United States Patent 10,696,975 (GENES AND USES FOR PLANT ENHANCEMENT) - sequence listing, part 6

SEQ ID NO: 22450 - protein, 397 aa, Thermococcus kodakarensis KOD1
MEIGLVGKPNVGKSTFFSAATLVDVDIANYPFTTIDANVGVTYAIAEHPCKELGCTPNPQNYEYKDGKALIPIKMIDVAGLVPGAHEGRGLGNKFLDDLRMASALIHVVDATGKTDAEGQPTDYHDPVEDIEFLEREIDYWILGILKKGWEKFAKRIKLQHMKLEGAIADHLSGISVSEEDVWEAIHRLGLSDDPTKWTDEDLFNFVRELRKVNKPIIIAANKADAASDEQLERLKKEGEKRGYIVIPTSAAAELTLRKAAKAGFIDYVPGSSDFKVLKKLSPKQEKALELIREKVLQRFGSTGVQEVINRATFELLKLIPVYPVQDENKLTDQFGNVLPHVYLLPKGSTPKDLAYKVHTDLGKTFLYAVNARTKRRVGDDYELQFNDIIKIVATAK

SEQ ID NO: 22451 - protein, 596 aa, Oryza sativa Indica Group
MVLPSLWWGWGFGFDVLILLSRVLIQSVWNWEGELIRSQFPLLLAVSQFRSRIEFVVMPDWRVGELRKKIQNIKMSAVSGIDSPSSKLLQFEGKLKDGFARSNNSEHENGAGTVSISSKKSKHGVASEKKPHVDISGLIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAAYQRDAMELLSSDQICTGQENLDMIGNRYSSENAMEQPEDQKFSIASGSQLSSSQNLLNQKNHLDSTSPMQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDA

SEQ ID NO: 22452 - protein, 255 aa, Bradyrhizobium sp. ORS278
MTGRFDLRGKVAIVTGGNGGIGLGMARGLADAGADIAVIGRNEAKSQAAIADLASRGVRAIAVTADVRNKNDVDAMVARVTAALGRIDILINNAGMSIRKPPHLLELEEWQEVIDTNLTSAFLCSKAAYPALKANGGGKIINIGSMLSIFGASFAPAYAASKGGIVQYTRACACAWAPDNIQVNAILPGWIDTDLTRAARQQIDGLHDRVLARTPAARWGHIDDFAGIATFLSSSASDFVTGTAIPVDGGYSIMA

SEQ ID NO: 22453 - protein, 365 aa, Zea mays
MALRRLLQGSVLPRVTGRASAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAETYPEIQYEEVIIDNCCMTLVKNPGLFDVLVMPNLYGDIISDLCAGLIGGLGLTPSCNIGEGGICLAEAVHGSAPDIAGKNLANPTALMLSAVMLLRHMQFNDKADRIHNAILQTIAEGKYRTADLGGKASTSEFTNAVCDHI

SEQ ID NO: 22454 - protein, 478 aa, Thermococcus kodakarensis KOD1
MRLPGQKTKIIATLGPASLNEKTITAMVRAGMSVARINFAHGDLKQHEKSIKLVRKVSERLNRPVAILGDLPGVKIRVGEIEGGSVTLRRWQTVTLTTRDVIGNEAVIPVEFKDFPRLVSKGDVIYLSDGFIALRVEDVRDQDVICKVLVGGTLFSRKGINIPKARLAIEAITEKDLEFLEFSLEHGVDAVGISFVGSAYDVLKARRFVEERNGKLFLIAKIERPDAVRNFDEILRAADGVMVARGDLGVEMPIEKLPILQKKLIQKANCAGKPVITATQMLESMTHEKLPTRAEVTDVANAILDGTDAVMLSEETAVGKYPVETVKMMARIAKTTEAYRDSKWAERTVEWKMSELRGTRPTKGTIKDAITRSIIEALNSIDIKYILTPTRMGQTARLIARFKPKQWVLAFVTDEWVKNTLMFSYGVYPFLVEDTSEEEILRVITGLGLVDEGDTVLLTKGTPIGKTAGTNTIRIFNV

SEQ ID NO: 22455 - protein, 487 aa, Exiguobacterium sibiricum 255-15
MSLQFTILLIGLLLFTAVWTTKLSSRLNIPALLIFIALGMIAGSDITGFIRFDDAELAQLLGTVALIIILFEGGLQTAWKEVKTELSPSLSLATFGVFIATTIVAVASHYILGFSWANAFLLGAIVGSTDAAAIFSVLSGQSVRRKVGSTLELESGTNDPMAVFLTVFFLEFVTNPKEASLVSGLTSLVWEMVIGLLLGLFIGWIASTLLNRIDLSSSSFYPILLMSFAFLSFGIADTIHASGFLAVYVTAIYISNHELVYRQTLVRFTMSMAHLAQIGMFIVLGLLVFPKQLLDPQVILSSIALALILIFIARPVSVWLSLLPFKYSWQEKVFVSFAGLKGAVPIILATYPLVAGIDNAGMIFNIVFFTVLLSTLIQGSMLTFLADRLHLNDTGSSAIQTVIEFMSIGKPNAEIIELTIPNSHPFVGKAIMDIDLPQEFLITAIIRDDQIVTPRGDTLFEGRDQLLLLTPKHRIKTLKRFLFPKTP

SEQ ID NO: 22456 - protein, 469 aa, Vibrio fischeri ES114
MSVENVLALIQENEVKFIDLRFTDTKGKEQHISIPSHQIDADFFEEGKMFDGSSVAGWKGINESDMVMMPDPASAVLDPFTEDSTLNIRCDILEPATLQGYDRDPRSIAKRSEEYMRSTGIADTVLIGPEPEFFLFDDVRFNTDMSGSFFKIDDIEAAWNSGTEYEGGNKGHRPGVKGGYFPVAPVDSSQDIRSAMCLIMEEMGLVVEAHHHEVATAGQNEIATRFNTLTTKADETQIYKYVVHNVAHAFGKTATFMPKPLVGDNGSGMHVHQSLAKDGVNLFAGDKYGGLSELAIYYIGGIIKHARAINAFANPSTNSYKRLVPGFEAPVMLAYSARNRSASIRIPVVPSPKARRIEVRFGDPAANPYLCYSAMLMAGLDGIKNKIHPGEAMDKDLYDLPAEEAAEIPTVAESLDIALKALDEDREFLTAGGVFSDDFIDSYIGLKSQDVEAINTAVHPLEFEMYYSV

SEQ ID NO: 22457 - protein, 303 aa, Burkholderia vietnamiensis G4
MSGFTNADVPDQSGKTFIVTGANTGIGLEIASTLAARRARVLLARRDEAKAEAAISRIRLKTPEANLAFLPLDLADLTSVRNAAKLVEKEPRVDVLINNAGVQGPKLKRTVQGFELTFGVNHLGCFAFTVLMLPRLTETSGSRIVVTSSGLHKSAKIEWDDLNAEKSYKWMPRYAASKLANLLFVFELDRRLRAAGIAVTALACHPGLAGTNLARDSWWGNIAMSLIGLFFNTPAQGAWGALQAATGQIKSGGYYGPTKTSELRGPSGECTPSQDARNPELAKRLWDVSVQLTRIDVELPSNA

SEQ ID NO: 22458 - protein, 190 aa, Triticum aestivum
  misc_feature (169)..(169): Xaa can be any naturally occurring amino acid
HYRTSLYKKAGWYRSGIPGISSTHASGPPLPSPRAPPSPSSSSIPMQQRRGRPSGTDGSDFSYRMVVDSRYQRVADGRSRLARLMLVQTLHQVAGGALLLLSLSKGAEINKFAVLSLAAGLLAILLGEFGRRRTVAVFLRLYTSLSSIAIAFSVTCIIRSDLFVKITKXNTAAITSYEMFDVVRVALGKF

SEQ ID NO: 22459 - protein, 223 aa, Brassica napus
MDGERRVHPDCINASNPYHECVEYCFKKIAEAKAKLEKLGLVEAVSGQSRESLADKRIEEESSEEEEEDEEDNQEPEVDVNQLTGRKKKLFELRLKMNEARKFNQTDVGSEKKKMEAPTEPKGISKQKWVEARQKKIGKILDANGLDMSKAYMLDTQEAAETKYKKWEKEPTPSGWDVFNQKTLYNAYKKRTKNIQVDIEEYNRMRAADPEFYREASSLQYGQ

SEQ ID NO: 22460 - protein, 451 aa, Pseudomonas aeruginosa UCBPP-PA14
MAGGEKAGKRGMGFWTCSALVIGNMVGSGVFLLPSSLAAFGGLSLFGWLVSSTGAVLLALTFARLARVNPGAGGPYAYTRDGFGSFAGYLCAWTYWKAAWIGNAAIAVTLVGYLRVFIPALADPLLMVCVAIAAIWLCTLINLRGIGTFSVVQNLLTILKLLPLLLVGILGWFHFNPEHLAIPARSELPNMGYAQAIATTAALTLWSFIGLESATVPADDVEDPRRTIPRATLFGTLAAAALYILSITAVQGLMPPEVLARSTSPFADAARILMGDWGYYLVAAGAVIACLGALNGWVLLQGQIPVAPARDGLFPESLGQLNKNGAPAHGLLASGLLVTALVMVDGHGDLVDVFNVIILLGTMTGVVPYAFCTAALLQLLAVRPDEFSPRSRRQLLVIGSLGFAYSLWALYGTGQQAIFWGFLVLMAGIPMYTWRQWRNQVNGVPTLKAND

SEQ ID NO: 22461 - protein, 120 aa, Brassica napus
  misc_feature (11)..(11): Xaa can be any naturally occurring amino acid
  misc_feature (20)..(20): Xaa can be any naturally occurring amino acid
  misc_feature (25)..(25): Xaa can be any naturally occurring amino acid
  misc_feature (29)..(29): Xaa can be any naturally occurring amino acid
  misc_feature (32)..(32): Xaa can be any naturally occurring amino acid
  misc_feature (35)..(38): Xaa can be any naturally occurring amino acid
  misc_feature (41)..(43): Xaa can be any naturally occurring amino acid
  misc_feature (46)..(46): Xaa can be any naturally occurring amino acid
  misc_feature (49)..(49): Xaa can be any naturally occurring amino acid
  misc_feature (53)..(55): Xaa can be any naturally occurring amino acid
  misc_feature (59)..(59): Xaa can be any naturally occurring amino acid
  misc_feature (61)..(61): Xaa can be any naturally occurring amino acid
  misc_feature (71)..(71): Xaa can be any naturally occurring amino acid
  misc_feature (74)..(74): Xaa can be any naturally occurring amino acid
  misc_feature (76)..(76): Xaa can be any naturally occurring amino acid
  misc_feature (78)..(78): Xaa can be any naturally occurring amino acid
  misc_feature (85)..(85): Xaa can be any naturally occurring amino acid
  misc_feature (87)..(87): Xaa can be any naturally occurring amino acid
  misc_feature (89)..(89): Xaa can be any naturally occurring amino acid
  misc_feature (97)..(101): Xaa can be any naturally occurring amino acid
  misc_feature (107)..(107): Xaa can be any naturally occurring amino acid
MAYSMLSSAGXVTSPAQATXGAPFXGLKXSSXFPXXXXGQXXXTFXVSXGRRXXXVEVXPXGGKKKFENLXYLXDXTXVNGVKEXYXLXPKGDSCGXXXXXHGFFYXEPPQGGELTPKPP

SEQ ID NO: 22462 - protein, 317 aa, Arabidopsis thaliana
  misc_feature (83)..(83): Xaa can be any naturally occurring amino acid
  misc_feature (104)..(104): Xaa can be any naturally occurring amino acid
MAATSLTAPPSFSGLRRISPKLDAAAVSSHQSFFHRVNSSTRLVSSSSSSHRSPRGVVAMAGSGKFFVGGNWKCNGTKDSIAXSLISDLNSATLEADVDVVVSXPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 22463 - protein, 203 aa, Oryza sativa Japonica Group
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSLPVIGSSFLVFL

SEQ ID NO: 22464 - protein, 440 aa, Zea mays
MSSSDETTGGSVAIAIVSVITGGIVVIVVSVLIYKCCKLRMIRKYGYGGDDDLPLRPVERWRAESVPVPPTGSSSSSYGTVDVVKDRPVRFSSSQLSEFTANYSERLGAGGFGVVYRGQIQLPAGGQGSSSTSLAVAVKVLGSNMGRRAEEQFMAEIGTIGRTSHVNLVRLYGFCFDADLKALVYEFMPNGSLDHHLFHDHDSDQNQKLGFGKLYDVAVGTAKAVRYLHDECERRIIHYDIKPGNVLLDEAFRPKVADFGLARLCERERTHVTMTGGGRGTPGYAAPELWMAAPATHKCDVYSYGMLLFEILGRRRNYVDDDVDGGARDAAAADSAERWYPRWVWQRLERGETEALAARALASKAGKEGRKKVERLCAVALWCVQYRPDDRPSMSGVVRMLEGDEDVAAPAVNPFAHLDSDLLSSRTSTAYTTTTFGSAA

SEQ ID NO: 22465 - protein, 465 aa, Lentinus sajor-caju
MFPGARILATLTLALHLLHGTHAAIGPAGNMYIVNEDVSPDSFARSAVVARSVPATDPTPATASIPGVLVQGNKGDNFQLNVVNQLSDTTMLRTTSIHWHGFFQAGSSWADGPAFVTQCPVASGDSFLYNFNVPDQAGTFWYHSHLSTQYCDGLRGPFVVYDPSDPHLSLYDIDNADTVITLEDWYHIVAPQNAAIPTPDSTLINGKGRYAGGPTSPLAIINVESNKRYRFRLVSMSCDPNFTFSIDGHSLLVIEADAVNIVPITVDSIQIFAGQRYSFVLTANQAVDKYWIRANPNLGSTGFVGGINSAILRYAGATEDDPTTTSSTSTPLLETNLVPLENPGAPGPPVPGGADININLAMAFDFTTFELTINGVPFLPPTAPVLLQILSGASTAASLLPSGSIYELEANKVVEISMPALAVGGPHPFHLHGHTFDVIRSAGSTTYNFDTPARRDVVNTGTGAN

SEQ ID NO: 22466 - protein, 224 aa, Magnetospirillum magnetotacticum MS-1
  misc_feature (10)..(10): Xaa can be any naturally occurring amino acid
VLRALKPITXADVQSVTVRGQYAAGAVNGRPVESYQADLGSDAASRTETFVALKLEVRSGRWAGVPFYVRTGKRLPKKLSEIVVQFRASPFSIFPAESFGREPNRLVIRLQPEEGMKLEVMTKDPGPGGMRLRPTNLDISFEETFKQRYPDAYERLLMDVVRGNATLFMRRDEVEVAWAWADTLLKAWAERPEPPRPYAAGSWGPTASIALIERDGRTWHEEIG

SEQ ID NO: 22467 - protein, 316 aa, Neurospora crassa
MAEQLILKGTLEGHNGWVTSLATSLENPNMLLSGSRDKSLIIWNLTRDETSYGYPKRRLHGHSHIVSDCVISSDGAYALSASWDKTLRLWELSTGTTTRRFVGHTNDVLSVSFSADNRQIVSGSRDRTIKLWNTLGDCKFTITEKGHTEWVSCVRFSPNPQNPVIVSSGWDKLVKVWELSSCKLQTDHIGHTGYINAVTISPDGSLCASGGKDGTTMLWDLNESKHLYSLNANDEIHALVFSPNRYWLCAATSSSIIIFDLEKKSKVDELKPEFQNIGKKSREPECVSLAWSADGQTLFAGYTDNIIRAWGVMSRA

SEQ ID NO: 22468 - protein, 345 aa, Yersinia pestis CO92
MHEAQTFSSTPATKPQYPLQRFSVAPMLDWTDRHCRYFHRLLTKQALLYTEMVTTGAIIHGKADYLAYSEQDHPVALQLGGSDPQALAHCAKLAEQRGYNEINLNVGCPSDRVQNGRFGACLMGEADLVADCIKAMRDAVAIPVTVKTRIGIDQLDSYEFLCEFVQTVAERGECEIFTIHARKAWLSGLSPKENREVPPLDYERVYQLKRDFPALTIAINGGVKTLAEAKEHLKHLDGVMMGREAYQNPGILTQVDRELFDPNAPVVDSVKAIEALYPYIEQELSQGAYLGHITRHILGIFQGIPGARQWRRHLSENAHKPGAGVSVVEEALALVSPSYYESVGG

SEQ ID NO: 22469 - protein, 207 aa, Burkholderia mallei ATCC 23344
MASQAPRDFEAQALGLVPIVVETSGRGERSYDIYSRLLKERIVFMVGEVNDQTANLVVAQLLFLESENPDKDISLYINSPGGSVSAGMAIYDTMQFVKPDVSTLCMGLAASMGAFLLASGAKGKRYALPNARVMIHQPLGGARGQASDIEIQAREILYLRDRLNHLLAHHTGQDVERIARDTDRDNFMSSEDAKAYGLIDHVSTKRP

SEQ ID NO: 22470 - protein, 138 aa, Shorea scaberrima
EKNIPVLLGLLSIWNVSFLGYPARAILPYCQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 22471 - protein, 354 aa, Schizophyllum commune
MGCVQSSGVDEEAKARNDEIESQLKKDRMMAKNEIKMLLLGAGESGKSTVLKQMKLIHHGGYNEQERDSYKEIIFSNTIQSMRAILEAMPQLDIPLTPQNDARRAVIMSMPMQIEADVLPPDVVDAIRSLWKDPGVRQAVQRSREFQLNDSAVYYFNSIDRMAAPNYMPTDQDILRSRVKTTGITETTFKVGELTYKLFDVGGQRSERKKWIHCFENVTALVFLVSLSEYDQMLYEDESVNRMQEALTLFDSICNSRWFVKTSIILFLNKIDLFAEKLPRSPLGDYFPDYTGGDNYDAACDYLLHRFVSLNQSAATKQIYAHYTCATDTQQIKFVLSAIQDILLQLHLRECGLL

SEQ ID NO: 22472 - protein, 248 aa, Corynebacterium glutamicum ATCC 13032
MTNGKLILLRHGQSEWNASNQFTGWVDVNLTEQGEAEAKRGGELLVEAGVLPGVVYTSLLRRAIRTANIALNAADRHWIPVIRDWRLNERHYGALQGLDKAATKEKYGDDQFMEWRRSYDTPPPELADDAEYSQANDPRYADLDVVPRTECLKDVVVRFVPYFEEEILPRAKKGETVLIAAHGNSLRALVKHLDGISDADIAELNIPTGIPLVYEIAEDGSVVNPGGTYLDPEAAAAGAAAVANQGNK

SEQ ID NO: 22473 - protein, 510 aa, Desulfitobacterium hafniense DCB-2
MAQELVLVLDFGGQYNQLIARRVREAHVYSEMISYKTPVEEIKARNPKGIIFSGGPASVNQEGAPKVDEAIYELGIPIFGICYGMQLMTVQLGGKVMHPEVREYGKAMLHVDQAKGLWKGLGGERQCWMSHGDSVTELPEGFVIAAHTDHTPVAAMMDETRHFYGVQFHPEVKHTPDGQAMLKHFLFDICGCHGEWTMESFIDAQVKAIREKVGDRQVLCALSGGVDSSVAAVLVHKAIGDQLTCVFVDHGFMRKNEPEQVKKIFTEQFHLKLIFVDARERFMAKIGGVSDPETKRIGIGNEFIRLFEDEARKLGQIDFLVQGTLYPDIVESGTDTAETIKSHHNVGGLPEDMQFELIEPLDMLFKDEVREVGAELGIPDEIVWRQPFPGPGLAIRIIGEVTEEKLDILREADAVIVEEIRNAGLYKEVWQSFAVLPTIKSVGVMGDGRTYAYPIVVRAVTSEDAMTADWARLPYDLMEKISTRIVNEVKGVNRVVYDITSKPPGTIEWE

SEQ ID NO: 22474 - protein, 189 aa, Methanosarcina acetivorans C2A
MRELKILVVNNYGQFCHLIHRAVRDLDMDTKIIPNVTPIEDILAEEPDGLILSGGPEMERAGLCFDYVREIDIPILGICLGHQAIALAYGGHVHSGKKGGYAEIEIEVIEEDDILRGLGPKITVWASHADEVAILPEGFIHLARSDICEIEAMRHPTKPIYGVQWHPEVSHTKKGDELLTNFFEVCDRY

SEQ ID NO: 22475 - protein, 327 aa, Yersinia pestis CO92
MAKHIQFTTTGGPDVLQYLEFTPSDPAPHEVQVENKAIGINYIDTYVRSGLYPPAHLPSGLGTEAAGIVSKVGAAVSSVKVGDRVVYAQSALGAYSEVHNVPADKIALLPEQISFEQAAASFLKGLTAYYLLRQTHEIKPGEVFLFHAAAGGVGLIACQWAKALGAKLIGTVGSDEKAQLAKAAGAWATINYRTENIAQRVAELTEGEKVGVVYDSVGKSTWEASLDSLKRRGLLVSFGNASGPVTGVNLGILNQKGGIYVTRPSLNVYVANRQELESASQQLFSMITSGAINVDVAQAQQFPLRDAQRAHETLEGRQTTGSSLLIP

SEQ ID NO: 22476 - protein, 351 aa, Schizophyllum commune
MGACVSSSSQPVADVQAKERSDEIDSQIKADSERLKKECKILLLGSGESGKSTIVKQMKIIHKNGFSPQELASFRPTVYRNVIDSAQAVAQIIKKANPESPNLALLDKIIDYDANGIVTPDLADAIRRITSDPATPKIIDEHANEFYLMDNAAFFENVVRIGAEKYVPTETDILRARVKTTSISETRFACGPLTIHMFDVGGQRSERKKWIHCFESVTSIIFCTALSEYDQVLLEEKNQNRMAESLTLFESVINSRWFLRTSIILFLNKTDVFKIKLPKVPLDRYFPEYTGGNDINKAAKFILWKFMQANRARLSVYPHLTQATDTKNVRHVFAAVKETILHNALKDSGIL

SEQ ID NO: 22477 - protein, 365 aa, Chlamydia trachomatis D/UW-3/CX
MSIEVRIPNIAESISEVTISALLIPSGDLVQENQGILEIESDKVNQLIYAPCSGRVEWSVSVGDTVAVGSVVGIISEAEKSQDTAPIHEQMPFSLVEQESDAQIIAFPSSVRQDPPAEGKTFVPLKEIQPASSDHRESRESMSAIRKTISRRLVQSLHDSAMLTTFNEIHMGPLIALRKERQEDFVAKYGVKLGFMSFFVRAVVDSLKKYPRVNAYIEDNEIVYRHYYDISIAIGTDRGLVVPVIRNCDQLSSGEIELQLADLASRAREGKLAIHELEGGGFTITNGGVYGSLLSTPIINPPQVGILGMHKIEKRPVVREDAIVIADMMYVAMSYDHRIIDGKEAVGFLVNVKEQLEQPELLLKM

SEQ ID NO: 22478 - protein, 216 aa, Campylobacter jejuni RM1221
MNDRFTRIKWLVGEEKFQKISQTKVLVCGLGGVGGICVDALYRSGFQNLTLIDADKFEITNQNRQIHSENLGEEKAKVFARIYNAKGIVSKIDNEFLANFDLSEFDLIIDAIDDIPAKVALANLIDFKRQIFISSTGGARKLDPTRIKTTSIFKTHGDALAKKFRYELRKSGFKGNFDVVFSDEEAHCKDLGSFMGVTASFGLALASLALRKVLAR

SEQ ID NO: 22479 - protein, 183 aa, Candida glabrata CBS 138
MLSRISMQKRFLSSTVAKLGKKVYFEPSVNGSRIGRIEFELYDDVVPKTAENFRALCTGEKGWGYKGVPFHRIIPQFMIQGGDTDLTNGFGGKSIYGNKFADENFTKTHDKPGLLSMANAGPNTNGSQFFITTVPCPWLDGKHVVFGEVTKGMDIVKTIESYGTMSGQPRAKIVVEESGEIKE

SEQ ID NO: 22480 - protein, 666 aa, Phaseolus vulgaris
MAAISCILSLLLSSLIAQVSAQFNTEYCDNNKGNYTINSTYHNNLNTLLSTLSSHTQINYGFYNFSHGQNNDKVNAIGLCRGDVKPDECRRCLNDSALTITQLCPNQKEALLWLNTSKCLLRYSHRTIFGVMESSPGFYLTNVNNVTEADKFNQALSNLMRNPTVVAASGDSRLKYAADSAIAANFQTVYGLVQCTPDLSETDCNRCLDGAISEIPSCCGNKMGGRVLRPSCNIRFESAIFYDSNAKLDPDVTPPSPPPSSFTNTSPKESNNTITIVIAVVVSIVVVAVVSLLGLCIYLRRKKARKSPTVNQDDDDDDIEISQSLQFDFDTIRVATEDFSNSNKLGQGGFGAVYRGRLPNGQMIAVKRLSSGSSQGDTEFKNEVLLMAKLQHRNLVRLLGFCLEGRERLLIYEFVPNKSLDYFIFDPVKKAQLDWEMRYKIIRGIARGLLYLHEDSLLRIIHRDLKASNILLDEEMNPKIADFGMARLVLLDETHANTNRVVGTYGYMAPEYIMQGQFSVKSDIFSFGVLLLEIVSGQKNSGFRHGENVEDLLSFTWRNWRDGTAVNIVDPSLENNSRNEVMRCIHIGLLCVQENLTDRPTMATIMLMLSSYSLGLPIPSEPAFYANSTARSLPATSSWGHSSRATANQSAQESENENSITEPYPR

SEQ ID NO: 22481 - protein, 230 aa, Dehalococcoides sp. BAV1
MIKDIRNVFSKDPAARSVAEVLFCYPGLHALWFHRVANWLWRHKLHFWARWLSHGGRFCTGIEIHPGAKIGQRFFIDHGMGVVIGETSEIGNDVLMYQGVVLGGTSLSKGKRHPTICDNAVIGTGAIVLGGITVGEGAKVGAGSVVTKDVPAGATVVGIPGRVVEESRRMVIDLEHGKLPDPVADALKVVLAEQQKLMDRLAQLEKNSGLKVPQDELRGQIREIMKEFNL

SEQ ID NO: 22482 - protein, 398 aa, Bradyrhizobium sp. BTAi1
MNIHEYQAKALLHEFGVPISKGVPVLRPEDSDAAAKALGGPVWVVKSQIHAGGRGKGKFKEASAGDKGGVRLAKSIDEVNAFAKQMLGATLVTVQTGPDGKQVNRLYIEDGSDIDKEFYLSLLVDRETSKVAFVVSTEGGVNIEDVAHSTPEKIITFSVDPATGVMPHHGRAVAKALKLSGDLAKQAEKLTIQLYTAFVAKDMAMLEINPLVVTKQGQLRVLDAKVSFDSNALFKHPEVVALRDETEEDAKEIEASKYDLNYVALDGTIGCMVNGAGLAMATMDIIKLYGMEPANFLDVGGGASKEKVAAAFKIITADPNVKGILVNIFGGIMKCDVIAEGVVAAVKEVGLKVPLVVRLEGTNVDLGKKIISESGLNVLPADNLDDAAQKIVKAVKGG

SEQ ID NO: 22483 - protein, 276 aa, Vitis vinifera
MDEEGIGVVLARASELRSKFTNCIHKATTQGDEVEEGEEKEEGEAASETLLNIRDALESLESQLSSLQGLQQQQWYEREAALAEIDYSRQKLLKKLKQYKGEDLEVIHEASAFASETVEHSNDLLLPPYPSRPPRSLVADNGHMSHFPFMRKSNQNGNEKLNESERNQMHSGSKNTSKGLGIFFNGAKMVLTLVGVISILSLAGVEPRFRKRDAYFNILGLFQQSATEEKRSNTVECPPGKVLVLEDGEARCLVKERVEIPFESVVATPDVNYGCG

SEQ ID NO: 22484 - protein, 411 aa, Bradyrhizobium sp. BTAi1
MTEIRVPTLGESVTEATIGRWFKKAGDAVAVDEPLVELETDKVTIEVPAPSAGTLGEIIAKDGETVAVGALLGQINDGAVAAKPAAAAPAPAKPAAAPAAAAPAPAKALPADTPQAPSVRKLSAESGVDATTVPGSGKDGRVTKGDMLAAIERAASAPTPVNQPAAAVQVRAPSPADDAAREERVKMTRLRQTIARRLKDVQNTAAMLTTFNEVDMTNVMALRSQYKDVFEKKHGSKLGFMGFFTKAVVQALKDIPAVNAEIDGSDLIYKNYYHIGVAVGTDKGLVVPVVRDCDHKSIADIEKGIADFGRRARDGQLKIDEMQGGTFTITNGGIYGSLMSTPILNAPQSGILGMHKIQERPVVVGGKIEIRPMMYLALSYDHRVIDGKEAVTFLVRVKESLEDPARLVLDL

SEQ ID NO: 22485 - protein, 649 aa, Coccidioides immitis RS
MSFPFASVTSYSPRLRQYANALLTPVLPATQTPASRTTKRGTAAINYAENDIDEEDFDDSDSTRRPTGLRSLKREDIHPDRGPTGEKLGTEIFAPANVQPNFREWLLRRRPKAMKEVQLTGYGLLPLNLVPIRIDLEVPAHQPLEPFPLPRNYLELGINPTAPAYRKPEAAPPYRIKDFILWNLHEPFITPEEYAVTFVRELDLPNLPMMVTAVCNQIRQQLEEYAGVAMHPIFQKIPASKNTLSRTQYIPESPTPAQISATTPANQADAAGKQAISQGVSSDDNSFNTDDAYRCIVILDITLQNKLYTDKFEWSLLHDQGLADQFARMTCADLSLGPEWVNVISHGICETVLKLKKEACESGGLVGIGGDGAEIDNLAANGREAGWRYDPDGLGDEWEPRVQILSKEDIEKREGDRERQIRRLRRETARFSSTANMSLDMTRQSSGGYFDLPDPDTPLGRGERNKRRRRARSNSPASGTPGGRDKAGDAPIAPGQDTPLGPREMGLRGQRFSAKIAEWNMNGTAGYQRGRRTFLPLDEFSHNVHLSCVLREILICTLFLLWTKLVQTGLSGTLFTVCCTQNGFVWRLNQKEGFFRSAGAALATGRLFYLAWYSGIRGCLMGVYGDSRRISSLFMFPTGSQHENCPKLI

SEQ ID NO: 22486 - protein, 498 aa, Olimarabidopsis pumila
MRINPTTSDPEVSIREKKNLGRISQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFKLILSGEFDSLPEQAFYLVGNIDEATAKATNLEMESKLKK

SEQ ID NO: 22487 - protein, 406 aa, Bradyrhizobium sp. ORS278
MEDFYRIRRLPPYVFEQVNRAKAAARNAGADIIDLGMGNPDLPAPAHVLEKLKETLGKPRTDRYSASRGIVGLRRAQAAYYDRRFGVKLNPDTQIVATLGSKEGFANVAQAITAPGDVILCPNPSYPIHAFGFLMAGGVIRSVPAEPTPQFFEAAERAIIHSIPKPLALIVCYPSNPTAYVASLDFYRDLVAFAKKHEILILSDLAYAEVYFDDNNPPPSVLQVPGAMDVAVEFTSMSKTYSMAGWRMGFAVGNERIIAALARVKSYLDYGAFTPVQVAATAALNGPDDCIREMRDVYRKRRDTLVESFGRAGWDIPSPEASMFAWTPLPEKFKSLGSMQFATLMVEKCGVAVSPGVGFGEHGEGYVRIAMVENEQRIRQAARGVRRFLESGIETLHNVVPLANRR

SEQ ID NO: 22488 - protein, 467 aa, Bradyrhizobium sp. BTAi1
MANYDLVVIGTGPGGYVCAIRAAQLGMKVAVVEKNATLGGTCLNVGCMPSKALLHASELFEEAGHSFAKMGIKVPAPEIDLPAMMNFKQQGIDGNVKGVEFLMKKNKIDVLQGKGKILGTGKVQVTGNDGTAQTVETKNIVIATGSDIARLKGIEIDEKRIVSSTGALSLDKIPSSLLVVGAGVIGLELGSVWRRLGAKVTVVEFLDRILPGMDLEIAKQFQRILEKQGFAFKLGAKVTGVDTSGATLAATIEPAAGGAAEKIEADVVLVAIGRVPYTDGLGLQEAGVVLDNRGRVQIDHHFATSVPGVYAIGDVVAGPMLAHKAEDEGVAVAEILAGQAGHVNYDVIPGVVYTTPEVASVGKTEDELKQAGVAYTVGKFPFTANGRSKVNQTTDGFVKILADAKTDRVLGAHIIGREAGELIHEAAVLMEFGGSAEDLARTCHAHPTRSEAVKEAALAVGKRAIHM

SEQ ID NO: 22489 - protein, 312 aa, Exiguobacterium sibiricum 255-15
MTTTQRLKHLLTLEELTAEGLTDLLELAKDVKASPATYAQTLAGKKVALLFEKASTRTRISFEVGVVELGGYPVVLNGSDMQIGRGESLSDTIQVMSRYVDALMIRTFAHETVETLAAHGTIPIINGLTDLHHPCQVLADLLTIEEHFGQRKGKILAYIGDGNNMTHSLLLGGALSGMTVRICSPAAYAPDQTIIDQAKMLAQQSGGQIEQYTDPVQAVAGADVIYSDVFASMGQEEESEARLKAFEGYQVNQTLLSSAATDVIFLHCLPAHRGEEVTAEVIDGSHSLVFDQAENRLHAQKALMIELIGVMD

SEQ ID NO: 22490 - protein, 351 aa, Exiguobacterium sibiricum 255-15
MKGTGALTLADGHVYPGELIGSSSVQGEVVFFTGMTGYQEVLTDPSYRGQIIVFTYPLIGQYGISEQDSESRQIQVSGVVVQTLANNGLRSDLADWLAASDIPVLTQVDTRALVHHLRNQGDQIGILTCGTSSVQEQSNLIATVSIKQPEVYPTDYEAGHIVCLDYGVKKSMIEALQERQMKVTVVPFDTPKTVIDELKPDGLLFSNGPGDPSQLDHLIPEINKLALAYPTLGICMGHQLIAKAFGCRIEKQHHGHRGANHPVRQLKTGRVFMTSQNHGYVVQADSVQNSELNVAYEHINDGSIEGLLHPTHPILTVQFHPEAHPGPLEAMVIFDQFVAGILKQEVAYAGS

SEQ ID NO: 22491 - protein, 54 aa, Vitis vinifera
MFSGMFARKPDKAVALKQLRTHVVMFGAWVAVVRVTPYILHYFSDEKEELKIDF

SEQ ID NO: 22492 - protein, 315 aa, Zea mays
  misc_feature (227)..(227): Xaa can be any naturally occurring amino acid
MAASNIGMMDGAYFVGRNEILAWINTTLQLGLSKVEEAASGAVACQLMDAAHPGAVPMHKVNFDAKTEYDMIQNYKVLQDVFNKLKITKHIEVNKLIKGRPLDNLEFMQWMKRYCDSVNGGFMSSYNASERRESSKGGKETNRRASVPSHTPAKSASTGHKAQASHGAKRASGQTAGAPQRSAKPSPAASSGGPAYDEQITELKLLVDSLEKERDFYFSQLRDIEIXLCQNPEVEHVPVHAIQNILYTSEGDPQQQAPALSPIMEASEERPKQEAAPKRKSISDLDEFGMSSSSRQRLSDISDGQLCGSPLTSFS

SEQ ID NO: 22493 - protein, 630 aa, Vitis vinifera
MAEKIGAAPPPASFEYELFEGDPDHLRTVAATSTQLSPWIDPASLKLKHRIGRGLFGDVWLATHHQSADDYDEYHEVAVKMLHTIREDHMQMFLDKFAGIFLKCRQLKGVCWLHGISIKTGKVCIAMKFYEGSVGDRMAHLKGGKLPLSDVLRYGIELAKGIMELHSTGVLVLNLKPSNFLLNEHDQVVLGDMGIPYLLLGIPLPNPDMVLRLGTPNYMAPEQWEPEVRGPISCETDTWGFGCSIVEMLTGVQPWCGRSIEEIYQSVVIKQEKPHIPSGLPPEVENVLNGCFEYDLRNRPLMVDILQAFESSQNAVYSDGGWIGLESRTCTERSNSRGYTSWFLSKDSLHVGDIVRSRKPLNACKPQIMDVPEGTVVGFDGDNDRDGFVLVKIRGKHNPLRVHVSTLERVTSGLVVTDWVRLKEPNRKHSTVGILHSVQRDGSVAVGFLGLETLWRGHSSELQMAETYYVGQFVRLKTNVFTPRFDWPRKKGGAWVTGRIAQVLPNGCLVVRFPGRFVFGVESNSFLADPAEVELVSFDKCHGVVEKYHHIEDFHWAVRPLVIAFGVFTTLKLGVFVGGNVCVRMRKSPRNLTPNDGQCQDGQAGGNPAWIPPTVANILFREGPPTATAR

SEQ ID NO: 22494 - protein, 380 aa, Exiguobacterium sibiricum 255-15
MSALLPTYLRHDIELVAGNGSFVQDKAGKNYLDFVMGIAVCNTGHRHPHVEQALQEQLQKLWHTSNLFMSSKQERVAAMLTENSHLSHVFFCNSGTEANEGAFKLIRKWTQKKEILTFSQSFHGRTFAMMGATGQDKIKAGFGEMVPDFKHLTFNDFDSLEMITNQTAAVWLEVIQGEGGVIVAENAWLEALMEKARQYDVKVVIDEVQTGIGRTGSRFAFEQTPLKPDIITVAKGLGSGFPVGAIITTPEATAVFTPGTHGSTFGGNPLAMAAAEATLDVLLNEQQMKQVQQKGLYLMQQLKQLPETMVVDVRGRGLMIGIEFHEPVSSLITALQQAGMLVVSAGPNVIRLLPSLCVTEQELDLAVGKIKTVCQQEVMM

SEQ ID NO: 22495 - protein, 534 aa, Burkholderia sp. 383
MRLANASCERPSHTSFATAPDHGFTTIGNHIMYDTEPLAATRGPAGGQPEPRRVRNFIDGDYRAGDRWFDKRSPLDNAVIARVAEASRADVDAAVQAARAALSGPWGGLTVAQRVDILYAVADGITRRFDDFLEAEVADTGKPVSLASHIDIPRGAANFKVFADVVKNVPGETFEMATPDGAGALNYAIRRPVGVVGVICPWNLPLLLMTWKVGPALACGNTVVVKPSEETPQTAALLGEVMNAAGVPRGVYNVVHGFGPGSAGEFLTTHPGVNAITFTGETRTGAAIMKAAADGARPVSLEMGGKNAAIVFADCDFDAAVEGTLRSCFANAGQVCLGTERVYVERPLFERFVAALKAGAEQLRPGRPEADTTGIGPLISQEHRDKVLSYYRKAAELGATVVTGGGVPDMPADLRDGAWVQPTIWTGLGDDSPIARDEIFGPCTLVMPFDSEAEVIGRANANAYGLSTAIWTTHLARAHRVAASIDVGIAWVNSWFLRDLRTAFGGAKQSGIGREGGVHSLEFYTELRNVCIKL

SEQ ID NO: 22496 - protein, 138 aa, Shorea scaberrima
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELQK

SEQ ID NO: 22497 - protein, 329 aa, Arabidopsis thaliana
MATNIGMMDSAYFVGRSEILAWINSTLQLNLSKVEEACSGAVHCQLMDSVHPGTVPMHKVNFDAKSEYEMIQNYKVLQDVFNKLKITKHIEVSKLVKGRPLDNLEFMQWMKKYCDSVNGGQHNYHALERREASKGGKEATKRAAATQQSGKSSSSSAPPRPSSSNGTRKHEPQSNNTGTHHSSTGNHHHSSKPSAKQSKPVPAYDEKITELKLYIDSLEKERDFYFSKLRDVEILCQNPDTEHLPLVGSIKRILYAADGEDVGAAETQTLSPIAEGSEERRNSVTESQKRKLIVNLDVDVAAITTLSPRQRLSDASDVKCSGSSPLLTC

SEQ ID NO: 22498 - protein, 273 aa, Corynebacterium glutamicum ATCC 13032
MGTMTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 22499 - protein, 325 aa, Bradyrhizobium japonicum USDA 110
MDASSATRAAHQPGRGRIYDSIVEAFGDTPIVRLRRLPGMHGVNATILAKLEYFNPAASVKDRIGAAMIIAMEKAGIVKPDTVLIEPTSGNTGIALAFVAASRGYRLKLVMPESMSIERRKMLAFLGAELVLTPAAQGMKGAIAAAEELVKTTPNSVMPQQFKNLANPEVHRRTTAEEIWNDTDGNIDFFVAGVGTGGTITGVGQVLKPRKASLRVVAVEPEESPVLSGGQHTPHKIQGIGAGFVPDILDRSVIDEIVKINSTTAIETSRALARHEGIPGGISSGAAIAAALQIGQRPEAAGKTILAVVPSFSERYLSTALFEGI

SEQ ID NO: 22500 - protein, 480 aa, Chlamydia trachomatis D/UW-3/CX
MAPNTDIGLIGLAVMGKNLVLNMVDHGFSVSVYNRSPAKTEEFLKDHGESGALQGFTTIQEFVQSLKRPRKIMIMIKAGAPVDEMIASLLPFLEEGDILIDGGNSYYLDSEQRYVDLKKEGILFVGMGVSGGEEGARKGPSIMPGGNIDAWPAIAPIFQSIAAQVDGRPCCSWIGTGGAGHFVKAVHNGIEYGDIQLICETYEILKTRLNLSLEQIGNIFFEWNQTDLNSYLIGAAAAVLIAKDENGNAIASTILDVAGQKGTGRWVAEDAIKAGVPMSLIIESVLARYLSTWKEVRTKAAQEFPGIPLLCQPPQEASAFIEDVREALYAAKIISYAQGFMLLKQVSQDKGWDLNLGELALIWRGGCIIQSAFLDKIHQGFENSPEAHSLILQDYFKKVLFDSETGFRRAVLHAIGSGVAIPCLSSALSFYDGYRTVDSSLFLVQGLRDYFGAHGYERRDCPRGEFYHTDWLETKKTFRV

SEQ ID NO: 22501 - protein, 294 aa, Medicago sativa
MEQYEKVEKIGEGTYGVVYKARDRATNETIALKKIRLEQEDEGVPSTAIREISLLKEMQHRNIVRLQDVVHSEKRLYLVFEYLDLDLKKFMDSSPEFAKDQRQIKMFLYQILCGIAYCHSHRVLHRDLKPQNLLIDRSSNAVKLADFGLARAFGIPVRTFTHEVVTLWYRAPEILLGSRHYSTPVDVWSVGCIFAEMINQRPLFPGDSEIDELFKIFRITGTPNEETWPGVTSLPDFKSAFPKWPAKDLATQVPNLEPAGLDLLSSTCRLDPTRRITARGALEHEYFKDIKFVP

SEQ ID NO: 22502 - protein, 989 aa, Arabidopsis thaliana
MALVSLLEISIAFFCFLIFRIFLISKKPHRSFLTNWPLLGMLPGLLTVLPRVYDFITEVLEDGNLNYLFIGPFLGGIDMLFTVDPANIHHIMSSNFANYPKGTEFKKLFDVLGDGIFNADSDLWKDLRKSSQSMMNHPDFQRFSLATSLSKLEKGLVPLLDHVAKEKLVVDLQDVFQRFTFDTTFVLATGYDPGCLSVEMPEIEFARALDDAEEAIFYRHFKPEVVWKMQRLIGVGAELKLKRAHAIFDRVCSKCIASKRDEISQGIDSSSSKDLLMSSINVDTTKYKLLNPSDDRFLRDTILSFMLAGRDTTGSALTWFFWLLCNNQEAMTKIRQEINTNLFPRNKTDDGSVSYDSDSFNPQEVKKLVYLHGAVCEALRLYPPVPFNHKSPAKPDVLPSGHKVKANSRILFCLYSLGRMKSVWGEDAMEFKPERWISESGRSVHEPSYKFLSFNAGPRTCLGKEVAMTQMKTVAVKIIQNYDINVVEGHKIKPAPSVILHMKHGLKVTVSKRCLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 22503 - protein, 528 aa, Chlamydia trachomatis D/UW-3/CX
MTQTAEKPFGKLRSFLWPIHMHELKKVLPMFLMFFCISFNYTILRDTKDTLIVTAPGSGAEAIPFIKLWLVVPSAVVFMLIYAKLSNILNKQALFFAVLSPFVVFFALFPVVIYPCRHILHPTAFADTLQSILPSGFMGFIAMLRNWTFAVFYVLSELWGSVMLSLMFWGFANEITKISEAKRFYALFGVGANVALLISGPAIIWSSKLRASLGEGVDPWGVSLYFLMAMFLCSCAIIAACYWWMNRYVLTDPRFYNPAELKAKKSKPKMSMGESFSYLLRSPYMLLLALLVICYGICINLVEVTWKSQLKMQFPNPNDYSAFMGNFSFWTGVVSVFVMLFIGGNVIRRFGWLTGALVTPIMVLVTGAVFFALVIFRDHATGLVAALGTTPLMLAVVVGAIQNILSKSTKYALFDATKEMAYIPLDQEQKVKGKAAIDVVAARFGKSGGSLIQQGLLVVCGSIGAMTPFLAVALFAIIMVWLTSATKLNKLFLAASAAKEQELAEAAAAEKEASSAAKESAPAIEGVS

SEQ ID NO: 22504 - protein, 250 aa, Oryza sativa Indica Group
MKFNIANPTTGCQKKLEIDDDQKLRAFYDKRISQEVSGDALGEEFKGYVFKIMGGCDKQGFPMKQGVLTSGRVRLLLHRGTPCFRGYGRRDGERRRKSVRGCIVSQDLSVINLVIVKKGDNDLPGLTDTEKPRMRGPKRASKIRKLFNLAKDDDVRKYVNTYRRTFTTKNGKKVSKAPKIQRLVTPLTLQRKRARIAQKKQRIAKKKSEAAEYQKLLAQRLKEQRERRSESLAKRRSKLSAATKAAATTA

SEQ ID NO: 22505 - protein, 427 aa, Campylobacter jejuni RM1221
MQNEILKKLDLEHIWHPCTQMKDHENLPLIPIKRAKGVWLYDFDDKAYMDCVSSWWVNLFGHCNEKIANAIKKQVDELEHVILAGFTHEPIIKLSARLCEKVGRNFNKCFYADNGSSAIEVALKMSFHYHLNKGVKKSKFLSLSNSYHGETLGALSVGDVALYKDTYKPLLLECLSTPVPQGKDYTQELEILKDILEKNASEICAFILEPLVQCAGNMHMYEAGFIDEAIKLCHKFGVQVIFDEIAVGFGRTGTLFALHQCKQSPDFICLSKGITGGFMPLSVVLTRDEIYNAFYDTYESQKAFLHSHSYTGNTLACAAANAVLDIFEDENILVKNQILSEFIKKEFSRLEKFDFLGNFRTCGMISAFDILSTKYKRVGLFVFQKALEKGLLLRPLANTIYFMPPYIITKEQIVYVLESLEQIFKEF

SEQ ID NO: 22506 - protein, 257 aa, Exiguobacterium sibiricum 255-15
MTKRKLIKLGGSVFEQLDPRYYEEWGQWLAEKNELIILHGGGPALSAYCRDMNIKAEFNNGIRVTTEQVLLGAERVLGGEVQSKIVYELNENGLPAIGLTGIDGASIRGEQQPAFGAVGEVTQINPKLFTTLMASGFLPVVTSLITGTEGTLNCNGDTCAIAVAKGLAVDEFELLTDVSGVRLNGTFQSEVTVAELEEGIESTEINGGMIPKVEAVIEAVRQGIHQVKIRSGHDVTSQGTRIKEETNERFTTDVFTS

SEQ ID NO: 22507 - protein, 682 aa, Kluyveromyces lactis
MSSVAASQNKINDLLEAIRQEFANVSQEANSYRLQNQKDYDFKINQQLAEMQQVRNTVYELELTHRKMKDAYEEEISRLKLELEQKDRQLASIAHGSTVGNVPGQVPQLSRNSGAQGNANIAPPNIPQPMVSQTVGTGMAPQMAPLNTQHPTQQTKSNAGEQAAANLAPVIQQQQQPQQQLPPQQQQQQQQQQQSNIPVTTAAPVQPAGGNLDQTVPNSISPQQQPTEQQQPASTATTAPATASTAPPTSAPSDQVGQDHYLVPADQRAVHAKPIPPFLLDLDSQLVPSHLKKQNNDYYVLHNPALPTDLDVELHKSLEHSSVVCCVRFSSDGEFLATGCNKTTQVYKVSTGELVARLSDDSASQPQPQPQNQTVTAETSTSNSNGSSAEDGTGNQNSAASTASSDLYIRSVCFSPDGKFLATGAEDKLIRIWDLETKKIVMTLKGHEQDIYSLDYFPSGNKLVSGSGDRTVRIWDLTTGTCSLTLSIEDGVTTVAVSPGEGKFIAAGSLDRTVRVWDSDTGFLVERLDSENELGTGHRDSVYSVVFTRDGKGVVSGSLDRSVKLWNLNGLSGQKSHAECEVTYTGHKDFVLSVATTQNDEYILSGSKDRGVLFWDTKSGNPLLMLQGHRNSVIYVTVANGHPLGPEYGVFATGSGDCKARIWKYSKKNGQQNSTQIKEIKE

SEQ ID NO: 22508 - protein, 718 aa, Idiomarina loihiensis L2TR
MIYQGESIRVDFIEPGFAELQFDAKGSVNKFDQATLEEFSEALTKLQNTDDLRGVIVTSSKSTFIVGADITEFLTLFSDQEKTRSWVAKASRVFDQLEDLPVPTVGAVTGFALGGGCEALLACDYRVADTTATIGLPEVKLGLIPGFGGTMRLPRVIGPDNALEWITTGKNNKALDALKVGAVDAVVEPENLTKAALNLAKAAAAGQQDWKAKRQPKLEPLKANDTELMMTLVTAKGMIAAKAGKHYPAPHKALEAIENGAREHREGALTAENNAFFDLTQTEACQAQVGIFLADQAVKGKSKKYAKAATKEIKTAGVLGAGIMGGGIAYQSALKGVPAVMKDIKQDALDLGMKEAGKILKKGVERGKVNNEKMIKILSSITPTLLNDAVKDVDIVVEAVVENPKVKGSVLAEIEGVIGDDAILTSNTSTISITELAKNLKRPEKFCGMHFFNPVHKMPLVEIIRGEKTSDDTVNAVVAYALKLGKTPIVVNDCPGFLVNRVLFPYLAGFAGMVDEGVDFVGIDKVMEKQFGWPMGPAYLSDVVGIDTADHCTVVMEAGFPTRMKRDESSAIAKLAAAERYGQKNGKGFYVYGTDKKGKPTKEADPATYELLGCEQGKKLDADEVIARCMIPMVNEVVRCLEEDIVGSAAEADMALLYGLGFPPFRGGPFRYLETLGMDNFIQLADKYAHLGEIYQVTDGMREMAKAGKSYFDTTSAK

SEQ ID NO: 22509 - protein, 580 aa, Prochlorococcus marinus str. MIT 9211
MTNIHFKRRTKIVATIGPATESKERITELVEAGATTFRLNFSHGDHSEHAKRIETIRLVEAKLGVKIGILQDLQGPKIRLGRFKDGPIRLNSGDKFVLTSKDVGCNNEIANVTYEKLVSEVSINKRILLDDGRVEMVVERVDKLEEKLHCKVVVGGMLSNNKGVNFPDVQLSINALTPKDKIDLSFGLSQSIDWVALSFVRNPDDIKEIKELIRSHGYTTPVVAKIEKFEAIDQIDAILRLCDGVMVARGDLGVEVPAEEVPLLQKELIKKSNSLGIPIITATQMLDSMASSPRPTRAEVSDVANAILDGTDAVMLSNETAVGDYPIEAVKTMATIAKRIEKDYPQRALESHLPSTIPNAISAAVSSISRQLNASAILPLTKSGSTAHNVSKFRPPTPIVAVTNETDVARRLQLVWGVTPIVIKEQETTTKTFNLAMEMAQGMGLLKPGALVVQTAGTITGVSGSTDLIKVGIVNDIVARGNSEGNNSVCGKVRIAKEQKDLSELKKGEILVLDKNINNYSQALKYAAGIILEGTLNIENNNTVPTIYNVKGATDILRDGDMVTLVLKEGTICRGEILND

SEQ ID NO: 22510 - protein, 480 aa, Bradyrhizobium sp. BTAi1
MATAANQIGRITQVIGAVVDVQFEGHLPAILNSLETKNAGNRLVLEVAQHLGESTVRTIAMDTTEGLVRGQEVTDTGAPIRVPVGEGTLGRIINVIGEPIDEAGPVKADSLRAIHQEAPSYTDQSTEAEILVTGIKVVDLLAPYAKGGKIGLFGGAGVGKTVLIQELINNVAKAHGGYSVFAGVGERTREGNDLYHEFIESKVNADPHNPDPSVKSKCALVFGQMNEPPGARARVALTGLTIAEDFRDKGQDVLFFVDNIFRFTQAGSEVSALLGRIPSAVGYQPTLATDMGALQERITTTTKGSITSVQAIYVPADDLTDPAPATSFAHLDATTTLSRSIAEKGIYPAVDPLDSTSRMLSPLVVGEEHYAVARQVQQVLQRYKALQDIIAILGMDELSEEDKLTVARARKVERFMSQPFHVAEIFTGSPGKFVELADTIKGFKGLVEGKYDHLPEAAFYMVGTIEEAVEKGKKLAAEAA

SEQ ID NO: 22511 - protein, 288 aa, Zea mays
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 22512 - protein, 396 aa, Bacillus subtilis
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKTDDHSFLSQEPPVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEKPQH

SEQ ID NO: 22513 - protein, 210 aa, Salmonella enterica subsp. enterica serovar Typhi str. Ty2
MILHPSLASADPLRYAEALTALHDAPLGSLHLDIEDTSFINNITFGMKTIQAVAQYSRHPLSFHLMVSSPQRWLPWLAAIRPGWIFIHAESVQNPSEILADIRAIGAKAGLALNPATPLLPYRYLALQLDALMIMTSEPDGRGQQFIAAMCEKVSQSREHFPAAECWADGGITLRAARLLAAAGAQHLVIGRALFTTANYDVTLSQFTAL

SEQ ID NO: 22514 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGEQAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 22515 - protein, 355 aa, Aspergillus nidulans FGSC A4
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 22516 - protein, 350 aa, Triticum aestivum
  misc_feature (76)..(76): Xaa can be any naturally occurring amino acid
MGSISDDEAACIYAMQLAAAAVLPMTLKNAIELGMIEILVGAGGKMLSPSEVAAQLPSTANAEAPAIVDRMLRLLXASHNVVSCEVEEGKDGRLARRYGTAPVCKWLSPDEDGVSLAPMVLLNDKVMLESWYHLKDTVLNGGLPFEKAYGMTAFDYQGTDPRFNRVFNEAMKTHSMIITKKLLEFYKGFDGVGTLVDVGGGVGATIHTILCRYPSIEGVNFDLPHVISEAPSFAGVHHIGGDMFKKVPSGDAILMKWILHDWNDEHCTTLLSNCYDALPAHGKVVIVEYILPVKPDETATAQRSFEADMIMLTHTPGGKERYLREYEELARSAGFVRVKGPPPFKKKWGF

SEQ ID NO: 22517 - protein, 307 aa, Bacillus cereus ATCC 10987
MNVYRGVHELIGHTPIVEITRFSLPEGVRLFAKLEFYNPGGSVKDRLGRELIEDALEKGLVTEGGTIIEPTAGNTGIGLALAALQHDLHVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 22518 - protein, 177 aa, Narcissus pseudonarcissus
GLHRSILVQVIGSGASELLIHSYKRSFSGFAAKLSDEEAYKIARMSEVVSVFPSRIRELHTTRSWNFIGFPVNAKRESYESNIIIGMLDTGIWPESDSFSDEGFGPPPAKWKGTCQSSSNFTCNNKIIGAKLYNSDGDLSDGDIDSPRDSEGHGSHTSSTAAGRQVGGMNLYDLAKG

SEQ ID NO: 22519 - protein, 271 aa, Candidatus Pelagibacter ubique HTCC1002
MIKQAIIPLAGLGTRLLPLTSVFAKELLPINGKPGLEYIIEECIEAGIKEIVFIISKKKLMIKKYFYNDKFYKDIIKKKNDPKIIKEYKKILKYKKMIKFVFQDKPLGTGDAVYKTKKFITDKYFLMLLPDDLIIKKNCSKSMIAVHNKFKASVMASMKVNKNDVSRWGIYNIRKKIDKNNFIINNVVEKPSIKTSPSNNAVIGRYILPKTIFSKLKSLKPGKSGEFHITDAIQALIEDDNQFIGHNFLGKYLDCGTMKGYIKSTLEISKQ

SEQ ID NO: 22520 - protein, 132 aa, Brassica napus
MVKSKRESITKAEAALDSKTKPSKKSKRDVEVDLDIPKDAKKQKKELIQAVEKAPPKKNNKKKKKKKKNANVEMAEAEQKPIAKQPKTLFAGRLPFHIEKSDLESFFKEVGEIKDVRLAKGIAHVEFASEEA

SEQ ID NO: 22521 - protein, 373 aa, Lachancea kluyveri
MLRLSTRASLTARPFFQGSFRTMATASIPEKQKGIIFYENGGELKYEDIPVPKPKPNELLINVKYSGVCHTDLHAWKGDWPLPTKLPLVGGHEGAGVVVAMGENVKGWKIGDLAGIKWLNGSCLSCEYCEKSNESNCPHADLSGYTHDGSFQQYATADYVQAARIPEGTDLAEVSPILCAGVTVYKALKSANLKAGDWVAISGAAGGLGSLAVQYAKAMGYRVLGIDGGAEKGELVKKLGGEVFIDFTKHKNLVEAVQEATNGGPHGVINVSVSEAAMTASTQFVRPTGTVVLVGLPAGAVIKSEVFSHVVKSINIKGSYVGNRADTREAIDFFARGMVKSPIHVVGLSELPKVYELMEKGKILGRYVVDTAK

SEQ ID NO: 22522 - protein, 332 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQDSQQPPQQQQPQVQVQQAQPQKQAAPVMRRASSIAARQAAMAQQSQETKPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 22523 - protein, 505 aa, Debaryomyces hansenii CBS767
MNWYIIIFIAYFVRRLIILCKNYWLARQWGCEPMQEFGGRFGIISLINVIKARREGFLVDYQKQTYIETDTDTIKSRLFHKQLIHTKNAENVKAVVATQYDDFSIGKRHKFFKPLLGNGIFASEGERWQHSRTMLRPQFARERVAHVQALEPHLQVFAKHVRKSEGGVFNIQILFHKLTIDAATEFLFGESVDSLRDASIGYESLPTDIDGKAGFDDAFNISQNYMMLRALAQDLYFLFDSKEFREANRKIHKFTGHYVHKALETTQEELDAKSRDGYIFLYELVKQTRDPIILQDELLSIMLAGRNTTASLLSFLFFELARNPEIWSKLKREVYEHFGNGDDVKLEKITFESMKKCTYLKWVINETLRMYPSVPQNFRVAKKDTTLPRGGGKDQQSPIFVPKGQFVLYTTYSMHRLEAYYGKDADVYRPERWENLRNIGWAYMPFSSGPRVCLGQQFALTEASYITIRLAQMFPNLESHDSKYPPPKLTNSTMRHLDGVFISLH

SEQ ID NO: 22524 - protein, 212 aa, Bacillus cereus ATCC 10987
MGTNKPVVIGIAGGSGSGKTSVTKAIFDHFKGHSILILEQDYYYKDQSHLPMEERLKTNYDHPLAFDNDLLIEHLQQLLAYKQVEKPVYDYTLHTRSDEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDIMVTKIATILEQKVNL

SEQ ID NO: 22525 - protein, 419 aa, Oryza sativa Indica Group
MENMRSENFNQGVSMEGVKHAPEMANTNRRALRDIKNIIGAPHQHMAVSKRGLLDKPAAKNQSGHRPMTRKFAATLANQPSIAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCPAKSEPAVFLLKSVAL

SEQ ID NO: 22526 - protein, 300 aa, Azoarcus sp. BH72
MSAASSTESVTPALKAEILAEALPYIKRFFDKTIVIKYGGNAMTDPHLKDCFARDVVLLKLVGLNPVVVHGGGPQIETLLAKVGKKGEFVQGMRVTDAETMEVVEMVLGGQVNKEIVNLINQAGGKAVGLTGKDASFIRAKKLLMQKLDAPAGDVIDVGQVGEITTIDPSLISFLDQGDFIPVIAPIGVGDNGETYNINADVVAGKLAEILKAEKLVLLTNTPGVLDKAGNLLTGLTPRQIDDLVADGTLSGGMLPKIGSALDAARNGVKSVHIIDGRVEHCLLLEILTDHGVGTMIKSK

SEQ ID NO: 22527 - protein, 380 aa, Glycine max
MYRVLNRAFCTATEPATTHVAVSIRSISEDLYKEVKLKNVVEKFKKASDNDRFRKKTGIYEDTVRRLAGARRFRWVRDILEHQKQYSDISNEGFSARLISLYGKSGMTKHARKVFDEMPQRNCSRTVLSLNALLAAYLHSHKYDVVQELFRDLPTQLSIKPDLVTYNTIIKAFCEKGSFDSALSVLREIEEKGLSPDSITFNTLLDGLYSKGRFEEGEKVWEQMSVNNVAPGVRSYCSKLVGLAEVKKAGEAVELFREMEKVGVKPDLFCINAVIKGFVNEGNLDEAKKWFGEIAKSEYDPDKNTYSIIVPFLCEKGDFKTAIEMCKEIFNNRCRVDATLLQGVVDKLASEGMITEAKEIVEIGKTNRYCRYRLDLPAEK

SEQ ID NO: 22528 - protein, 671 aa, Yersinia pestis CO92
MNPFIVADAESCIGCRSCEVACVVAHHEGQFPDKPEYFTPRVKVFKGDQCATAVFCHHCEDAPCASTCPNGAIVELNNRVQVIQEKCIGCKTCMIACPFGMMTVVTETVQPASHRLADVYRRTEAQKCDLCLDQPDGPACIKTCPTQALTLVDQQYLLHQQQQKRQHMALNEHNGRLFSRAVVQAASASSNKSIRDATPVNLLQRPRAPRLEPKKIPLAERKTGFAEIYLPFTESQIHEQAERCLECGDKTICQWTCPLHNAIPKWISLAHQGRIHEAAELSHQTSSLPEVCGRVCPQDRLCEQSCTLNDHDGAVTIGQIERHITETALATGWRPDLSQVKPSGKRVAIIGAGPAGLGCADILVRNGITPVVFDRYPEIGGLLTFGIPAFKLEKSVMTRRREIFTEMGVEFCLNTEIGRDITMENLLHDFDALFLGVGTYRSMRSGLENEDAQGVYDALPFLIGNTQHLMGYTANGAHPYVSMQDQRVVVLGGGDTAMDCVRTSLRQGASRVVCAYRRDEKNMPGSKREVKNAREEGAEFMFNLQPMSIVVDESGQVTGIKMVRTEMGQADAQGRRQALPITGSEHLIPADAVIMAFGFSPHRMSWLAEHNVVLDKHGRVVAPTISGYPYQTSNPKIFAGGDIVRGADLIVTAIAEGRKAAESIAYYLNVL

SEQ ID NO: 22529 - protein, 337 aa, Streptococcus pyogenes
  misc_feature (7)..(7): Xaa can be any naturally occurring amino acid
  misc_feature (25)..(25): Xaa can be any naturally occurring amino acid
  misc_feature (89)..(89): Xaa can be any naturally occurring amino acid
  misc_feature (109)..(109): Xaa can be any naturally occurring amino acid
  misc_feature (119)..(119): Xaa can be any naturally occurring amino acid
  misc_feature (123)..(123): Xaa can be any naturally occurring amino acid
  misc_feature (129)..(129): Xaa can be any naturally occurring amino acid
  misc_feature (163)..(163): Xaa can be any naturally occurring amino acid
  misc_feature (210)..(210): Xaa can be any naturally occurring amino acid
  misc_feature (294)..(294): Xaa can be any naturally occurring amino acid
GGGGGGXSIRSLFGGLREKILGKNXKIVFPEGNDERVVRAAARLKFEGLLEPIILGQSEEVRNLLTKLGFADQDYTIINPNEYADFDKXKEAFVEVRKGKATLEDADKXLRDVNYFGVXLVKXGLADGXVSGAIHSTADTVRPALQIIKTKPGISRTSGVFLXNRENTSERYVFADCAINIDPTAQELAEIAVNTAETAKIFDIDPKIAXLSFSTKGSGKAPQVDKVREATEIATGLNPDLALDGELQFDAAFVPETAAIKAPDSAVAGQANTFVFPDLQSGNIGYKIAQRLGXFDAIGPILQGLNKPVNDLSRGSSAEDIYKLAIITAAQAIESQG

SEQ ID NO: 22530 - protein, 357 aa, Campylobacter jejuni RM1221
MPNLEEFRNKIDAVDDKILELLNERMTYVKSIGELKQSSGGAIYRPERERAIINRLKNANLGLLDQNAIEAIYQEIFAVSRNLEMPQTIAYLGPEGTYTHQAARSRFGAMSRYIALANIEDVFKELSNKEAKYGVVPIENNTEGAVGITLDCLGKYNELKIFGEIYMDIHHSFVGINENLKEIKRIYSHPQGYNQCRKFLESHELSAIEFVPSKSTANAAYLASQDKYAAAICSKIAAKLYNVPVLFDKIEDNAANKTRFLILSDIKNPKMPNCKTSILAHTAHKPGGLSFLLEQFKKENINLTKLESRPVKSKEFLHSFYIDFEGHIDDENVKKALKDIQEIVWLGSYLSGEKDEI

SEQ ID NO: 22531 - protein, 514 aa, Prochlorococcus marinus str. MIT 9211
MEDYLQKILRARVYDIATKTPLEKAKNLSNRLKNKVWLKREDLQPVFSFKLRGAYNRMASLTDEELKIGVVASSAGNHAQGVALSASYLKCRAVIVMPITTPAMKITSVRRLKAEVILYGETYDEAYKEAQRISEKNGLVFIHPFDDPEVIAGQGTIGQEILSQIENPPDAIYIAVGGGGLIAGVASFVKSLWPSTEIIGVEPTDASAMTDSLKAGKRIELKDVGLFADGVAVKKVGEKTFELAKRYVDRMITVNTDEICAAIKDVFEDTRSILEPAGALSIAGLKSDVSNRNLVNKNLVAIACGANMNFDRLRFVAERAELGEKREAMFAVEIPENAGSLKNLCKILGNRSLTEFSYRMSEGNSAQIFMGLEVEGNKDKGDLIKSINSKSFKCLDLSDDELSKVHLRHMVGGRLPISANALSNKNYKELLYRFEFPERPGALMRFVNTMRPNWNISIFHYRNHGADIGRIVIGVLVEEKDLEAWERFLKEIGYKSWEETKNPAYQLFLGAQNG

SEQ ID NO: 22532 - protein, 643 aa, Prochlorococcus marinus str. MIT 9211
MRLSELSHPNQLHGLTIAQLEDIACQIRERHLQVVSTSGGHLGPGLGVVELTIALYQTLDLDVDKVVWDVGHQAYPHKLITGRYENFNTLRQKGGVAGYLKRSESTFDHFGAGHASTSISAALGMAFARDRLGLNHKCVAVIGDGALTGGMALEAINHAGHLPNTPFLVVLNDNDMSISPPVGALSTYLNRMRHSAPVQFISDSVQESVKNLPFIGGEIPPEIKSLTGSVKRLAVPKVGAVFEELGFTYMGPIDGHDISRMIRTFQAAHRVGGPVLVHVATTKGKGYPYAEADQVGYHAQSAFDLTTGKSIPSKSPKPPSYSKVFGQTLVKICEQNNKVIGITAAMATGTGLDLLQKAIPNQYVDVGIAEQHAVTLAAGMACDGLRPVVAIYSTFLQRAYDQLIHDVGIQKLPVTFVLDRAGIVGADGPTHQGQYDISYLRSVPNFTVMAPKDEAELQRMLVTCLENDGPCALRIPRGSGEGVTLMEEGWEPLKIGRGEILEDGDDLLILAYGSMVTPAVQTAELLKQAGISSTVVNARFLRPLDQALIHPLARRIGKVVTIEEGALGGGFGSAVVESFSDQDLLVPTFRLGIPDKLVDHASPQQSKESLGLTPSQMSKSIMKRYGWDTSDSLFLSNSNTSSA

SEQ ID NO: 22533 - protein, 123 aa, Zea mays
  misc_feature (43)..(43): Xaa can be any naturally occurring amino acid
LFHCLHAVCSHHQKLGFPAKFKDFKIQNIVRSCDVIFRTLFGXCDVKSPIRLEGLAYSHGAFSSYETELFSGLIYRMKRQKIMLLIFVSGKIVLTRAKVRDETYTAFENIYPVLIKFRKVRQC

SEQ ID NO: 22534 - protein, 338 aa, Picea sitchensis
MDSSSSLPIVSEAPGFIRIYEDGTVERLVDREIVPPSSQDDNFDEEKEGVASKDVVLDPQTGVFVRFYLPRLEVTNGKGRVPVLLYFHGGGFCIGSAASPVYHHYLNQVATDAKVICLSVDYRRAPEHRLPAAYDDCFGVLEWLDRQAMVLEGVSVDPWLASHADFSKVFLAGDSAGANILHQVGIRASGRNWDGLCLQGAILVHPFFGGAERIGCELLAEAEVDAFNTMTDAIWSISLPAEADRDHPFCNPVGPRSPALSTLVYPRMLIFVAGKDLLRDRGIWYYEEIKKAGIDTDLVMTEGESHVFHLFNPKSENVPLMMKRIFDFIHSSSENPNH

SEQ ID NO: 22535 - protein, 160 aa, Bradyrhizobium sp. BTAi1
MRIVVIAVGRLKQGPERELAERYRERFDDLGRKLGFRGLDLHELPESRARDAATRISEEAAAIAALIPGRSVLVCLDERGQNIDSASLAAQIGRWRDEGVPAAVFVIGGADGLSPELRRRAKLGVAFGAATWPHQIVRVLLFEQIYRTATILAGHPYHRA

SEQ ID NO: 22536 - protein, 391 aa, Rhodospirillum rubrum ATCC 11170
MIPPGNAIFAAAGASVFETMSQLAHEHGAINLGQGFPEALEPPEVIEAAARALRDGPHQYPSAWGVPALRQAVAEANERFWGLATDPTREVLVTSGATEALAACFLGLLNAGDEVIVLQPAFDCYQAQIRRAGAVAVGVALSAPDWTLPRAALAAAITPRTRAIVLNTPMNPCGKVFDGPELDFIAELLIAHDLVAICDEVYEHLTFEDRAPLPLMTRPGVRARCLRIGSAGKTFSVTGWKIGYVSGDAALLAPVARAHQVTTFSTPPFLQTAVAHGLRLADGYFDGLRATLRTRRDLLSRGLTEAGFEVLGCQGTYFLLAGTDGAEDDVGFCRRLVEEAGVTAIPLSGFFTPAGRRPLVRFCFAKRLETLEGGIARLVAWRGGQRWRRAS

SEQ ID NO: 22537 - protein, 332 aa, Leptospira interrogans serovar Copenhageni str. Fiocruz L1-130
MVCRTLLYNWKFSFSFGVRVNSSSFSKIFHSYKSTFENFLNSQTLSILSKQSAPELFEAMKYSLVAGGKRLRPVLALAAFGGLQNETQNVLLLGASLECIHTYSLIHDDLPSMDNDDFRRGLPTLHKKFSESTAILAGDALNSFAFYFISWIRVENGDHFLHRNLLEILHAGCGAPGMVSGQVYDLQMERENVKENDLTNQSDKIEMLQLTHRLKTGALIKSALLLGNRLRKDWKKRETSLSQYGEDLGLLFQITDDILDVEGTQESLGKTPGKDQKSGKITYPMLFGMDRCKKMVEELQKNLIFTSSDFVSTEEEQTFFQELPIYIGQRKN

SEQ ID NO: 22538 - protein, 671 aa, Vitis vinifera
MSITLLLQLIISLLCLKEASASPSLAKQGCVAHCGDVSIPYPFGIGTGCYFNDYFSINCNDSSTPPKPFLNHTKLNLELLNVSLEYKTVMVNSPITPLCGGNGTWRTTDVGGRPFRFSRVHNIFMVVGCDTNAVLMTDDQEEILAGCTSNCNSGITSTGTGCYGIQCCQTTIPYSNQSTHLGMYQVKYIKTSGDCSYAFLGVRDWFANNISNPAISTNSGYAPLVMFWEMETGSLGRCYSLNLDWQSETAIDSCSCVNRYEGNPYLPNGCQVVEACANCSILDCGMIGAEYHCFPSNRRAKELKAMILGLSIGGGSLLLLVGSFGLYKGVKKRREIIRKQKFFKRNGGLLLQQQLSSIETIEKTKIFTFKELEMATDNFNKSRILGQGGQGTVYKGMLNDGRIIAVKRSKIIDESQLEQFINEIMILSQINHRNILGLLGCCLETEVPLLVYEFISNGTLFQLIHDQNNEFPFSWHMRLQIASEAAGALAYLHSSSSMPIYHRDIKSTNILIDEKYRAKVSDFGTSRSISIEQTHLTTHVKGTFGYFDPEYFQSGRFTEKSDVYSFGVVLVELLTGKKPVSWTTLEEEKSLVARFILSLEEESHLYDILDDRVRKEGEKERIIAVANLAKRCLNLNGKKRPTMKEVTFELEYIRMSSLPINSQQYILNEDE

SEQ ID NO: 22539 - protein, 432 aa, Candidatus Pelagibacter ubique HTCC1002
MKLCMIGTGYVGLVSGVCFSDLGNDVICVDKDLNKIENLKNGIIPIYEPGLEELLIKNYKNNRLKFSTNLKDSISKSDIVFICVGTPTKKNGNNADLSQVYNVAKEISKSIKKFKIIITKSTVPVTTGDEIEKIISKKVSKKLFSVVSNPEFLREGDAIRDFTYPDRVVIGTHNKKSNKILKNLYSPLISKGAKYVNTSRRAAELIKYASNAFLATKITFINELANLCEKINVNIEDISIGMGLDNRIGSRFLRAGPAYGGSCFPKDTKAITATANKFKTNLTVIKSVIKSNENRSSLMLKKVFEILKNKIKNKNICFLGVTFKANTDDMRDSSSLTMIPALIKKGAKINYFDPTGEKLDFKKFNNVTFSNNIKDAIKKSDLIVIHTEWNDFKNINFKKDVKNKKFSIFDMRNIYSADKMKDNKIKYFSIGN

SEQ ID NO: 22540 - protein, 206 aa, Idiomarina loihiensis L2TR
MADQQLDYASAKFVTSAPDISKLPPDSGIEVAFAGRSNAGKSSALNTLTRQKALARTSKTPGRTQLINVFELTTGQRLIDLPGYGFAKVPLAVKEKWQRSLSEYLQQRDSLKGIVVLMDIRHPFRETDQELIYWAVDCDLPVLALLTKADKLKQGARKSTVLKAKQAAIAFNGDVQVEAFSSLKRIGVEQVEEKLNQWYSKEYDDE

SEQ ID NO: 22541 - protein, 861 aa, Cryptococcus neoformans var. neoformans B-3501A
MICITGPEVTDAVYRAAKQEAGGHSSLATCFYLISFFFASSFLLSQARFLLIFLTVTLFTHICSLETRQAHGADKKNSRLTHKRPPPDLILPNMSSSSAPPNMTAFPRENHYELEDQALDVIPTRAGRKLCVRHKQMANQNVNEKLQRSLDNLNPSERAAITQMWSTFSTAPHGKRKIILEGILTMCCFSQLSHLSDSLNQIIRIDPFSLLPRETSLRILGYLDAFSLGRAAQVSRSWKALADDDLLWRRMCGQHIDRKCDKCGWGLPLLERKRLRVELKDRSPAGLVEHDHKHENENGESRLVTRDQVLSGNANTVSSIGGLKSCDTSAMYLFPPNVNATAPKGIKRAAPESSIGAAKKVKMNDSDSDVEIIKPGGSSLTREVRLTRPWKTVYCERLMVERNWRKGRCSTKILKGHTDGVMCLQYHTALTNPSYSVLITGSYDRTVRVWNLDTGEEVRVLRGHTRAVRALQFDQMLLFTGAMDGTVRMWNWRAGECLRVMDGHTDGVISLNYNGYLLATGSADSTINVWNFRTGNRFTLRGHEEWVNNVVLWDGKTSPSDTDPAAIPSFTQAVSNRCQKSKSPAAASNEPTLPNIDPGAMLFSSSDDMTIKLWDLETAACIRTFEGHKAQVQSLRVLMVDMTEEEVAARDRRQRRQATPPTTGFTAASLVSPPGSQAAFGAGGASIHDAPAGFDPLEHRGRSRSDTVQPRVYVHSPDGTHKKSEREQSRGHEKKAIVASGSLDGTVKIWDVETGREQSTLFGHIEGVWAVDIDALRLVSASHDRTIKVWEKESAQCVQTLVGHRGAVTSLQLSDDMIVSGSDDGDVMIWNFASSANNVSNTASVSGPCVDITPSPTPAIV

SEQ ID NO: 22542 - protein, 543 aa, Corynebacterium glutamicum ATCC 13032
MGDDLVQHLPGLNRRLPGVDKRNRIALSACGVLRAPENFQEEGIRRIGGNHSDEAGVLALKSLSFHTRCGFSPQWKNSLAQAAKTPATQWKGRRQRLLRHHKWWLLSRCEPQNLSCTRVYSAKEITSLDSMLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 22543 - protein, 168 aa, Ralstonia solanacearum GMI1000
MNWMDIRIGQGYDVHALVEGRKLILGGVEIPHTRGLLGHSDADALLHAITDALFGAAGLGDIGRHFPDTDPAFAGADSRVLLREAVRRVREAGYDVGNVDATVIAQKPKLAPHVPGMVANLAADLGIAPGRCNVKAKTNEKLGFEGREDGIVAQAAVLIYRAEAAEQD

SEQ ID NO: 22544 - protein, 353 aa, Zea mays
MMMDGSAAGTSNGGSGADGDAARRNNTRMPKYSKFTQQELPACKPILTPKWVVSVFFLVGVVFVPVGVVSLLAAQDVVEIIDRYDHACVPPNMTDNKLAYIQNETIPKDCTRILTVTKEMKQPIYVYYQLDNFYQNHRRYVKSRNDAQLRDYKKSNTTTSCDPERFTADGKPIVPCGLIAWSLFNDTYSFTRGKENLTVNKKDISWKSDREHKFAKNVYPSNFQNGALIGGKKLNSSIPLSEQEDLIVWMRTAALPTFRKLYGRIYVDLKANDTITVRLSNNYNTYSFGGKKKLVLSTATWLGGKNDFLGFAYLIVGGLCIFLAFAFTLLYLIKPRKLGDHNYLSWNRHPAGR

SEQ ID NO: 22545 - protein, 230 aa, Ralstonia solanacearum GMI1000
MRPGTTDAWPIAAHSPIVAGRVRPPLACLAGALLVCRTPSAAPPQEKPMKTIGDKLEPFKVIGVKPGFNRHEENGQSAFEDITEASFPGKWKVIYFYPKDFTFVCPTEIVAFARLNQDFEDRDTVVLGGSTDNEFVKLAWRREHKDLDRLKQWSFADTTGALIDQLGVREHEAGVALRATFIVDPDNVIQHVSVNNLNVGRNPDEVLRILDALQTDELCPCNRAVGGATL

SEQ ID NO: 22546 - protein, 239 aa, Brassica napus
  misc_feature (206)..(206): Xaa can be any naturally occurring amino acid
ALPHLQKTNGRIVVNASVENWLPLPRMSLYSAAKAALVNFYETLRFELNGDVGITIATHGWIGSEMSRGKFMLEEGAEMQWKEEREVSANGGPLEDFAKMIVAGACRGDAYVKFPNWYDVFLLYRVFTPNVLRWTFKLLLSSEGSRQSSLVGVGQGMPVEESSSQMKLMLEGGSPRVSASPPHYTASPPRVSASPPHYTASPPRYXSNPPRFSRFNIQELPWEVNGESRVRVRMVWRVE

SEQ ID NO: 22547 - protein, 453 aa, uncultured candidate division OP8 bacterium
MPFSSLHLHPTLLKALKELGFPRPTPIQADAIPPAMSGRDVMASAVTGSGKTAAFLLPILHQLIDRPRGTTRALVITPTRELAAQILEDLNDLAVHTPISAAAVFGGVSIRPQEHAFRRGVDVLIGTPGRLLDHFRAPYAKLAGLEHLVLDEADRMLDMGFLPDIRRILKHIPARRQTLFFSATMPAPIGVLAREMLRNPATVNINRIAAPAAGITQAVYPVAQELKAALLVALLKRDDIRDALVFTRTKHRANRLAEHLVRQGIKAERIHGNRSQGRRTEALAGFKAGKYRVLVATDIAARGIDVTELGHVVNFDVPLVPDDYIHRVGRTARAEATGDAFTFVSPQEQGDLTRIERVIGKQLPRITVPDFDYRARTESRLEVPLAERIAAIRSRKAEERARAKAKAERKAALPPPGPARVTPKPEPKRSAPAPRGRGSRRGGRRSGGGGRFR

SEQ ID NO: 22548 - protein, 242 aa, Bordetella bronchiseptica RB50
MLQNREGQRVPSVTFPVRENNAWKQVTTDDVFKNKTVVVFSLPGAFTPTCSSTHLPRYNELAPAFFAAGVDSIVCVSVNDTFVMNEWAKDQESANVTLLPDGNGEFTDGMGMLVDKKDLGFGKRSWRYAMLVKDGVVEKMFIEPEKEGDPFEVSDADTMLAYVAPQARKPDQVVVFSKPGCPFCVDAKALLKGKGFDPIEIPLDNKVRGRVIGAVSGGDTAPQVFINGKLIGGFDALKAYLA

SEQ ID NO: 22549 - protein, 615 aa, Campylobacter jejuni RM1221
MSKKFVHTQEELEKLSLKELENLAASMREKIIQVVSKNGGHLSSNLGAVELSIAMHLVFDAKKDPFIFDVSHQSYTHKLLSGKEEIFDTLRQINGLSGYTKPSEGDYFVAGHSSTSISLAVGACKAIALKGEKRIPVALIGDGALSAGMAYEALNELGDSKFPCVILLNDNEMSISKPIGAISKYLSQAMATQFYQSFKKRIAKMLDILPDSATYMAKRFEESFKLITPGLLFEELGLEYIGPIDGHNLGEIISALKQAKAMQKPCVIHAQTIKGKGYVLAEGKHAKWHGVGAFDIDSGESVKKSDTKKSATEIFSKNLLDLASKYENIVGVTAAMPSGTGLDKLIEKYPNRFWDVAIAEQHAVTSMAAMAKEGFKPFIAIYSTFLQRAYDQVIHDCAIMNLNVVFAMDRAGIVGEDGETHQGVFDLSFLAPLPNFTLLAPRDEQMMQNIMEYAYLHQGPIAFRYPRGSFILDKEFNPCEIKLGKAQWLVKNSSEIAFLGYGQGVAKAWQVLRALQEMNNNANLIDLIFAKPLDEELLCELAKKSKIWFIFSENVKIGGIESLINNFLQKYDLHVKVVSFEYEDKFIEHGKTSEVEKNLEKDVNSLLTKVLKFYH

SEQ ID NO: 22550 - protein, 425 aa, Pseudomonas syringae pv. phaseolicola 1448A
MAFLALGINHKTASVDVRERVAFTPEQLVEALQQLCHLTESREAAILSTCNRSELYIEHEHLGADSILAWLANYHHLSLEELRASAYVHEDDAAVRHMMRVASGLDSLVLGEPQILGQMKSAYAVAREAGTVGPLLGRLFQATFSAAKQVRTDTAIGENPVSVAFAAVSLAKQIFSDLQRSQALLIGAGETITLVARHLHDLGVKRIVVANRTLERASMLAAEFGAHAVLLSDIPAELVNSDIVISSTASQLPILGKGAVESALKLRKHKPIFMVDIAVPRDIEPEVGELDDVYLYSVDDLHEVVAENLKSRQGAALAAEQLVSVGAEDFMSRLRELAAVDVLRAYRQQSERLRDEELSKAQRMLANGSNAEDVLIQLARGLTNKLLHAPSVQLKKLSAEGRVDALAMAQELFALGEGSTDKTPQ

SEQ ID NO: 22551 - protein, 301 aa, Corynebacterium diphtheriae NCTC 13129
MSSSMTVVGSINADVSIQVARHPSPGETVLGHDSTISPGGKGANQAVAAALQGASVSFVGAVGNDTYADHALKILRSSGVNLDAVETIDDNTGVAYIQVSDDGENSIIVIPGANAHVTADYVEHHRKPIEDADIVLLQGEIPADGFSAAVQAARGTVVVNLAPVIDVDRDCLLRADPLMANEHEAALILEQLGVPVTSEDPRVLIEALRSQGFASVVLTLGGHGALVADASGVTPIATPYVTAVDTTGAGDAFAGAFVARRLQGDSLIDAATFAARVGAFSVQGRGAQTSYPSESDTLPAV

SEQ ID NO: 22552 - protein, 235 aa, Campylobacter jejuni RM1221
MQKQEKIIEMFNQIAPTYDKANRILSFGADVAWRKKACQRVMSLYLKKDLKIADIACGTGDMIEIWQESALKMEKNILNIKGIDPSSGMLNVAKEKFPNVEFIEAGAQNLPLESQSLDILSISYGIRNVVERQKALSEFARVLQKDGILVVLEFTKREKGGFIAACRDFYLKNILPSIGGIISKNKSAYEYLPNSIEGFLSKEEFILELKNAGFEILDYKSFSFGVSSMFIAKKL

SEQ ID NO: 22553 - protein, 507 aa, Burkholderia thailandensis E264
MASHDYLKKILTARVYDVALETELERARNLSARLDNAVYLKREDNQPVFSFKLRGAYNKMAHIPADALARGVITASAGNHAQGVAFSAARMNVKAVIVVPVTTPQLKVDAVRAHGGPTVEVIQAGESYSDAYAHAVKVQAERGLTFVHPFDDPYVIAGQGTVAMEILRQHQGPIHAIFVPIGGGGLAAGVAAYVKAVRPEIKVIGVQTDDSCAMKQSLAAGKRVELAEVGLFSDGTAVKLVGEETFRLCAAYLDDVVTVDTDALCAAIKDVFQDTRSVLEPAGSLAVAGAKRYAERAGIEGETLVAITSGANMNFDRMRFVAERAEVGEAREAVFAVTIPEERGSFRRFCSLVGERNVTEFNYRIADAQSAHIFVGVQIRRRDETDEIARNFAAHGFTTVDLSGDELSKQHIRYMVGGRSPLAHDERLFRFEFPERPGALMKFLSSMAPDWNISLFHYRNQGADYSSILVGLQVPQADHAAFDRFLAALGYPFWEESVNPAYRLFLS

SEQ ID NO: 22554 - protein, 473 aa, Antirrhinum majus
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKAPTLTSTLTARSKAASGVKTKTKEQIVDIDAADVNNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASVYAARCTLNKAPFWNETLQLHTGFSEPQLMDCAKLLVAFPKMAGDQKLKSIYRKYSNLERGAVALLSPAKSVFVFLIELLMNAIEKIQCSLFFTSEIWCRF

SEQ ID NO: 22555 - protein, 441 aa, Antirrhinum majus
MGSRHQVVQQQNRGDVVPGAIKQKSMAVEKKNRRALGDIGNVVTVRGVEGKALPQVSRPITRGFCAQLIANAEAAAAENNKNSLAVNAKGADGALPIKRAVARVPVQKKTVKSKPQEIIEISPDTEKKKAPVLEKEITGEKSLKKKAPTLTSTLTARSKAASVVRTKPKEQIVDIDAADVNNDLAVVEYVEDMYKFYKSAENDSRPHDYMDSQPEINEKMRAILIDWLVQVHYKFELSPETLYLTINIVDRYLASKTTSRRELQLLGMSSMLIASKYEEIWAPEVNDLVCISDGSYSNEQVLRMEKKILGALEWYLTVPTPYVFLVRFIKASLPDSDVEKNMVYFLAELGMMNYATIIMYCPSMIAAAAVYAARCTLNKMPIWNETLRMHTGFSEVQLMDCAKLLIDFHGGSTDQKLQGIYRKYSRLEKGAVALLPQPLLA

SEQ ID NO: 22556 - protein, 787 aa, Kluyveromyces lactis NRRL Y-1140
MAGHSHRSSVKNGHKPFKSKHASKGSLKNAFKGKVEKEAKNGKSNKSVSKLERKNLSKQLRHQKILDTLETKKLFEGNNGAKKIITVIPLTADVYADDIVKKLILSAENDGKTESDLEFDLKMPSVTNFRINKFKTTLQVIIPDMSNFINILDCAKVADFVVFGLSGTSEVDGEFGEQIIRSLEFQGISSYLGVVSNLSQVHPKEKFQLDVKKSLESYFTHFFPNEKSVYNLEKPSEAINAIRTLCQKYPRTVKWRDARGYLLADNIDFIESSENRGHLVVQGIVRGAGFNIDRLIHIPGMGDFQVSKIEKLAASARRNKSTEEGTEFLPSEERDILEEYAAQDMNMDEWSDYEDGFEYENLTAARYDDHGFLPGREQESKKVKLPKGTSEYQARWYLDDVIEIGDEEELEEIQDENVPIQEDEMMVDDVDTFNTEQAQSEMDTQTEAGGEDMFVDLSPEEEERQLREYRDQEKEDLEFPDEIELDPRESAIESLKSYRGLKNLHNCSWEVDERDPDCPSEWKRVLRIGNYKNTMKKLNKEAIKSAQVVAGDIIKLYIDIPKFLLEKLADPKTEVFAVYSLLKHEHKNAVVNFSIERWEEYDSPVPSSEPIIVQYGIRRYTIEPLFSSASTSPNNVHKFERFLHQNYVSVATCIAPVDFTQSPAIFFKTSVTDPKGIELVGHGSFLNADHTRIMAKRIVLTGHPFKFHKKLVTIRYMFFRPEDVEWFKSIPLFTKSGRSGFIKESLGTHGYFKATFDGRLSAQDTVAMSLYKRVWPNASLPWSDKLL

SEQ ID NO: 22557 - protein, 543 aa, Corynebacterium diphtheriae NCTC 13129
MTISSSFIDVDALHHPSTTAGKIADFKARRAEANTPMGETALNKVRGQGRMTARERLDYLLDEGSFIETDQLARHRTHDFGLYGKRPVTDGIVTGWGTIDGREVCIFSQDGTVFGGALGEVYGEKMIKIMELAVTTGRPLIGLYEGAGARIQDGAVSLDMIARTFYHNINASGVVPQISVIMGACAGGNAYSPALTDFVLMVDQTSKMFVTGPDVIKTVTGEMITQEELGGASAHMAAAGNSHYTASSDEDALEFVQELVGFLPSNNRSMAPREDYDREDGSIDDNLTPDDLRLDHIIPDSPASPYDVRDIIESLTDDGDYLEIQADRAENVVIAFGRIEGESIGFVANQPTQLAGCLDIDASEKAARFIRTCDAFNIPVVMLVDVPGFLPGAGQEHNGILRRGAKLLYAYGEATVPKITVTMRKAYGGAYCVMGSKGLGADVNLAWPTAQIAVMGAAGAVGFLHRKELAKAVENDEDVFALTQAFEQEYENHMLNPYMAAERGLIDAVILPSETRGHISRNLRLLRNKHVQRPARKHGNIPL

SEQ ID NO: 22558 - protein, 389 aa, Thermococcus kodakarensis KOD1
MALSDRLDLVNPSEIRKLFDLAAGMQDVISLGIGEPDFDTPEHIKGYAKEALDKGYTHYGPNAGLPMLREAVAKKLKEQNGIEADPKTEVMILTGANQAFLMGLATFLKDGEEVLIPSPMFVSYAPAVILAGGKPVEVPTYEENEFRLSVDDLEKHVTDKTRALIINTPSNPTGSVLTKKDIEEIADFAVEHDLMVISDEVYEHFVYDGVKNHSIASLDGMFERTITVNGFSKTFAMTGWRLGFVAAPAWVIEKMTRFQMYNSTCPVTFAQYAAAKALEDPRSWKAVEEMRKEYDRRRNLVWKRLNEMGLPTVKPKGAFYIFPRIRDTGLTDHQFSELMLKEARVAVVPGSAFGKAGEGYIRISYATAYEKLEEAMDRMEKVLKEKKLV

SEQ ID NO: 22559 - protein, 392 aa, delta proteobacterium MLMS-1
MKNIRDIDIRGKRVLIRVDFNVPIDEQGNITDDIRIRGVLPTINHALDENAAVIICSHMGRPKGERRPEFSLAPAARRLSRLLDKEVKLAPDCVGPEVAEMAAALSPGEVLLLENLRFHPEEQANDEKFSRELAALAEVYINDAFAVAHRAHASVVGIPRFAPAKGAGFLLQKEMDYFHRSVGNPMRPLAAIIGGSKVSSKLGALTNLMDRVDKMLIGGAMANTFLRSQGLDVGRSKVEDDLLETARELIAKAHERGVKLYLPVDCIVAPELDAKAETKRVTCQEIPATWMALDIGPATTMLFTEALDDAKTIIWNGPMGVFEVDAFSRGTMAMVQTLTRSHALTIVGGGDTDVAVHRAGESANISYISTGGGAFLMLMEGKTLPGVAILEE

SEQ ID NO: 22560 - protein, 250 aa, delta proteobacterium MLMS-1
MRTPLLAGNWKMHLDQAAAAELAAAVAKVAAACPEREVMIAPPFTALAAAGQAAGQQVILAAQNVCWEAQGAFTGEIAPPMLRELGCGMALVGHSERRQLFHEDNSMINRRLGGALAHGLVPVLCIGETLAEREADRTMEVLASQLREGLAGISLDDPRQLVVAYEPVWAIGTGKTAGPEQAQEAHQFVRGLLAELYQKNIADGVRILYGGSVNAANVDTIMAQPDVDGALVGGASLDIASFERIIRFQV

SEQ ID NO: 22561 - protein, 239 aa, Aegilops searsii
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSV

SEQ ID NO: 22562 - protein, 275 aa, Idiomarina loihiensis L2TR
MAFFKGVKEDIASVFARDPAARNTMEVLFHYPGLHATWFHRVSHKLWGWKLYWLARFVSNISRWLTGIEIHPGAKIGRRFFIDHGMGVVIGETAEIGDDVTLYHGVTLGGTSWHKGKRHPTLKDGVVIGAGAKVLGPITVGKSARIGSNAVVVRDVPELTTVVGIPARVAQSGVDKETTERRKKMAQEYGFDAYAISADNPDPVATAIGRMLDHVQVLDNKVSDLCQAVNKLGGDVCGEIPEVDMDDVEFLEESERAAKRRAHKDDASASDTQEP

SEQ ID NO: 22563 - protein, 454 aa, Rhodospirillum rubrum ATCC 11170
MTAPVDLLAQIGHTPIVRLDHLDTGPCSLFVKLESQNPSGSIKDRIAVSMIDAAERDGRLKPKGRIVEATAGNTGLALALVAARRGYHLTLVIPDKMSREKIAHVRAMGAEVVLTRSDIGKGHPAYYQDLAQRIADETGAFFTDQFNNPDNPIAHETGTGPEIWEQMDGRVDAVVAGVGSGGTLTGLSRFFARVSPQTDIVLADPKGSILADYVTSGRIGAAGSWLVEGIGEDFVPPVSDLSRVTHAYTIPDGESFATARGVLRQEGLLIGSSSGTLLAAALRYCREQTSPKRVVSFVCDSGNKYLSKMYNDFWMADQGLSNRPRFGDLRDLIARRQDEGAVVSVAPGDTLAIAYQRMKLYDVSQLPVLDGTRCVGLIDESDVLLSLRERGGLFDVAVSAAMSTDLETVGPDADADHLVGLFDRGRVAIVVDDSGFLGLITRIDFLNHLRGKAA

SEQ ID NO: 22564 - protein, 342 aa, Listeria innocua Clip11262
MLNEQQITRLLYRLQDPVLEASLEETEGILEVQVLGESANIKIALADPAIETDHFVHNIEELLTQFGVNEINIELEYLPAAVIDRIFQARDNILSETSQTKFLAIASGKGGVGKSTVAANLAIALAQQGKKVGLLDADIYGFSIPVLLGTTESPRKENGQIIPVETNGIQMISMDFFVESGEPVIWRGPMLGKMIKMFLEEVRWGKLDYLLIDLPPGTGDVALDIHTLIPKCNEIIVTTPHFAAASVASRAGYMASKNNHNIIGVIENMSYLKLEDGQTLKIFGQGGGEKVAADLETQLLIQLPIEQPDFNGNGYTSAIYSESSEAGKAYKTLAEKIIPYLL

SEQ ID NO: 22565 - protein, 218 aa, Cryptococcus neoformans var. neoformans B-3501A
MPSNFPPVQPKPKLKVCEVLANQIYTVDDFFSPSELRAVLAWAQSLELEGPKKPGKGEAERTGRRASLHSPEIASSLLRLIHPLLPSLSPPYTSHPGLSANIRVYHYPPHTFFGQHYDMPQLDHASRRLSCWTVLVYLSDGVTGGGTTFYPHEETGKKGKKGSKTGLKYGQKEKVTVEPKAGRMLLHWHGVSGGGCMKHEGDEVLSGDKWVLRTDVLA

SEQ ID NO: 22566 - protein, 419 aa, Roseovarius nubinhibens ISM
MRGKRLPGEYESKLAKGAVKLPLSAVNVDVTGADIEDSPLVFETGDADGVLLPTGRGPMPLPWLGSDQPLYPMELRRSREDAFGADPRAALRRVLTRYEARGWSVQAATELEFTLVDDTGDELACVRNPQNGQPIEMPEVLALSHMDAFDAFLTDLYEGAEEMGIPAQTVTSEAGVGQFEITLDHQDALRAADDAWLFKALIRGLARKHGLAATFMAKPFGDDAGNGMHVHFSIWGAGGQNMMDETHPGGEERLHAALAGCLAAMAGSTLIFAPHANSYARLVPGAHAPTAICWGQDNRTAALRIPMGGPGSRRIENRVAGGDTNPYLVLAAILGAAIHGIENGLTPPPPIEGNAYEQDLPQLAASWTEAIDRFEADPIMAEIFGPLLRDCLVRCKRQEVDILADVPLEDHWKTYLDTA

SEQ ID NO: 22567 - protein, 142 aa, Schizochytrium sp. FJU-512
MRRAASVCARVGGRALAARPAVMAVRSMQQPLAMPALSAARVEFSAAMRSGVRAFSASTFLPEAEVQERVIEVVKNFDKVDGAKVNPQAHFINDLGLDSLDAVELVMAIEEEFVIEIPDDVAEKILTCEDAVKFVSQHPQAQ

SEQ ID NO: 22568 - protein, 281 aa, Synechococcus sp. RS9917
MPTRVAFLGPEGTYGERAARAMVRLEGLEAVELVPCAGLRSVVEHVADGRCGAAVVPVENSVEGGVTASLDGLWSHPQLCIRRALVLPIRHALLSSGRLDQISEVLSHPQALAQCSGWLAEHLPGALQLPTSSTAEAARMVRGSQFRAAIASRSLATPGALEVLAYPINDAVGNCTRFLLLQRGDRCQSGDVASLAFSLHRNAPGALLEALGAVAALGLNMSRIESRPSKRELGEYVFFVDVELPPGDDGLLLSALTERLSPFCEHLSQFGAYPSTELEPD

SEQ ID NO: 22569 - protein, 759 aa, Aspergillus nidulans FGSC A4
MHLSLSSTFATVALSVLSLTSTSAASLNLPKTAYRMPARTADPSNPALTWHVSQFDLGCSPGGCVYSFNILGHASENTPGFNTSCNGTSTQDDYAPCKDEGILAQIEPATYPNWTVSVQHQWREAMFEEYYAFGTGTGNGIGLRGTAEVVSSSSTRMSHISCLSYTLLQTMHQYNLFAWDEPICTPYIVTIQCAPNDISVLAPVDHREGRAERVFRGKHVQIVILCTDSPRPNPLILLPASILRQLVAGPRLQHPETGLDLCYVADNSEPSPISTLSNAARYLPGRFILTPLKQLVNFLDSKHGADWCIWEFRAEGTGYPDSEVYGRIHHFPFPDHHPPPFALIPKVMASMRNWLQRLDGSGADGQENQRKGQRVAVVHCKAGKGRSGTMACSYLISQEGWKMEDALQRFTERRMRVGFGSGVSIPSQLRWVRYVERPVEILEIHVWGLRDGVKVVVEGFVEEGQKIKQFHLFRKDERTVMSDSTLQSQSSQRSSNTTSEDDEDNKVSSNNDNNSKINPKQKLNATKLSGTSNQVQEQQPISATESDSSLLSTTTPASNSASTTPTTTTTSQPPQKHTHAVFLRPSSPLILPSPDINIDFERRSKAASYTGLAMVTSIAHVWFNPYFEGGDKYDSGVFEIDWDAMDGIKGTSRKGIKALDRLKVVWRYADDDTTEVQNTHAQKRPVSRGVITEPKPGEPIPETRVKDWRLKDSHHGGGDETAEDKVDVDSSSSNDEGSVGTASEKEKENVPMAGGKSGG

SEQ ID NO: 22570 - protein, 313 aa, Bordetella parapertussis 12822
MTAPVLVCGSMAFDTIAVFEGRFKEHILAERIQSLSVSFLVPAMRKEYGGCAGNIAYNLKLLGGQPVPVATVGEDAGEYLARLSGLGIDVSRIQVVPGTFTAQCFITTDLEDNQIAAFHPGAMEFSSGNDLSDAQAAWAIIAPDSKAGMFAHAERLHARGIPFIFDLGQAMPLFDGADLERMLKLAQALTVNDYEAGVVEQRTGRSLAEIASGLRAAVVTRGAHGATVMAGGQTIEVAPVQAQAVVDPTGCGDAHRAGLLYGLTSGWGWADSCRLGNLMGAIKIASRGPQNHAPSRSEIDALMRANYGIGLPD

SEQ ID NO: 22571 - protein, 404 aa, Burkholderia thailandensis E264
MSTTDHSPIPRPVVVPLDAILPEEPLLMMGAGPVPIPAAVAKANTIVINHLGATMAKIIEQVKEMARYVFQTRTKWVLGVAGPGSAAMEMAVSNLAWSGTKVLSIKNGFFSARMAEMAMRVGASVATIDVPDRSVASLDEIADAIARERPEIVTIVHGETSNTVWNRHLKEIATIAKAAGALVVVDAVCTLSTMPLDMDAWGIDAVITGGQKGLSSIPGVSLIAFSDAAWERMKSRPEPNTHWCLDMALAENFWHNAGYHYTAPVSGVLALHEALRLVCAETLENRFARHLRCSLALQAGITGMGLELYAPESCRLNSVVGIAAPQGLTPGLICGHISKQYQVEISGSFGLPIVRIGQMGEQCREHNLFRTLHAFGRTMVDLKVGVDLPAGVAALEQALSGRAA

SEQ ID NO: 22572 - protein, 414 aa, Arabidopsis thaliana
MGSVSLKIGDGTARFKRSTLFSSAINLLMLFSIVTTNLFALYAFSSRSQSHTPHPLHSNNVSLVSQHLSLILREIDSSHHTLTQMEKQIIGYESLDLSQQEVPQELKLFLQQHQLPLGKDSRTGITQMVASVGHSCEMSLDLLSQYMSYNVFEKCPDDWSLAQKLILRACEPLPRRRCLAKTVHKPGLALFPDSLWRPVGNSSVNWSGLGCKSFECLKGKKLSRDCVGCFDLATSHEKDRFVKVNGKTDFLIDDVLDLGDGKIRIGFDISSGSGTFAARMAEKNVNIISNTLNIDAPFSEFIAARGIFPLFMSLDQRLPFYDNVFDLIHASNGLDLAVSNKPEKLEFLMFDLDRILKPGGLFWLDNFYCGNDEKKRVLTRLIERFGYKKLKWVVGEKTDAEVFLSAVLQKPARI

SEQ ID NO: 22573 - protein, 768 aa, Arabidopsis thaliana
MPLCNNFSGNLVVAVALFFAGALYIFNYQNYVNTLRTTQYPVDELEAALYTAAAGNNKTVIITMVNKAYVKEVGRGSTMLDLFLESFWEGEGTLPLLDHLMVVAVDQTAYDRCRFKRLHCYKMETEDGVDLEGEKVFMSKDFIEMMWRRTRLILDVLRRGYNVIFTDTDVMWLRSPLSRLNMSLDMQISVDRINVGGQLINTGFYHVRSNNKTISLFQKWYDMRLNSTGMKEQDVLKNLLDSGFFNQLGLNVGFLSTTEFSGFCQDSPHMGVVTTVHANCCLHIPAKVFDLTRVLRDWKRYKASHVNSKWSPHLKYLNISIKLLILHLKCGCLSYARQVFDELPKPTLSAYNYMISGYLKHGLVKELLLLVQRMSYSGEKADGYTLSMVLKASNSRGSTMILPRSLCRLVHARIIKCDVELDDVLITALVDTYVKSGKLESARTVFETMKDENVVCCTSMISGYMNQGFVEDAEEIFNTTKVKDIVVYNAMVEGFSRSGETAKRSVDMYISMQRAGFHPNISTFASVIGACSVLTSHEVGQQVHAQIMKSGVYTHIKMGSSLLDMYAKCGGINDARRVFDQMQEKNVFSWTSMIDGYGKNGNPEEALELFTRMKEFRIEPNYVTFLGALSACSHSGLVDKGYEIFESMQRDYSMKPKMEHYACIVDLMGRAGDLNKAFEFARAMPERPDSDIWAALLSSCNLHGNVELASIAASELFKLNADKRPGAYLALSNVYASNDKWDNVSKIREVMKRRRISKTIGRSWTSED

SEQ ID NO: 22574 - protein, 137 aa, Campylobacter jejuni RM1221
MEKTLSIIKPDAVKKGVIGKILDRFESNGLRIAAMKKVQLSKEQAENFYAVHKERPFFKDLVEFMISGPVVVSVLEGEGAVLKNRDLMGATNPKEAKAGTIRADFAESIDANAVHGSDSLENAKIEIDFFFKPNEIC

SEQ ID NO: 22575 - protein, 638 aa, Arabidopsis thaliana
MINLSLYQTNSLSYTIIWMLFVIPSCVLSVDERQKHCSPTFRCGKQTDLYYPFWSPDREECGHPVFKVNCSGDFAEFTISTVKFHVLEMNYESRIIRLVRTEYLNNLCPWHPENRSINQEVLPFLQDTELGTFYYNCSGPTVDELANGYIRQLGCDEEVGGKSYFVSSPSHPGNRAILDGLSASCERNVDIPVSRSAMETTATNQSLEAIKKVLDVGFELGFNSDCSLCVASKGACGFNQSSKAFVCYCKDEPHEHTCGKMGIGIGLGCGFLGATLITVCLLCFFFQKRRTSHHLRPRDNNLKGLVQLKQYSYAEVRKITKLFSHTLGKGGFGTVYGGNLCDGRKVAVKILKDFKSNGEDFINEVASMSQTSHVNIVSLLGFCYEGSKRAIVYEFLENGSLDQFLSEKKSLNLDVSTLYRIALGVARGLDYLHHGCKTRIVHFDIKPQNILLDDTFCPKVSDFGLAKLCEKRESILSLLDARGTIGYIAPEVFSGMYGRVSHKSDVYSYGMLVLEMIGAKNKEIEETAASNSSSAYFPDWIYKNLENGEDTWKFGDEISREDKEVAKKMTLVGLWCIQPSPLNRPPMNRIVEMMEGSLDVLEVPPKPSIHYSAEPLPQLSSFSEENSIYTEVFIGSTS

SEQ ID NO: 22576 - protein, 438 aa, Azoarcus sp. BH72
MKISIFGLGYVGAVSLACLARDGHQVVGVDIDATKLELIRSGTTPVVEEGMVELMANVAASGRVSVTTDVRQAVLDTEISLICVGTPSAPNGSQDQGAVLRLARDLGRALAEKSAPHVLVFRSTLVPGTVEGSLKPIIETESGKRDGEDFHLCFQPEFLREGSSIRDYDKPPFTVVGANHAYPAERLRELFGHLPCKFLETSVRAAEMMKYCCNNFHALKITFANETARLCSALGVNPFEVMELVCQDTQLNISRAYLKPGFAFGGSCLPKDLRATSYLAKTHDVELPMLNGILQSNRHHVEEAIQKVLASGCRRVGMLGLSFKTGTDDLRESPLVTLAEQLIGKGMQLSIYDPDVQLSRLLGANRRFIETQLPHIGELLKPELDAVIGEAEVLIVGVSSPAIFDALATHSRPEQKVLDLVRLPNPQALRAEVEGLCW

SEQ ID NO: 22577 - protein, 383 aa, Candida glabrata CBS 138
MDKPVEDQEVPQQEQEDVPPPPPAEAPQEQEQQQEQEQPQEQEQEQQQEQEQPAEEMNVEHQDAPVHHEPMPYESQFPEPPQPYYNQPPQGVPTFHQQEGELSNTRLFVRPFPLDVQESELNEIFGPFGAMKEVKILNGFAFVEFEEAESASKAIEEVNGKTFANQPLEVMFSKMPVKRFRITLKNLPEGCSWQELKDLARENNLETTFSSVNSRDFDGTGALEFPTEEIMNDALEKLNNIEFRGSVISVEIDDNPPPIRRSNRGGFRGRGGFRGGFRGGFNGPRGGFRGGYGGPRGGYGGRGGFNGPRGGFRGGYNSGGFRGGYGAPRGGFGQGPRGGYGAPRGGYGGSRGGYGAPRGDYGAPRDSYRTRDAPPRERSPTRQ

SEQ ID NO: 22578 - protein, 1175 aa, Magnaporthe grisea 70-15
MFVVRPGVDLLVQRPWIAVFLAAALLTAVCISRRRKPDDLEHIPCSGQGTPRKRLQEYRLHAKRLYGDGYKKFQSLYRVLSPEATGKATPELSRVARDAVLSEIPQSSDWTEVDVHHQLVRIVTIVSGWMFVGPDFCRTDEYMDLAAHYAADAFGGPLVLQMFPKALRSIVAPLVPPVRRVWKAHRRIAALLGPAIAQRQRNTGPGSQPAPDDMLQWLIDNRHQFPDEIKGDGDIARLQLALSAVAIHTTALTATATLYDLAAEPEIMQDVREEIHRVLQEHDGKITSKMLFDLKLLDAVCKESQRLNPADLLSARRRVMQPFTFSDGTAVPVGTMLAVPVYHIGRDPALFPQDPEKFDPYRFTRLRSKDAEGGGNHLQFASVTHGTMAFGWGKHACPGRFFAAAEIKLILLHMLLNFEVSVVPGPDGVKRYPNVEMGNMNTRITLVRVTLVKKLPIFHPRHVRQHVARKIQQQTRVVRVPGGAGPPDVPDPLKRVQPPVEALPDGRAVDHARKRAVVRHGHKLDAALARRRRAARGPPQPLDRRQDLGPDPRGGLGLLLDRGLGAVPKGVQVRRRRGFKHVYPRHGGDGGLVGPVAVLHLEARELGAAHHPGPVVVAREAREERLLLCRRPKAGLEGRGRWDGHEQLPRADLGRPSGGRVAADCGLHPHAHVAVLVEGAIESRHGAGQEETAALGKLGLRPPVQQPVVGGDEHGLLLALADQRRAEYLGGVQGWHPHKVSVPLADLEGRVDNVAQAVHVDKVGKRNHELVGYLVREVVSPVQHCAGAAVSKGSRQQDVVGPLLETALGNGKQETWARPWFAPLVHPVDGGPWWNSVTEAPHASHSHWESAPGLEDGKNSIAFMSTLWRWASPGTNGGLSCGWTCTGAFRAGLEFAAGSASITPESHVFDAEAIGALKGLQAAAKAQPGARIWICVDSTSVIWGLRGDAPRTEVRVRWCPGHQGIPGNDRADELAKAGSAGPPDPDPRAQQTTYSGAGTVLRAILSNIEKDWWRKELCERSPAYREWKFQYTPRKEPEELRLPRPLLGHYLAMRTGHGDFKAYHDRFNHQDANTSCAWCWKRTSPEHPVHCRYSRAVWRNWPWPDNDRPVGPPDRAQRRKFFQTSLGQPTSFQAFSIATNYFSARPRAARQRPARHERTLRLGTPIVNDSNSDEE

SEQ ID NO: 22579 - protein, 305 aa, Halobacterium sp. NRC-1
MELGVVGLGRMGRIVVDRCLDAGHDVVAFDIDATAREDAADAGATPADTLDALAAELGAEKRIWLMVPAGDPVDAALDELAPHLDSDDVVVDGGNSHFEDSTRRAEEHDFAYLDCGTSGGPAGAELGFSLMVGGPEWAYDDLVPVFDAVATGPDGHDRMGPAGAGHYVKMVHNGVEYALMQTYGEGFELLHEGRYDLDLEAVARTWNNGAVIRSWLLELCEEAFREEGSDLGTVADHVAGGSTGTWTVQEALEQEVPVPLVSQALSERFGSRSTGGDTGRFARRLANRLRYGFGRHEVARTGDDA

SEQ ID NO: 22580 - protein, 288 aa, Rhodospirillum rubrum ATCC 11170
MRSTLGRLTVIAGTGGDGVPPSEGFLDALWLRLRQEAREAYAHAPMLAPLFVESILNQPTLEAAAFHRIAARLKNDLVGLGIIIDAFNRAVEAMPEIAQDLRTDIAAVVERDPACARFIEPFLYFKGFHAIQTHRLAHWLWHHDERDFALYLQSRSSDVFQTDIHPAARFGRGIFLDHATGLVVGETAVVENDVCLLQNVTLGGTGKDSGDRHPKVRQGAMIGAGAKILGNIEIGASARVAAGSVVLRSVEAGTTVAGVPAKLITRAAAPTEDQILNDLLYESFAYTI

SEQ ID NO: 22581 - protein, 192 aa, Halobacterium sp. NRC-1
MVTTLGVTLGLGVTLLFVVLHLAKGSSKPPAEDIAQDVLEHRASTVPETDFPEPYNRSIGGGGGAGAVAGGAESELEDGEEEDDGFDPDAIADDDVEYYEIEYVKEGETIEVASNESILDAGVDEGWDLPYACQQGQCVSCSGRVADGEDAAEYIRHSNNESLGDAEIEEGYMLTCTAHPTASFSIETDETP

SEQ ID NO: 22582 - protein, 340 aa, Bacillus licheniformis ATCC 14580
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRRARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 22583 - protein, 273 aa, Idiomarina loihiensis L2TR
MRIATLGPAGTFSEVAAGLYQPERQHQIQLLDSLVSCLDAIGNDCDAAVVPIENLTEGFVSPVVDYLVQRPLHIQAEIRIPVGFQCLANSAQPQQIWAQFVAAGQCNQCLNELGLPVIHTASNALSLDALLATEKPSAAVVPKHVNCPASLQILNSNIADNPRNETRFVVLSATSETPEFDKSTHWKSSLLLIDDNDHPGLLVDSLQVFAKQQINLTSIVSRPAGSQFGDYHFFIDFDGHLSEPGVAAALQELAKMNNIHWLGSYPAAAIGNQ

SEQ ID NO: 22584 - protein, 452 aa, Roseovarius nubinhibens ISM
MAQWTDSLPEAANAYLEGRRLDEVECIVSDLPGIARGKAVPASKFARQDYFHLPDSIFYQTITGGWAEAAGDEGFIERDMLLRPDMSTATAAPWTADWTLQVIHDAFDKTGAPIPYSPRNVLKRVVQLYRDQGLEPVVAPEMEFFIVARNIDPAQEIQPMMGRSGRPAAARQSYSMTAVDEFGPVIDDIYDFAEAQGFEIDGITQEGGAGQLEINLNHGDPVALADEVFYFKRLIREAALRHGSFATFMAKPIADEPGSAMHIHQSVLDLKTGENIFSTPEGEETDAFRHFLGGMQKHLPAAIAVLAPYVNSYRRYVKDHAAPINLAWARDNRTTGLRIPISGPKARRIENRLAGMDCNPYLGIAASLACGLLGMMNKVEPAAEFHGDAYEGDEDIPRVQGEALDLFEEATDLHEVLGREFARVYAIVKRAEYDEFLQVISPWEREHLLLNV

SEQ ID NO: 22585 - protein, 465 aa, Corynebacterium efficiens YS-314
MNASPTVTDQLVQTRKFKGLRARHIHFIALGSAIGTGLFYGSAGAIQAAGPSVLLVYLLGGAVVYFMLRALGEMSVRHPVRGSFAVYTRAHLGGWAGYITGWMFAFEMLIVCLADLTAIGIYMKFWFPDTAQWVWVAATLLIVGGANLASVRWFGELEFVFTLIKVTAVIAMIVGGAAILAFGLGNSPEVSGISNLWEHGGFFPNGIEGMIAAFILVLFAFGGTEIIGVAGSEAEDPEKSIPKAVNTVPARILLFYVGAILVILALNPWQTITGEESPFVQIFSTLGVNWAAGLLNLVVITAALSAINADLFGAGRVLTGLAKENLAPKIMGRVAGNGVPIMTTVIMIIVLILGVVLNVILPERVFEIVASLATFATVYVWLMILLAQVASRRQMSAQEVAGLKFPVPFYPFGQYFAILFIAFTFGIMVWYDNYHLALGVGVGFLVVMTILYYATGRPKAIAPAQ

SEQ ID NO: 22586 - protein, 981 aa, Arabidopsis thaliana
MDLSLIQGMSLPLYFLLTIFFFFFATAKTRRSSSTGTLPPGPPILPLVGNIFQLGFNPHRSLAAFSKTYGPIMSLKLGRLTAVVISSPEAAKEALRTHDHVMSARTFNDALRAFDHHKHSIVWIPPSARWRFLKKTITKYLLSPQNLDAIQSLRMRKVEELVSLVNEFRERGEAIDLARASFVTSFNIISNALFSVDLATYDSNSSSYEFHNTVVHLTEIAGIPNVGDYFQYMRFLDLQGTRKKAVLCIEKLFRVFQEFIDARLAKRFSRTEKEPKEASSIDMLDSLLDLTQQNEAELTMNDLKHLLLDVFVAGTDTNSSTMEWAMTELFRSTEKMVKAQSEIRQVIGQNGFVQESDIPSLPYLQAIVKETLRLHPAAPLIPRKSESDVQIMGFLVPINTQVVVNVWAIGRDASVWENPMKFEPERFLLRETDVKGRDFELIPFGSGRRMCPGISMALKTMHMVLASLLYSFDWKLQNGVVPGNIDMSETFGLTLHKAKSLCAVVPSPPGPPRLPIIGNIHLVGRNPHHSFADLSKTYGPIMSLKFGSLNTVVVTSPEAAREVLRTYDQILSSRTPTNSIRSINHDKVSVVWLPPSSSRWRLLRKLSATQLFSPQRIEATKTLRENKVKELVSFMSESSEREEAVDISRATFITALNIISNILFSVDLGNYDSNKSGVFQDTVIGVMEAVGNPDAANFFPFLGFLDLQGNRKTLKACSERLFKVFRGFIDAKLAEKSLRDTNSKDVRERDFVDVLLDLTEGDEAELNTNDIVHLLLDLFGAGTDTNSSTVEWAMAELLRNPETMVKAQAEIDCVIGQKGVVEESDISALPYLQAVVKETFRLHPAAPLLVPRKAESDVEVLGFMVPKDTQVFVNVWAIGRDPNVWENSSRFKPERFLGKDIDLRGRDYELTPFGAGRRICPGLPLAVKTVPLMLASLLYSFDWKLPNGVGSEDLDMDETFGLTLHKTNPLHAVPVKKRGRN

SEQ ID NO: 22587 - protein, 494 aa, Exiguobacterium sibiricum 255-15
MQQHTKSSLNTDFTKIFINGQWRKGASDSNMTNTNPFTGETLFEISAANNDDLDDAYQSAKVAQKEWAKVPALKRQGLIEEFLKVMYEEKETIVNWLIKESGSTRIKAEGEFLASVLIVKEAATFPLRMHGEIRPSVVPGKENRIYRKALGVIGVISPWNFPFHLAVRSIATAIAIGNAVVVKPATDTPVSGGLIFASLFEKAGLPKGVLNVIVGRGSEIGDSIVEHPVPRLISFTGSTEVGRHIGELAGKHLKKTALELGGNNVFVVLDDADLDRAVESAVYSKFYHQGQICMSTNRILVAQSIHDEFVEKYVARVKELQFGDPSNGRTQVGPLINQSQVDRIMEEIEKTKAAGATVRVGGEADGNVIAPTVVTGVTNDMPLAKNEIFGPVAVIIPFKDDAEALELANSLPYGLSGAVHGSSIERATEFALQVETGMIHINDQSVNDEPHMPFGGEKDSGLGRFNGEWVLEEFSTVQWLSVMHERRQYKPFFE

SEQ ID NO: 22588 - protein, 111 aa, Synechococcus sp. RS9917
MHRSDLAMVGSTSSTSPGGAAVLDKQTERVRKHSPRYKVLLHNDPVNTMEYVVTTLRQVVPQLSEQDAMAVMLEAHNTGVGLVIVCDLEPAEFYCETLKAKGLTSTLEPET

SEQ ID NO: 22589 - protein, 398 aa, Vitis vinifera
MAPAFEDETASETNFSDVEQLHKSKVTVVGSGNWGSVAAKLIASNTLKLSSFHDEVRMWVYEEILPSGEKLSEVINQNNENVKYLPGIKLGKNVVADPDLEHAVKDATMLVFVTPHQFMEGICKRLVGKIRGDAEAISLIKGMEVKMEGPCMISTLITDLLGINCCVLMGANIANEIAVEKFSEATVGYRENRDIAERWVRLFSTPYFMVSAVQDVEGVELCGTLKNVVAIAAGFVDGLEMGNNTKAAIMRIGLREMKAFSKLLFSSVRDSTFFESCGIADLITTCLGGRNRKVAEAFARNGGKRSFDELEAEMLQGQKLQGVSTAREVYEVLSHRGWLELFPLFTAVHEISTGRLPPSAIVEYTIEVHTSLYTVPRVACHGNNQLLHLKFPTQKDIK

SEQ ID NO: 22590 - protein, 357 aa, Oryza sativa Japonica Group
MTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 22591 - protein, 618 aa, Aspergillus nidulans FGSC A4
MGSHSKAIPPSDKPCTSIPPNLLPSAPASPPTPAPSPTPHQRLPSWRAPEQEEDALLLNTKFFESLSGPRRQQYLEAILSLCSSQQLSFVSSYVAPRLRKDPFRVFPTEISLRVLSFVEDPKTLARASQVSKRWHALLEDDITWKNLCEKHAFTHRRPAEDNQDIIESIHNHRTNSLSGLQRRPNSATIQSRDGFADIPRSLSGDWIASSSIQTRKRRVRPLSYKYHFKQKYMIESAWSKGGRCTQRHISPDQGVVTSLHLTPKYIVASLDNAKIHVYDTNGENQKTLEGHVMGVWAMVPWDNILVSGGCDREVRVWNMATGESIYLLRGHTSTVRCLKMSDKNTAISGSRDTTLRIWDLRTGTCRSVLVGHQASVRCLAVHGDIVVSGSYDTTARVWSISEGRFLRALSGHFSQIYAIAFDGRRIATGSLDTSVRIWDPNTGQCHAILQGHTSLVGQLQMSGDTLVTGGSDGSVRVWSLTRMAPIHRLAAHDNSVTSLQFDNNRIVSGGSDGRVKVWCLRTGQLLRELSTPSDTVWRVTFEEEKAVIMSSRSGRTVMEVWSFSPPPEDTEFDAATIGASSSISEPPPVRDSHPIRPLVLPDLPQRSDGDQVMVDVPP

SEQ ID NO: 22592 - protein, 306 aa, Oryza sativa
  misc_feature (207)..(207): Xaa can be any naturally occurring amino acid
VPERGGVTLIRAHHHASRLTSYQVSSFLLILPNHCIRVGVLLLLLLLLAECNGAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLXMTEKRIRHIPVIDGTGMVGMVSIGDIVRAVVSEHREELNRLNAYSGRVATRTPTSNVGHSLLPLRLCLSEKDSLIQITLARDDDEIGRDFPGEIVAECF

SEQ ID NO: 22593 - protein, 335 aa, Campylobacter jejuni RM1221
MRLILDTDIGNAIAGANTDDGLALALILSSKEIKLEMLSTVCGNVPSLVAYSVAKDLFKRLNLNIPVYLGANEALKEPSKAWRQRLDESVKNFKLEYLWENIKSPEILENINPDAIFKMGELVSKNPKEISICAIGPLTNIAMTMKIFKDFDINLKELFIMGGSFDMPYYTKDTNFGFDPEAASIVLNSRAKITLVPYNATMQTLLTHEDLKELQGKNILCDFIVETLGVWIDYASKTRGTKGTWIHDALTIAYALDSSIADFDECYADVICDSSLARGMSWRCFKEPKMSMGVDLSTKNCVKILKNVDNAKLLKLIKEKFLKGVCYENYESITT

SEQ ID NO: 22594 - protein, 461 aa, Arabidopsis thaliana [sequence omitted]

SEQ ID NO: 22595 - protein, 232 aa, Zea mays
MEDWDSEEFQPVVPVVKAEPLKNQWADEDVEEDDVKESWEEEEEEEKPKPAPVEKVAAKPSTKAPAKKGKQQALTSAEEPDEPPLSPTSQKIRQQRLVEEADFKSTTELFAKKGSEQKSLDTFIPKSESDFAEYAELIANKLRPYEKSFHYMALLKNVMRLSMTSLKGADAKDISSSVTAIANEKIKAEKEAAAGKKKQGAKKKQLHIEKGDDDFIPGRGGGYDDPDEYDFM

SEQ ID NO: 22596 - protein, 145 aa, Triticum aestivum
MVLTHVQSDEAAASAAVFASRYVQDPVPSYELGEKSISKDAAYQIIHDELLLDGSPRLNLASFVTTWMEPECDRLILEGMNKNYADMDEYPVTTELQNRCVNIIARLFNAPVGAGETAVGVGTVGSSEAIMLAGLAFKRRWQNRR

SEQ ID NO: 22597 - protein, 444 aa, Kluyveromyces lactis NRRL Y-1140
MSSQEQPGRIETLNEEQETKLKQVWAHLFNFWDIPVDSRKVLTHYHDSLRRNNTVSSEASHATVESGAKKTGKLFGRFRKSTKTEKKEPIKPRSRHSRTSSVTSTRSRESIEAAYTPNMVHDALKELQPEEIRNNLWDMLRVDYPDNLVLRFLRARKWDTDKTMYMLANSLRWRLKDARPDDIIKRGELGAYEDDKAGYVKNIELRKAVIHGFDRLGHPIVYVRPRKHLSSDQTEAEVHDYSLLIIEQTRLFLKEPVDAATILFDLSGFTMSNMDYAPVKYLISCFEAHYPECLGKLFIHKAPWIFPPIWNIIKNWLDPVVASKIVFTKTAKDLAEYVPEEYIPKDLGGDCTYDYDAYEKPDGSLDTKLNKKAELEEIVTERKALVDKFIQATVSWIEATDDETNAKWLAAKIELGKELTENYIKMDPYIRSRSFYEYEGTLSL

SEQ ID NO: 22598 - protein, 252 aa, Aegilops speltoides
RPKGVTPKFSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSAGSSLVEEDKLELATSLLAKAKAKGVSLLLPSDVIIADKFAPDANSQTVAASAIPDGWMGLDIGPDSVKTFNDALDTTQTI

SEQ ID NO: 22599 - protein, 252 aa, Aegilops speltoides
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSAGSSLVEEDKLELATSLLAKAKAKGVSLLLPSDVIIADKFAPDANSQTVAASAIPDGWMGLDIGPDSVKTFNDALDTTQTI

SEQ ID NO: 22600 - protein, 362 aa, Corynebacterium diphtheriae NCTC 13129
MTETTLRSDTDAVILVGGKGTRLRPLTVSTPKPMLPTAGVPFLSHLLARIKAAGITHVVLGTSFKAEVFEDYFGDGADLGLEIEYVVEDKPLGTGGGIRNVYDKLRANTVMVFNGDVLGGTDLGGILDAHHAKNADLTMHLVRVPDPRAFGCVPTDAEGRVSAFLEKTEDPPTDQINAGCYVFRRELIGEIPADRVVSVERETFPRLLEEGRRVFGYVDNAYWRDMGTPSDFVRGSSDLVRGIAPSPLLEGKTGECLVDESAGVSDGALLLGGTVIGRGTEIGAGCRLDDTVVFDGVTIEPGAVIEDSIIGHGARIGANARITGCVIGEGAEIGARCELRDGMRVWPGVVIPTAGIRFSSDA

SEQ ID NO: 22601 - protein, 530 aa, Lactobacillus plantarum WCFS1
MSEKTNTPNRKHKLIEYANGPSLEEINGTIEVPKNLNFWKTLFAYSGPGALVAVGYMDPGNWSTSITGGQNYQYMLMSVILISSLIAMLLQYMAAKLGIVSQMDLAQAIRARTSKSLGIVLWILTELAIMATDIAEVIGAAIALYLLFNIPLVIAVFITVLDVLVLLLLTKIGFRKIEAIVVCLILVILFVFVYQVALSNPDWGGVIKGLVPTADTFSTSRSVNGMTPLSGALGIIGATVMPHNLYLHSAISQTRKIDHNDEEDVARTVKFAAWDSNIQLSFAFVVNSLLLIMGVAVFKSGAVKDPSFFGLYEALSNTSMLSNGILISVAKSGALSALFAIALLASGQNSTITGTLTGQVIMEGFVHMRMPLWLRRLVTRLISVIPVLICVLLTSGKSAIDEHTALNNLMNNSQVFLAFALPFSMLPLLMMTDSAAEMGKRFKNSLWIKGLGWLSVIGLTFLNLLGLPDSILGFFGDNPSAGEQTFSKILAYLLIAAILALLVWTVFDLQRGNKRYVEQQLAAAAKEANK

SEQ ID NO: 22602 - protein, 338 aa, Bradyrhizobium sp. BTAi1
MTAPEGTLESFLEGDCSVSEPLAITVTALAFVAETLAGVISSGPLNGRLGEEVGANSDGDRQKKLDVVADELFAGALAPTPVRWYASEERPTAEMLNPEGTLALAIDPLDGSSNIDVNISIGTIFSVFEAKESGVESFLRPGREQIAAGYVVYGPQTVFILATRTTLAQFVLHRGHFFLVSDSLRIPDRTTEFAINASNYRHWSRPIRAFVDDCIAGDEGPWGENFNMRWVASLVAETHRILTRGGIFLYPADARRGYGQGRLRLVYECAPIAFIVERAGGKATDGIDRILDLTPSELHQRTPLVFGTAEKVSQVCAYHDLPESEVSPLFGTRGLFRA

SEQ ID NO: 22603 - protein, 239 aa, Aegilops speltoides
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSV

SEQ ID NO: 22604 - protein, 321 aa, Exiguobacterium sibiricum 255-15
MRALRFRTFGDSSVLHYEEYPTPEIKSNEVLIEMKAIGLNFADIYRRKGNYHLEGTPPYLLGYEGSGIITQIGAAVTDLQVGQRVAFADVPNANAEFVAAPVDKVIPLPDFVSYETAASVLLQGLTAHYLTRDSYTIRPKDLVLVHAAAGGVGQLLTQIVRLHGAIPIGLTSSMEKADIAKQAGAEHVFLYSDNWVEQILTLTDQRGVDVVYESVGSTLMNSFEVTKIHGTVVFYGMAGGDPVSVDPRFLMDTSKTLTGGDLWNVLTTREERIRRAGELFSWLESGQLQIASPTTFSLSDGQRAHDYLESRQSTGKILLLP

SEQ ID NO: 22605 - protein, 295 aa, Bradyrhizobium sp. BTAi1
MSEQHPIISVVGSSGAGTSTVKHTFDQIFRREGIKAVSIEGDAFHKFDRASMKAELQRRYDAGDRTFSHFSFEANELSELEKVFASYGATGTGRTRHYVHDDEEAERYGVPPGRFTEWEDFDKGSDILLYEGLHGAVRTQDIRIADHADLKIGVVPVINLEWIQKVHRDKASRGYTAEAVTDVILRRMHAYVHCICPQFSETDINFQRVPVVDTSNPFIARWIPTAGESLVVIRFKNPRGIDFPYLVQMIRDSWMSRANSIVVPGDKLDLAMQLILTPMILRLVDQSKRLKRASS

SEQ ID NO: 22606 - protein, 361 aa, Kluyveromyces lactis NRRL Y-1140
MKGLILVGGYGTRLRPLTLTVPKPLVEFGNRPMILHQIEALAAAGVTDIVLAVNYRPEVMVETLKKYEDEFGVSITFSVETEPLGTAGPLKLAESVLKKDNSPFFVLNSDVICDYPFKELADFHQAHGGKGTIVATKVDEPSKYGVIVHDIATPNLIDRFVEKPVEFVGNRINAGLYILNPEVIDLIDLKPTSIEKETFPILVEQKSLYSFDLEGYWMDVGQPKDFLSGTVLYLNSLSKRDPAKLAKGENIVGNVLVDPTAKISPTAKVGPDVVIGPNVVIGDGVRITRSVALSNSHIKDHALVKSTIIGWNSTVGKWARLEGVTVLGDDVEVKDEIYINGGKVLPHKSISVNVPKEAIIM

SEQ ID NO: 22607 - protein, 335 aa, Bradyrhizobium sp. BTAi1
MTVRVAINGFGRIGRNVLRAIYESGRGDIEVVAINDLGSVDINAHLLRYDSVHGTFPGAVKVNGASIDIGRGSPIRVTAERDPKTLPWKDVDIALECTGIFTAREKASLHLENGSKRVLVSAPAAGADKTIVFGVNHNSLSPGDNVVSCASCTTNCLAPVAAVLHRTIGIDKGFMTTIHSYTGDQPTLDTLHKDPYRARAAAMSMIPTSTGAAKAVGLVLPELNGKLDGVAIRVPTPNVSVVDFKFIASRETTAEEINSVVRTAAGADLEGILGFTDEPLVSVDFTHDPRSSIVHMDQTKVIDGRLCRVMSWYDNEWGFSNRMADTAVAMGRLIG

SEQ ID NO: 22608 - protein, 400 aa, Bradyrhizobium sp. BTAi1
MTLKSVHDVDISSRRLLIRADLNVPMNNGGVADATRIERFVAGLKPLLARGARAVVLSHLGRPDGQRRPELSLEPVAAALGRVLGKDVAFSEAISGPVAARSAAALGPGDVLVCENLRFDQREEANDASLAEELAELGDLYVNDAFSCAHRAHASTVAIAERLPAVAGPLMMAEISALTQALEAPQRPAVALVGGAKVSSKIDVLFNLIGKLDTVIVGGGMANTFLAANGLPIGKSPHESAKFETVRKILSRAQSCGCQIVLPVDIVWADRFERGAEAHIAELDCCPQHGMILDAGPRSIERIWDVLAEAKTILWNGPLGAFEIEPFDHATEAVAAEAARLTRVGKVKSIAGGGDTVAALNAAGVTEDFTYVSTAGGAFLEWLEGKELPGVSVLRTPQLA

SEQ ID NO: 22609 - protein, 445 aa, Xanthomonas campestris pv. vesicatoria str. 85-10
MMHHTSPNSAARHACVAQARTHCWRNDIAPMHRRMRRDASAPLAGQRSSAPIRQTTMRILVTGGTGYIGSHTCVELARRGHDVCIVDNLSNSSERVLDHLQHLMGFRPEFHRMDVRAPELADLLISERIDAVLHFAALKAVGESVREPLLYFNNNVTGTLALLRAMRTAKVCNLVFSSSATVYGDANRSPIDESAPLKAINPYGRTKLMMEEMIGDLSAAWPDFNAALLRYFNPVGAHPSGYLGEDPRGVPNNLMPYIAQVAVGRRAALQVFGDDYPTDDGTGVRDYLHVMDLARAHVDAIDYLQRERKGLVVNLGTGRGYSVREVAAAFARASGRRIPLSIGPRRGGDVAVYFASTALANRLLGWTAEYDLDRMCRDTWRWQSMHPDGYAGSRLPRPRSAAAVPERDSARELPTSPRRRPPGPDTRRRSEPVRTLAVADGFSGA

SEQ ID NO: 22610 - protein, 485 aa, Oryza sativa
  misc_feature (100)..(100): Xaa can be any naturally occurring amino acid
MEKSEIFVGAHSYAAICAFTLIIGWLAHWVYRWINPPCNGRLPPGSMGFPIVGETFQFFRTSPSIDMPIYYKRRLERYGPIFKTNIGGQHVVISLDPEVXNQFIFQQEGKLFQSWFPETTLNIFGKKTLTTYNRTAHKLIRSFVCKLYGPENVKKSLLPELENSMRESLASWIGKPSVEVNDGVSNMIFGLAAKHLIGLDITNSGELKKNFQEIFQVMVSIPFPIYFPGTSFYRCMQGRRNVWTTLTNVMKKRLSAPGNKFGDLVDLIVEELRSENPTIDESFAIDTLSGLLFASFAPLSCTLTTTFKFLNDNPEVFDKLKEEHEMILKKREGANSGFTWEEYKSLKFSTQVVNEINRITTVIPGGFRKALTDVQVNGYTIPSGWLVMISPMGVHLNPKLFEDPLKFDPWRWTEEKRISMQRNFMPFGGGIRMCPAAEFNKLFITLFLHIVVTEYRWKDIDGGNVKRISEVLVAQEYHIQLVPQT

SEQ ID NO: 22611 - protein, 134 aa, Cryptococcus neoformans var. neoformans B-3501A
MVVDGRRDARSKWPAVAANSQGIQTLLEAEKEAAKVVQKARQYRVQKLKDARSEAAKEIEAYKAKKEEEFKRFESEHISRTSTSQTSIDSTTKTQLSELDDAVAKNKEEVVKKIVSRVLQSKPHLHPNLKKLEA

SEQ ID NO: 22612 - protein, 155 aa, Picea glauca
MASADVEFRCFVGGLAWSTDDRSLQEAFSPYGEVVESKIISDRETGRSRGFGFVTFNDEQSMRDAIDAMNGKMLDGRSITVNPAQSRGNGGGGGGGGSRGYRGGGGGGGYGGSRDRGDRGYGGGGGGYGGGGGGYGGGGGSRYGGGGSEGGSWRR

SEQ ID NO: 22613 - protein, 181 aa, Populus trichocarpa x Populus deltoides
MASSVISSAAVATVNRTPAQANMVAPFNGLKSTSAFPVTRKANNDITSIASNGGRVQCMQVWPPTGLKKFETLSYLPDLTTEQLAREIEYLLRNKWVPCLEFELEKGWVYREHHQSPGYYDGRYWTMWKLPMFGCTEASQVLIELEEAKKAYPNSFVRIIGFDNTRQVQCISFIASKPKGV

SEQ ID NO: 22614 - protein, 99 aa, Zea mays
VKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 22615 - protein, 362 aa, Mycobacterium tuberculosis CDC1551
MSASLPVFPWDTLADAKALAGAHPDGIVDLSVGTPVDPVAPLIQEALAAASAAPDYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSAAWLAQRGILVAPGDFYGPGGAQHVRVALTATDERVAAAVGRLTC

SEQ ID NO: 22616 - protein, 503 aa, Oryza sativa Japonica Group
MESLLAAGAGGIGVAAAAAVVAATLAVVPPKDRGNNPPPADPGLPVIGNMHQLKEKKPHHTFTKWSKTYGPIYTIKTGASSVVVLNSTEVAKEAMIEKFSSISTKKLPKALSVISRKNMVSISDYGDFYKMAKRNIMLAILGFNAQKRFCDTRERMVSNVLSSLHKLVAVDPHSPLNFREVYTTELFGLSLIQNLGEDVCSVYVEEFGREISKEEIFHVLVHEILSCVVEPDWRDYFPYLSWLPNKSFETIVSSTEFRRDAVMNALIKRQKERIARGEARISYIDFLLEAKNSTQLTDHQLMLLLAESIAAAVDTVLVTTEWAMYELAKNPDKQEWLYREIREVCGGKAVTEEDLPRLPYLDAVLHETLRLHSPVPVLPTRFVHDDTTLAGYDVPAGTQVMINVFGCHMDEEAWESPGEWSPERFLGEGFKLADRYKTLAFGAGRRTCAGSQQAVSIACVAIARFVQELQWTLREGDGDKEDTTQYTALKLHPLHVHLKPRGS

SEQ ID NO: 22617 - protein, 169 aa, uncultured candidate division OP8 bacterium
MERPSRRKKRNCGWILALIHGIQRPSCTPKGASPNASDKAKSMDINKLPIGENAPEEVNVIIEVPMGGNPVKYELDKESGAMFVDRFLHTAMHYPCNYGFVPHTLSDDGDPVDAAVLGQHIVAPGVVIPSRPIGVLLMEDESGIDEKILCVPINRLHPYYENVTSIDHV

SEQ ID NO: 22618 - protein, 505 aa, Oryza sativa Japonica Group
MEAFVPGGAGVAAAAVGGFVAAAALAERAGVIAPRKRPNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISREEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 22619 - protein, 267 aa, Zea mays
  misc_feature (58)..(58): Xaa can be any naturally occurring amino acid
  misc_feature (72)..(72): Xaa can be any naturally occurring amino acid
MSLRASIIGLPNVGKSNLFNAIVVRCFEDDDIVHVNGRVEPGSDIDVINLELIFSDLXQEQAEKSGLEKIQXALMEGKPARSVDLAEHEKEVIKHLYLLTMKPVISVANVIESDLAEPDINPRVKEVAKAASYLQYGMVTILAQIETELAELPLEERVEYLKSLGVAESGLGNLVKATYNLLGLRTYFTTGDKVHHLCCVTAPQAAGVIHSDFQKGFIRVETVSYDDFVAAGFLGVAREKGLEKFQKHRVKKFWQHFHFILIAVPRQ

SEQ ID NO: 22620 - protein, 208 aa, Oryza sativa Japonica Group
MASYHQQQGGSTFMAIPTINFQMYSEIAGDDEWWEYIPCPFCYIEVEVHFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 22621 - protein, 345 aa, Candida glabrata CBS 138
MPVATERRASMDDFDTDIITLPRFIVENQKTVKTARGDFSLVLNALGFAFKFISQTIRRAELVNLIGLAGASNSTGDEQKKLDVLGDEIFINAMKGCGFIKLLVSEEQEDLIVFPTETGTYAICCDPIDGSSNLDAGVSVGTIVSIFKLLPGSTGSIKDVLRSGHDMVAACYAMYGASTHLMLTMGNGVDGFTLDTNLGEFILTQPNLRIPQLRPIYSVNEGNRLYWDELIVSFIDSLKEGQESNKGKPYSLRYIGAMVADVHRTFLYGGLFSYPGDRLKPDGKLRLLYEAFPMAFLVEQAGGKAVNDQGERILDLVPKHIHDKSSIWLGSSGEIDKFLKHIGKE

SEQ ID NO: 22622 - protein, 361 aa, Candida glabrata CBS 138
MKGLILVGGYGTRLRPLTLSVPKPLVEFCNRPMILHQIEALAEAGVTDIVLAVNYRPEVMVDTLKKYEKEYGVNITFSVETEPLGTAGPLKLAEKILKKDNSPFFVLNSDVICEYPFKELAEFHKSHGGKGTIVATKVDEPSKYGVIVHDLGTPNLIDRFVEKPKEFVGNRINAGLYILNPEVIDLIEMKPTSIETETFPKLVNEKSLYTFDLEGFWMDVGQPKDFLAGTGLYLQSLSRRHPEKLSTGSNIVSNAIIDPTAKISPDAKIGPDVVIGPNCVIGSGVRIVRSVLLKNCVVKENSLIKDTIVGWDSTIGRWCRLEGCAVLGHDVAVKDEVYVNGAKVLPHKSISANVPSEAIIM

SEQ ID NO: 22623 - protein, 500 aa, Mentha arvensis
MELQISSAIIILVVTYTISLLIIKQWRKPKPEENLPPGPPKLPLIGHLHLLWGKLPQHALASVAKQYGPVAHVQLGEVFSVVLSSREATKEAMKLVDPACADRFDSIGTKIMWYDNDDIIFSPYSEHWRQMRKICVSGLLSARNVRSFGFIRQDEVSRLLGHLRSSAAAGEAVDLTERIATLTCSIICRAAFGSVIRDHEELVELVKDALSMASGFELADLFPSSKLLNLLCWNKSKLWRMRRRVDTILEAIVEEHKLKKSGEFGGEDIIDVLFRMQKDSQIKVPITTNAIKAFIFDTFSAGTETSSTTTLWVMAELMRNPEVMAKAQVEVRAALKGKTNWDVDDVQELKYMKSVVKETMRMHPPIPLIPRSCREECEVNGYKIPNKARIMINVWSMGRNPLYWEKPKTFWPERFDQVSRDFMGNDFEFIPFGAGRRICPGLNFGLANVEVPLAQLLYHFDWNLAEGMKPSDMDMSEAEGLTGIRKNNLLLLPTPYDPSS

SEQ ID NO: 22624 - protein, 476 aa, Arabidopsis thaliana
MSYNTGKESSPVSPLKKRRASWSELWVNHHHLLSSSPLDLAAKFQSLTPPISKSKTLLPDFTLLLPDLILIRVIQKIPNSQRKNLSLVCKRWFRLHGRLVRSFKVSDWEFLSSGRLISRFPNLETVDLVSGCLISPPNLGILVNHRIVSFTVGVGSYQSWSFFEENLLSVELVERGLKALAGGCSNLRKLVVTNTSELGLLNVAEECSRLQELELHKCSDSVLLGIGAFENLQILRLVGNVDGLYNSLVSDIGLMILAQGCKRLVKLELVGCEGGFDGIKEIGECCQMLEELTVCDNKMESGWLGGLRYCENLKTLKLVSCKKIDNDPDESLSCCCPALERLQLEKCQLRDKNTVKALFKMCEAAREIVFQDCWGLDNDIFSLAMAFGRVKLLYLEGCSLLTTSGLESVILHWHELEHLKVVSCKNIKDSEVSPSLSALFSALVELQWRPDTRSHLSSSLTGTGIGEKGGKFFKKT

SEQ ID NO: 22625 - protein, 251 aa, Bacillus cereus ATCC 14579
MVFMIIRNEQDLEGLRKIGRIVALAREEMKKQAKPGMTTKELDLIGKKVLDEHGAISAPEKEYDFPGVTCISVNEEVAHGIPGDRVLKEGDLVNVDVSAALDGYYADTGISFVLGEDEAKEKLCQAAVDAFWAAMKKVRAGSKQNQIGRAVSNFAHKSGYNVIQNLTGHGIGLSLHEAPNHILSYYDPMDNALLKDGLVIAVEPFISMKADHIIERGDDGWTFVTPDKSLVAQCEHTVVVTRGEPIILTEI

SEQ ID NO: 22626 - protein, 243 aa, Bradyrhizobium sp. BTAi1
MTFDRSIKIAPSILSADFAAFGAECRAIEAQGCDWVHVDVMDGHFVPNITFGPQLCRAIRPHVKTVMDVHLMITPVDPYIHAFAEAGADVITAHVEAGPHLDRTLQAIRAAGAKAGVSLNPSTPAEAIEFVLDRIDLVLVMTVNPGFGGQSFIEAMVPKIRRLREMVGDRPIHIEVDGGVTPATAPLVAAAGADVLVAGSAVFKGGSAADPAPYGRNILAIREAATAAQRKVAEADGTRGHWT

SEQ ID NO: 22627 - protein, 387 aa, Xanthomonas campestris pv. vesicatoria str. 85-10
MLALNYHGSRDVRVETVPDPLLVERDDLILRVTATAICGSDLHLYRGKIPDLRPGDILGHEFMGIVEEVGPDVTAVKPGDRVVIPFVVACGRCFHCVLQEFSACETTNTGKGAALNHKDMRPPAALFGFSHLYGGLSGGQAEYVRVPKANVGPLVVPDALHDEQVLFLSDILPTGYQAVVDAGVKQGSTVAIFGAGPVGLMAAACCRMLGAERIFMVDRHAYRLDFASRAYGVIPINFDEVDDPADVIVSQTDGRGVDASIEAVGFEAEGSAIETALTNLKLEGSSGVAIRQCIAATRRCGVVSVPGVYAGFIHAFMFGDAFDKGLTFKMGQTHVQKHMPHLLECIGNGQLKPSSIISHRMPLADAARGYELFDKKQDDCRKVVLTP

SEQ ID NO: 22628 - protein, 568 aa, Brassica juncea
MASTPKLTTTISSSPSLQILCRKLPIAINHLPSSSTSRSLPKTLSYLSSLHRLRVPSVSNHRYYSSSSSRRCFSVRAVQNADNGADSDRHYDFDLFTIGAGSGGVRASRFSTSFGASAAVCELPFSTISSDTTGGVGGTCVLRGCVPKKLLVYASKFTHEFEDSRGFGWKYDTEPSHDWSTLIANKNAELQRLTGIYKNILNNANVKLIEGRGKVIDPHTIDVDGKIYTSRNILIAVGGRPFIPDIPGREYAIDSDAALDLPSKPKKIAIVGGGYIALEFAGIFNGLNSEVHVFIRQKKVLRGFDEDVRDFVGEQMSLRGIEFHIEESPEAIIKAGDGSFSLKTSKGTVDGFSHVMFATGRKPNTKNLGLENVGVKLAKNGAIEVDEYSRTSVPSIWAVGDVTDRINLTPVALMEGMALAKTLFQNDPTKPDHSAVPCAVFSQPPIGTVGLTEEQAIEQYGDIDVFTSNFKPLKATLSGLPDRVFMKLIVCANTNKVLGVHMCGEDSPEIIQGFGVAVKAGLTKADFDATVGVHPTAAEEFVTMRTPTRKIRKESSEGKASLEAKTAV

SEQ ID NO: 22629 - protein, 569 aa, Erythrobacter sp. SD-21
MAGEALVPTIKWLAASTPRSLLRDVIAGLVLSILLVPQAMAYAQLAGLPPQMGLFAALTPPLLYLVFGTSPFVSLGPVALVSLVIGEVVGSTSLAPEIGAEIIAIEAGLLLLLLGGFGLGRLVNFISEPVLLGFTAAAAVLIAASQLPTLLGINAARAGDLPTALGGLWVRFGSIKPVTAAIGLAALVTLVLAGRYAAPLLWKMGVKPPFRLALAKSFPLVVIVVAGLVASSSAAPVPMVEAVEGGLPEPVFPFVPLEYWLQLLPGSFAVAIIIFVTATAVAKALAGEDRSNLDTSREAVALGAGNVVAAVTGGYAVGASLSRSALVRDSGGHSPLVTVCASAVVVAVLFFLAPLLAYLPQTALAALVISAVFGLVKTRDIRMVWQHDRVEGLIIGAAFVATLLFGVQLGLAIGAVLGLAHFLWFSSTPRVTQIGTADGGTTYRSVRRDDVTIKTLPVLVVRIDRTIYFGNSEYCEDRIVKLVAQYEGVEHLVLDMRAVNAVDASGAAMLLRLVQRMRDYGVIVHFAATHEPVAQKIRPYGGERSDFHRTVSDALEACGVPEEGPIPYT

SEQ ID NO: 22630 - protein, 114 aa, Zea mays
MASIGSSNIGFQLLKKSGWKEGTGLGAQEQGRLEPVETRVKNNKRGIGSKEPKPQPKVEDDIETHPQKPKQEMQSKKRAKLAAKRIRKLQEEEKRLKEKEFEMAFFREFWPDNV

SEQ ID NO: 22631 - protein, 489 aa, Erythrobacter sp. SD-21
MQKLDPKRVDPRGRKVKILATVGPASRSPEMLARLYKAGVDAFRVNMSHGEHADHEKTIRAIRQMEKDFHRPIAILADLQGPKLRVGKFKDGQAVIRHSGHFTLDRNPEPGDETRVQLPHPELFGLLEKGQRLLINDGKIRLKVIRADENEILCSAEVGGVISDRKGVNVPDAEVPIPALTDKDRKDLAFAMSQGVDWIGLSFVQRPEDLAEARRLMGGKGSLCAKIEKPMAVRRLDEIIEMSDGIMVARGDLGVELEPQEVPPLQKRIVNATRTAGKPVIVATQMLESMIESPAPTRAEVSDVANAVYDGADAVMLSAETAAGDWPEEAVTIMHKIARQVEKDDAYLERVRFLDTPPDKTTADALAHACMTVADTVAIEAITVFTGSGSTARRVARERPSVPMLVLTPSMTTARRLGLLWGAHAVATKDIGSFEEMIAKGKRMALRHGFGSAGSKLIALAGVPFGTPGSTNLMHVVTISGNELDKHEG

SEQ ID NO: 22632 - protein, 406 aa, Burkholderia sp. 383
MLQLDFHPSGRHFLQIPGPSPVPDRILRAMSYPTIDHRGPEFGALGLKVLAGIKKIFKTTQPVVIYPASGTGAWEAALTNTLSAGDTVLMFETGHFATLWKKMAEALGLKPEFLGLPGIEGWRRGVQPDMIEARLRADTAHDIKAVCVVHNETSTGVTSDIAAVRRAIDAAGHPALLMVDTISGLASADYRHDEWGVDVTVSGSQKGLMLPPGISFNAVSPKALAASEHATLPRAFWGWHEIIEANRNGYWPYTPNTNLLYGLAEALDMILGEGLDNVFARHQRLAEATRRAVRAWGLEIQCADPAVYSPVLTGVMMPDGVDADAVRKLIYERFDMSLGQALGKMRGKMFRIGHLGDCNDLTLMATLAGCEMGLKLAGVPVAASGVVAAMDYLATNTHTPALRAAA

SEQ ID NO: 22633 - protein, 180 aa, Oryza sativa
LQEFGTRPRAEFGTRVPRNVSACVSEVGHARVYNVDDLKEVVEANKEDRLRKAMEAQTIITQELKRFEAWRDSLETVPTIKKLRSYADRIRASELEKCLQKIGEDALTKKMRRSIEELSTGIVNKLLHGPLQHLRCDGSDSRTLDETLENMHALNRMFSLDTEKAIIEQKIKAKVEKSQN

SEQ ID NO: 22634 - protein, 229 aa, Prosthecochloris aestuarii DSM 271
MKTISENLAAIQKEILTSCLKAGRSPEDVRLIAVSKTKPASLIREAYDAGQIDIGESYVQEFLEKTASPELEGLPVRWHFIGHLQSNKIKYIVDKVYMVHSIDKLSTARELSKRAAAKNLTVDYLIEVNTSGEPSKFGLSPEELLKTAGSFFDLPSVTLRGLMTIASPDPSLAHEEFKLLANLLEQLRAKAPHPENITELSMGMSGDFEKAIDAGATMVRIGTALFGRR

SEQ ID NO: 22635 - protein, 404 aa, Prosthecochloris aestuarii DSM 271
MPYTHSPVFTPAQRVQNYNYAIRNIVTHARKLEAQGKKITYLNIGDPVLYGFQPPEELIEANVLALRHGHNGYSPSSGRKEAVEAIAEDACRRGISTSPDNVIITFGASEAADLVCTSMLNPGDEVLCPSPGYPLYNAIIAKLNAREVRYSLDPANDWLPDPEQVEKSITPRTKILVVINPNNPTGELYSRETLDMFVDIARRHKLLIITDEVYHKLVYEGEHIPLASLASDDVAVITIDSLSKNYMAPGWRTGWLMITNSALIPDVRQAFIKLADARLCAPMAPQYTIKAAMTMGPEYNETILSRLRAQRELTIDRLNAIEGFSCNKPSGAFYVMGKLDLDATPFKTDEEFVLKLLQEKQVLFVHGSGFGTDPASGYARIVYLPDVTILEKVYADVADFINSL

SEQ ID NO: 22636 - protein, 181 aa, Synechococcus sp. CC9311
MSSSGPNNSGDVPTLLVKDSEGRDLLCFLEQLIPLDGQDYALLTPVDTPVCLFRLKDGDEPELIDSITSNEPILSVADVVLQEHDLTLVRSAVTLTVNGELDEPDPEDLDEDEAGDDESETYELLVSFLVDELEYGLYIPLDPFFVVARMDDGAAVLVEGDEFDQIQPRIEAELDERELSE

SEQ ID NO: 22637 - protein, 79 aa, Glycine max
ILRDLGVRSMKLMTNSPAKYSGLKGYGLSIAGRVPLVTPITSENRKYLETKRTKMGHVYGLANAQVNQPSGSQSTEEKH

SEQ ID NO: 22638 - protein, 209 aa, Caulobacter vibrioides
MYDPVSTAMNLVPMVVEQTSRGERAFDIFSRLLKERIIFLTGPVEDGMASLICAQLLFLESENPKKEIAMYINSPGGVVTAGLAIYDTMQYIKSPVSTVCMGMAASMGSLLLAAGAAGQRISLPNARIMVHQPSGGFRGQASDIERHAEDIIKTKRRLNEIYVKHCGRTYEEVERTLDRDHFMSADEAKAWGLVDHVYDSRDAAEAGAE

SEQ ID NO: 22639 - protein, 497 aa, Candida glabrata CBS 138
MAYKTAATKTIKLPNGLTYEQPTGLFINNEFVESSDGKTMTIENPSTQEPIVDVFSATKEDVDYAVDCAERAFEKSDWATQDPKVRARYLSKLADLMEEQLELIASIETLDNGKTIALSRGDVQLSINCIRDAASYADKVDGRSIDTGDGYMNYTIREPIGVCAQIIPWNFPLMMLSWKVGPALAMGNCIVLKPASATPLNALYFSSLCKQVGIPAGVVNIIPGPGGMVGTALTTHPKVRKVAFTGSTDIGKDIAVKASASNLKKITLELGGKSAHLVFNDANLEKTLPNLVNGIFKNAGQICSSGSRIYAQAGIYDRLLKEFKAYIEKNIKVGNPFDESNFQGAITNKEQYNTILKYINIGKEEGAKVLTGGETAAEKGYFIKPTVFYDVKEDMRVVKEEIFGPCVTISKFEEIEDGVAMANDSEFGLGAGIETENLSTALKVAKMLHSGTVWINTYNDFDSRVPFGGYKQSGYGREMGSEVYECYTQTKAVRIKL

SEQ ID NO: 22640 - protein, 240 aa, Kluyveromyces lactis NRRL Y-1140
MATTASEYGNELSKVPIQHQFNPYSDNGGTILGIAGEDFAVLAGDTRHTTDYSINSRYEPKVFECEDNILISANGFAADGEALVKRFKNSQMWYHFNHNKKLTIKSAARNIQHLLYGKRMFPYYVHTIIAGLDEEGKGAVYSFDPVGSYEREQCRAGGSAASLIMPFLDNQVNLKNQYEPDSNGTKRKEVKYLGVEEVIKLVRDAFTSATERHINVGDGLEILIVTKDGVRKEYFDLKRD

SEQ ID NO: 22641 - protein, 139 aa, Coccidioides immitis RS
MPKTDQDVGTGLVGAPACGDVMKLQIRVDKNSNTISDVKFKTFGCGSAIASSSYLTELVRGMTLEEAAKIRNTEIAKELCLPPVKLHCSMLAEDAIKSAISNYYTKNPKAAPTNLSGTESTVPRVESRPTPSPGSEASS

SEQ ID NO: 22642 - protein, 460 aa, Idiomarina loihiensis L2TR
MSNQITTINPSNGEQLKSYTKMDLAEVTQIIEESHAAFLQWRLESLEQRAKSVKAIGKALQEHKEEFADLMVKEMGKLPEQARQEIDLCVGICDYTAEHGPEELADEERKPGNGQRGIVTYSPIGIVYGIQPWNFPAYQVVRYSIANIMAGNTVLLKHAENVTGSGLLLEKIYREAGLPENVFRTLVISHETSDEVIAHSLVRGVTLTGSDGAGRKVATQAAKHLKKTVLELGSNDAYLVLDDADLDVAVDTCVMGRVFNTGQTCVAAKRFVVTEANYEAFKERYVEKMKALKVGDPTQSDTDVGPMARVDLRDQLHKQVEESVSKGARILCGGEKPEGKGAFYPVTVLENVEPGQPAYDDELFGPVAALIRAKDDEDAMRIANDSRYGLGGGIISKDVQRATELASKYFDTGMVFINGFGVATPEMPFGGVKDSGYGREHGGFGMHEFVNVKAINVVKE

SEQ ID NO: 22643 - protein, 278 aa, Coccidioides immitis RS
MNYKTPLEYFLYGAMIYIGLKRWGKARHFLDIVISTPTSSFASMIMVEAYKKWILVNLLEKGMVPAMPHTVNGSVAKAYKALAKPYSALALVFKIGPFLRLKAEVSAGIEIWRRDNNTGLVFQLLDSFCRFSVLKLERSFAALSLPDVARLSLSDGDGWPMELFVAELLATKRLDARLFQKSHPSTPTILRFGYNYHATRGANEAGLWDCLMEQKHRMDVLLRCVHGTDVKLELGREYIEGLRTSKWRKNGGDNEGGILMGENHSAVEFEEDIMADLR

SEQ ID NO: 22644 - protein, 327 aa, Zea mays
  misc_feature (153)..(153): Xaa can be any naturally occurring amino acid
  misc_feature (177)..(177): Xaa can be any naturally occurring amino acid
MVGGERRRGAAAKEVKLNTRNVFAALESLKKKKKGDKGRAAGPSSRKKHGARAAQQQQEPPQKDVFWAPAPLTTKSWADVEDDDDDDYFATTAPPRPVWAAAAAAEPAKEEEDVEDAVRAALQEDVESDDEDLDDEDLDDGAEHEVEDAPAEXAVKTVEALAAPPKDTERQLSKKEXKKRKLAELDAVLAELGLSGNSTSAAQDAEKEGANQAGDAEKKEDATVPSESKPSKKKKKKDKSSKEGRKETQEAAEGSEETASAGPDEEDTTAVDVKERLKKMASMKKKRSSKETDTGAKIAAAEATARSARLAAAKKKEKSHYNQQPVR

SEQ ID NO: 22645 - protein, 92 aa, Arabidopsis thaliana
MASQQEKKQLDERAKKAETVVPGGTGGKSFEAQQHLAEGRSRGGQTRKEQLGTEGYQQMGRKGGLSTGDKPGGEHAEEEGVEIDESKFRTKT

SEQ ID NO: 22646 - protein, 506 aa, Roseovarius nubinhibens ISM
MNEMTQAETGFASPFKVRYDNYIGGKFTAPVNGRYFDNVTPITGAKVCEVARSDAADVELALDAAHAAKESWGAMAAAERSTLLLKLADKIEANLELIATAETWDNGKPIRETMAADIPLAVDHFRYFAGVLRGQEGAMSQIDNDTVAYHFHEPLGVVAQIIPWNFSILMAAWKLAPALAAGNCVVLKPAEQTPAAIMVLTEIIGEMLPPGVLNIVNGYGAEVGAALGQSKRIAKIAFTGSTQTGRQIMQYATENLIPVTLELGGKSPNIFFSDVMAKDDAFLDKAVEGFVLFAFNQGEVCTCPSRALIQEDIYEEFIARAIERVKAIKQGDPRLPDTMVGAQASAQQQEKILSYFQIGVEEGAEVLTGGAAAPMEGDLSGGYYIQPTILKGHNKMRVFQEEIFGPVVSVTTFKDADEALALANDTMYGLGAGVWSRDANTCYRFGRAIEAGRVWVNNYHAYPAHAAFGGYKQSGIGRENHKMMLEHYQQTKNMLVSYNPNKLGFF

SEQ ID NO: 22647 - protein, 124 aa, Glycine max
MSMAKKPVKYSLVDAFTESVFKGSPAAVFFLEEKRDKKWLQGVAAEFNLSVTCYLTRITESHGTTSYPRFDLRWFTPVSEVVVTSGRVVEELQPQLDAIVKCPGRGLIVTGIAPPGSEFDFCSR

SEQ ID NO: 22648 - protein, 150 aa, Oryza sativa
VTAMSGYNLTLREDATQNRLKESLELFKNLWNNRWLKNISTILFLNKLDLLTEKITAGRSKLEDTFPEFARYQTPVDIVQKVPNEPPEVTRAKYFIRDEFLKISAQTSDNNRHYCYPHFTCAVDTENIRRVFNDCRDIIQRMHLMQYELL

SEQ ID NO: 22649 - protein, 294 aa, Roseovarius nubinhibens ISM
MKTLFKFLRPSVNDQHRGRLTKDGIRIHEAEDFAGMHAAGRLAAEILDEVAENVFVGQSTAAIDKLIEDRVEAAGAKSATIGYRGYQHASCISVNHVVCHGIPGDKIRKWKNDTSKRDDDTLIDGDIINVDVTVIVDGWYGDTSRMFVAGKPKPYAEKLIQVTHDALMIGIEAVKPGNTFGDIGHAIQTYVEAQRMSVVRDFCGHGLGRVFHAPPNVLHYGRPGTQAVLEEGMFFTIEPMVNLGRPETKVLSDEWTAITRDKSLSAQFEHSIGVTANGCEIFTLSPKGKFHPTS

SEQ ID NO: 22650 - protein, 341 aa, Populus trichocarpa x Populus deltoides
MDHAADAHRTDLMTITRFVLNEQSKYPESRGDFSILLNHIVLGCKFVCSVVNKAGLAKIIGLAGETNVQGEEQKKLDVLSNEVFIKALVSSGRTCILVSEEDEEATFVEPSRRGRYCVVFDPLDGSSNIDCGVSIGTIFGIYMVKDDHEPTLDDVLQPGKNMLAAGYCMYGSSCTFVLSTGTGVNGFTLDPSLGEFILTHPDIKIPKKGKIYSVNEGNVRNWDGPTAKYVEKCKFPQDGSSAKSLRYIGSMVADVHRTLLYGGIFLYPADKKSPNGKLRVLYEVFPMSFLMEQAGGQAFTGKQRALDLLPTKIHERSPIFLGSYDEVEEIKALYAAEEKKA

SEQ ID NO: 22651 - protein, 92 aa, Arabidopsis thaliana
  misc_feature (22)..(22): Xaa can be any naturally occurring amino acid
  misc_feature (47)..(47): Xaa can be any naturally occurring amino acid
  misc_feature (63)..(63): Xaa can be any naturally occurring amino acid
  misc_feature (66)..(66): Xaa can be any naturally occurring amino acid
  misc_feature (68)..(69): Xaa can be any naturally occurring amino acid
  misc_feature (79)..(79): Xaa can be any naturally occurring amino acid
  misc_feature (86)..(86): Xaa can be any naturally occurring amino acid
MASSMLSSAAVVTSPAQATMVXPFTGLKSSAAFPVNRKTNKDITFIXSNGGRVSCMKVWPPIXKKXFXXLSYLLTLVRXIWLGSCXPFRNKW

SEQ ID NO: 22652 - protein, 467 aa, Oryza sativa Japonica Group
MAAATAAPSIDEAKAKSVLRQVEFYFSDSNLPRDKFLRETVEQREDGLVSLALICSFARMKSHLGLDAAVKPETVPEETVLAVAEVLRRSQMLRISEDGKMVGRASELLKADEIIKQVDSRTVAASPLPYNVKLEDVQSFFAQYAKVNSVRLPRHISNKKHFCGTALVEFSEEDEAKIVLENNLFFAGANLEIKLKKEFDAETESKKEAYEKAHPKKDEQNEGYPKGLIVAFKLKRITVDGGVQQNCADNDTATEEETPKSMKKTSTGESEERTTVNSDMEEQKSSDDMTEAKEVNAGEATESGDKCTVDALLESEKKGDNETSIKDDRGLSGKANSPISREDLKEAFKKFGTVRYVDFSIGDESGYLRFEDSKAAEKARMSAVLADEGGLIVKDHIVTLEPVTGEAEKDYWNTIRGIQGKYKDNRSYKGRTGKSYRGGKQFNGKRGRHSDSSEKGANKTQKVEAAA

SEQ ID NO: 22653 - protein, 297 aa, Debaryomyces hansenii CBS767
MRDTRIFKQVDVFTNRKFKGNPVAVFFDADDLNSDEMQAIAKWTNLSETTFVLKTTNKDADYKLRIFTPKNELPFAGHPTIGSCFALIESGLIQPKSGKLIQECGAGLVEILVGGDVSIPKNLILSFRLPYFHITPIDTSVHLELESALKISSGFCSKIASPVLLDVGPKWLTIQLVEGIDVINLEPNYTEIARLSNFYGWTGIEVFGKHEDGTYESRSFAPVIGVNEDPACGSGAGALGVYLSLISAKDTKSADIKQGCKIARDAKLHVSIDKLNDKPSISVGGQAVTCIIGNYEP

SEQ ID NO: 22654 - protein, 430 aa, Xylella fastidiosa
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 22655 - protein, 477 aa, Bacillus cereus ATCC 10987
MASIYKFYLNGEWRESSSGETIEILSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGIDMVSFTGGTNTGKHLAKKAAMITLVLELGGKDPGIVREDADLQDAANHIVSGAFSYSGQRCTAIKRVLVHENVADELVSLLQEQVAKLSVGSPEQDSTIVPLIDDKSADFVQGLVDDAVEKGATIVIGNKRERNLIYPTLIDHVTEDMTVAWEEPFGPILPIIRVSSDEQAIEIANKSEFGLQASVFTKDINKAFAIANKIETGSVQINGRTERGPDHFPFIGVKGSGMGAQGIRKSLESMTREKVTVVNFK

SEQ ID NO: 22656 - protein, 468 aa, Burkholderia thailandensis E264
MQKGSAETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIALGIGNHGVPMGISNLWAHGGFFPNGAQGVLMSMQMVMFAYLGVEMIGLTAGEAENPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVAQMKFRASLAPAQERALRFRMPFWPYGSWVALTFLVLVVGLMAYFPDTRIALYVGPAWLVLLVVLYYALKLEPEGGKEAGLARGYERG

SEQ ID NO: 22657 - protein, 221 aa, Triticum aestivum
  misc_feature (140)..(140): Xaa can be any naturally occurring amino acid
MSAFVGKYADELIKTAKYIATPGKGILAADESTGTIGKRLASINVENVESNRQALREMLFTAPGALEYLSGVILFEETLYQTAADGTPFVDILKGRNVIPGIKVDKGTVDIAGTVGETTTQGLDSLGARCAKYYEAGARXFAKWRALLKIGAGAQALRNSPVEQKPPGAWPRYPPPLAQENGLGPPSGEPRNPPTDGARNRNLRAWARPPPRKGGPSAGRF

SEQ ID NO: 22658 - protein, 132 aa, Helicobacter pylori
SNIKYELDKESGALMVDRVLYGAQNYPANYGFVPNTLGSDGDPVDALVLSDVVFQAGSVVKARLVGVLNMEDESGMDEKLLALPIDKIDPTHSYVKDIDDLSKHTLDKIKHFFETYKDLEPNKWVKVKGFEN

SEQ ID NO: 22659 - protein, 438 aa, Solanum lycopersicum
MASSNCLHAILLCSLLFITSTIAQNQTSFRPKGLIIPVTKDASTLQYLTQIQQRTPLVPISLTLDLGGQFLWVDCDQGYVSSSYKPARCGSAQCSLGGASGCGECFSPPRPGCNNNTCGLLPDNTVTGTATSGELASDVVSVESSNGKNPGRSVSDKNFLFVCGATFLLQGLASGVKGMAGLGRTKISLPSQFSAEFSFPRKFALCLTSSSNSKGVVLFGDGPYFFLPNRQFSNNDFQYTPLFINPVSTASAFSSGQPSSEYFIGVKSIKINQKVVPINTTLLSIDNQGVGGTKISTVNPYTILETSLYNAITNFFVKELANVTRVAVVAPFRVCFDSRDIGSTRVGPAVPSIDLVLQNANVVWTIFGANSMVQVSENVLCLGVLDGGVNARTSIVIGGHTIEDNLLQFDHAASRLGFTSSILFRQTTCDNFNFTSID

SEQ ID NO: 22660 - protein, 180 aa, Haemophilus influenzae R2866
MKKLTLALVLGSALAVTGCFDKQEAKQKVEDTKQTVASVASETKDAAANTMTEVKEKAQQLSTDVKNKAAETVEDAKEVIKSATEAASEKATEIKEAVSEKASEMKEAASEKASEMKEAASEKVGEMKEAASEKATEIKEAVSEKASEMKEAASEKATEMKEAVSEKATQAVDSVKEATK

SEQ ID NO: 22661 - protein, 188 aa, Erythrobacter sp. SD-21
MGIIGSTIKPFNATAFQAGKDFFDVTDEDVKGKWAVFFFYPADFTFVCPTELEDLGEQYNMLQKMDVEVYAVSTDTHFSHKAWHDTSEKIGKLNFPFLGDQNHVLARNFDVLREGAGLADRATFVVDPDGVIQIMEQTCEGVGRNANELARKIKAAQYVRANPGQVCPAAWEEGSDTLAPSLDLVGKI

SEQ ID NO: 22662 - protein, 492 aa, Xanthomonas campestris pv. vesicatoria str. 85-10
MSRSFPLRQQWLGNVRGDVLAGIVVALALIPEAIAFSIIAGVDPKVGLYAAFCLAVVTSIAGGRPGMISAATGAMALLMVNVVKDHGVQYLLAATVLAGVLQLIAAALRLGALMRFVSRSVITGFVNALAILIFLAQLPELVGMPWPVYAVCAAALVIIYLLPRVTTAIPSPLVAIVVLTAACAYWHLDLRHVGDMGHLPESLPVFLLPDVPLTWDSLRILLPVSTTLAVVGLLESLMTAQIVEDLTDTPSQRNRECAGQGLANMVAGCFGGMAGCAMIGQSVINVRSGGRGRLSCLVAGVVLLLMVVYGAAWVRQIPMAALVAVMIMVSIGTFNWGSLRDLRRHPASSSVVMLGTVVVTVWTHDLARGVLAGVLLSALFFARKVGRMLQVQASDGDDGVRVYAVRGQVFFASAGQFVASFDFLGTPPKVLIDLRHAHFWDISAVAALDRVVFKLRAHGAEVEVAGANQASNALIDTLGTHRRDGARLQLGH

SEQ ID NO: 22663 - protein, 363 aa, Rhizomucor miehei
MVLKQRANYLGFLIVFFTAFLVEAVPIKRQSNSTVDSLPPLIPSRTSAPSSSPSTTDPEAPAMSRNGPLPSDVETKYGMALNATSYPDSVVQAMSIDGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALDLYQREEGLSSSNLFLYTQGQPRVGDPAFANYVVSTGIPYRRTVNERDIVPHLPPAAFGFLHAGEEYWITDNSPETVQVCTSDLETSDCSNSIVPFTSVLDHLSYFGINTGLCT

SEQ ID NO: 22664 - protein, 476 aa, Burkholderia thailandensis E264
MNIHPVILCGGSGTRLWPMSRGGYPKQYLKLAGNTTLVQQTALRVRDVEGVGAPIVVTNNEQRFLVAEQLRQVGITPSSIVLEPMGRNTAPAIAIAALLALRESPDALLLVLPSDHVIDNETAFVDVVKTAASVASDAHLVTFGVTPTQAHTGYGYIRRGEAFAGDTRVYRVDAFVEKPDAPAAERFIADGGYYWNSGMFMLKASTYLDELRRHAPDIANQAELALGAAKRDHDFLRLDPEAFGASPNVSIDYAVMEKTERAAVVAAANLGWNDIGSWSALADIAATDARRNALIGDVYTDAVENSYIRAEHRMVAALGLDNIVIVETADAVLVAHRDRAQDVKKVVEWLNASGRRESVTHRRVIRPWGAYEGIDQGERFQVKRIVVDPGAQLSLQMHHHRAEHWIVVKGTALVTNDGKEIILTENQSTYIPLGTTHRLKNPGKIPLELIEVQSGSYLGEDDIVRFEDTYGRTSAT

SEQ ID NO: 22665 - protein, 254 aa, Legionella pneumophila subsp. pneumophila str. Philadelphia 1
MGVTIKTPDEIEKMRVAGRLAAEVLEMIGPYVQVGITTDELNTICHDYIVNVQKAIPAPLNYNGFPKSICTSINHVVCHGIPGKKTLKDGDIINIDVTVIKNEYHGDTSKMFIVGTPSVKAKHVVQIAHECLYIGIDMVKPGVQLGDIGHAIQQHAEKNRCSVVRDYCGHGIGRVFHEDPQVLHYGVPGTGMKLEPGMTFTIEPMVNIGKHHTRLLPDHWTVVTKDHSLSAQWEHTLLVTDTGVEILTLRNEER

SEQ ID NO: 22666 - protein, 283 aa, Bacillus cereus ATCC 10987
MIRVGYLGPEATFTNMAVSRFFPEAEHVPYRTIPDCMDAAANGNVDYAVVPLENAIEGSVNITIDYLVHEQPLSIVGEITVPIQQHLLVHPQYAEVWEEVYAVHSHPHAIAQCHKFLNEELKGITARDMTSTSAAAQYVKEHPEEKIAAIANEAAAEKYGLTIVRRSIHTHKNNHTRFLVLHKKKKAILSNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 22667 - protein, 90 aa, Actinidia deliciosa
TLTRPELNLLLTFITSKNIHLISDEIYSGTVFSSPDFVSIMEFLKDSSHSTEVWNRVHIVYSLSKDLGLPGFRVGAIYSNDDVVLAAAKK

SEQ ID NO: 22668 - protein, 718 aa, Zea mays
RGRGRGPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 22669 - protein, 300 aa, Burkholderia xenovorans LB400
MAYKTIEDTIGNTPLVQLVRLPDDEIRSRNNVILAKLEGNNPAGSVKDRPALSMIKKAEARGRIKPGDTLIESTSGNTGIALAMAAAIRGYKMVLIMPEDLSVERRQSMAAYGAQIVLTPVTGGMEYARDLAEQMQREGKGIILDQFANPDNPAAHVEGTGPEIWRDTEGRITHFVSSMGTTGTIMGVSTYLKEQNQAIEIIGAQPEEGSRIPGIRKWPEAYLPKIFDRSRVDRVENVSQAAAEAMARRMASVEGIFAGISSGGACEVALRVARQVENATIVFIVCDRGDRYLSTGVFPA

SEQ ID NO: 22670 - protein, 288 aa, Rhodobacter sphaeroides
MAFEQRIEAAMAAAIARGQGSEAPSKLATALDYAVTPGGARIRPTLLLSVATACGDDRPVLSDAAAVALELIHCASLVHDDLPCFDDAEIRRGKPTVHRAYSEPLAILTGDSLIVMGFEVLARAAADQPQRALQLVTALAVRTGMPMGICAGQGWESESQINLSAYHRAKTGALFIAATQMGAIAAGYEAEPWEELGARIGEAFQVADDLRDALCDAETLGKPAGQDEIHARPNAVREYGVEGAAKRLKDILGGAIASIPSCPGEAMLAEMVRRYAEKIVPAQVAARV

SEQ ID NO: 22671 - protein, 631 aa, Streptomyces sp. CL190
MTILENIRQPRDLKALPEEQLHELSEEIRQFLVHAVTRTGGHLGPNLGVVELTIALHRVFESPVDRILWDTGHQSYVHKLLTGRQDFSKLRGKGGLSGYPSREESEHDVIENSHASTALGWADGLAKARRVQGEKGHVVAVIGGRALTGGMAWEALNNIAAAKDQPLIIVVNDNERSYAPTIGGLANHLATLRTTDGYEKVLAWGKDVLLRTPIVGHPLYEALHGAKKGFKDAFAPQGMFEDLGLKYVGPIDGHDIGAVESALRRAKRFHGPVLVHCLTVKGRGYEPALAHEEDHFHTVGVMDPLTCEPLSPTDGPSWTSVFGDEIVRIGAEREDIVAITAAMLHPVGLARFADRFPDRVWDVGIAEQHAAVSAAGLATGGLHPVVAVYATFLNRAFDQLLMDVALHRCGVTFVLDRAGVTGVDGASHNGMWDMSVLQVVPGLRIAAPRDADHVRAQLREAVAVDDAPTLIRFPKESVGPRIPALDRVGGLDVLHRDERPEVLLVAVGVMAQVCLQTAELLRARGIGCTVVDPRWVKPVDPVLPPLAAEHRLVAVVEDNSRAAGVGSAVALALGDADVDVPVRRFGIPEQFLAHARRGEVLADIGLTPVEIAGRIGASLPVREEPAEEQPA

SEQ ID NO: 22672 - protein, 379 aa, Rhodobacter sphaeroides
MSALRPPARGGLGLSRLGVRLAGSRRFQLIAERVPFLRRIGRREGEELFDIVAGFVHSQVLYALVELRVLHLVAEGPQTVQALAAATGLAPERMQFLLQGGAALKLLKPRRQRQFHLGGPGAAFLAVPGVQAMWGHHHVLYRDLADPVAFLKGETEPELARFWPYVFGAGGATDPEVTAKYSRLMTESQGLVAEDALRLVDLMGVRRLMDVGGGTGAFLAAVGRAYPLMELMLFDLPVVAEAAPQRLTEAGLAGRFTVHGGSFRDDPLPLGADAISLVRVLFDHSDETVKLLLHRVREALPAGGRVIVAEAMSGGARPHRETDTYMAFYTAAMRTGRVRSAAEIAELLTGQGFSEIKIFPGLRPYVASAVTAVRPSDAP

SEQ ID NO: 22673 - protein, 222 aa, Francisella tularensis subsp. holarctica
MIDKEFIQKSYTSIMQNIDSKVRLLAVSKYQSIDKIEYLAGLGQLDFGENYFQELEQKAQKLPHLRWHFIGSLQSRKIKHIVKYASSIQSVENIEHLEKIDKAAGQIAKIVDVFLQINIDDDINKSGFESTQLEEVVASIMKAKSFMNLKIVGLMCIPAKTNAPEKSFAKMKHFFDTVNFRLNDDLKLSRLSMGMSADYRLAIQYGSTDVRVGSSLFGARAT

SEQ ID NO: 22674 - protein, 668 aa, Staphylococcus aureus subsp. aureus MW2
MVINLNDKQTKTSKEGLISVSHPLAAKIGKDVLDQGGNAMDAVIAIQLALNVVEPFASGIGGGGYLLYYEQSTGSITAFDARETAPAHVDKQFYLDDSGEYKSFFDMTTHGKTVAVPAIPKLFDYIHKRYAKLSLEDLINPAIELAIEGHAANWATEKYSRQQHARLTKYYETAQVFTHENQYWREGDWIVQPELGKTFQILREQGFNAFYKGDIAKQLVNVVKACGGTITLEDLAKYDIQIKAPISATFKDYDIYSMGPSSSGGITVIQILKLLEHVDLPSMGPRSVDYLHHLIQAMHLAYSDRAQYLADDNFHEVPVQSLIDDNYLKARSTLIDSNKANIDIEHGVVSDCISHTDVEENHTETTHFCVIDKEGNIASFTTSIGMIYGSGITIPGYGVLLNTTMDGFDVVDGGINEIAPYKRPLSNMAPTIVMYHGKPILTVGAPGAISIIASVAQTLINVLVFGMDIQQAIDEPRVYSSHPNRIEWEPQFSQSTILALIARGHAMEHKPDAYIGDVHGLHVDLNTRDASGGADDTREGTVMGGEVLSIRKQPLLSPEIYDNDTHRVYFNDVQLPLLADQVRWMHDKYWVDESVVRIIFSEVSAHIEDLRSYENAGENYIDIAWLARKKGYQVALKDDGLYLTDDTYTSVKRNTNAYYRYDRDSITR

SEQ ID NO: 22675 - protein, 467 aa, Burkholderia xenovorans LB400
MKITIIGTGYVGLVTGACLAEIGHDVFCLDVDPRKIEILNNGGVPIHEPGLQEMIARTRAARRITFSTDVEAGVAHGDVQFIAVGTPPDEDGSADLQYVLEAARNIGRTMNGFKVIVDKSTVPVGTAQRVRAVVEEELAKRGLAGSAQHGFSVVSNPEFLKEGAAVDDFMRPDRIVIGLDEDEAGSRARELMKRLYAPFNRNHERTLYMDVRSAEFTKYAANAMLATRISFMNEMSNLADRVGADIEAVRRGIGSDPRIGYHFLYAGCGYGGSCFPKDVQALIRTASESGHNLRILEAVEEVNDRQKDVLVHKITSKLGNDLSGRTFAVWGLAFKPNTDDMREAPSRRLIAELLARGAHVRAYDPVAVTEARRVFAIDLHDAPEQFARLTFATTQDETLTGADALVIVTEWKEFKSPDFVHLKSVLKSPLIFDGRNLYEPDAMTELGIDYHSIGRPYAQPSELPADV

SEQ ID NO: 22676 - protein, 388 aa, Mycobacterium avium subsp. paratuberculosis K-10
MSDERVKPFLVPDLGEGLEEVTVTHWNVAVGDDVELNQVLCTVETAKAEVELPSPYAGRIVEMNGAEGDVLKVGAVLVRLDTAPESGEPPAAETAPTLVGYGADAGIDTSRRTGRPLAAPPVRKLAKELMVDLGSLRPRSGAVITREDVLSAAHGTGNGAEVRPVQGVQARMADKMTLSHKEIPAATVSVQVDCTALVRLSERLGPAEQRITPFVLTLRLLVIALRRNEIMNSTWVDTPQGPQVRIEHRVHLGVAVATERGLLVPVIADAHTKTTRELASRAAELISGARAGSLTPGELRGSTFTVSNFGALGVDDGVPVINHPEAAILGMGAIKPRPVAIGTEVVVRPTMSLSAVFDHRIADGAQAARFVCELRDLIESPETALLDL

SEQ ID NO: 22677 - protein, 1358 aa, Oryza sativa Indica Group
MEFYAYSMLLILPLILYMSYHLTRTLAEKKPTTHGLKAHPLLGHLPAFVKNSHRFLDWSTELIAGSPEMRIGLWIPGMRSGIVTGNPADVEHILRTNFANYPKGQHAIGMLEDFLGHGLFNSDGEQWLWQRKNASYEFSKRSLRKFVVDVVQAEVANRLLPLLRRAAGDGVGGDAVVLDLQDVLQRFGFDTICMVAFGHDPRCLADGGVLEEAKSEFMRNFGEALDLVIGRFMDPIEVSWKIKKWLNIGTERRLKKAIADVHAFAMDIVRARRQSASVKDRDDVLSRFVASDEYSDEVLRDIVLSFLVAGRETTSSGLTWFFWLLSSRPDVVARIADEVRAVRKATGTRPGEPFGFDALREMHYLHAALTESMRLYPPVPTDPQSCAADDTLPDGTFVRAGWFVNYSAYAMGRLAAIWGEDCMEYRPERWLGDDGAFQPASPFRFTVFHAGPRMCLGKEMAYVQMKSIVANVIEELVVDVVKEVAGGGVPEHVFSISLRMKGGLPVKIRRKGHMRGTVRPSIQAAAPGPRWLRLAATLRPISPATAAVRYPLFPLACGHQVSAVTMAKEVDRFVELVVVRHGETSWNSSRIVQGQMDPELNEIGKQQAVVVARRLARKARPAAIYSSDLKRAAETVKIIAKVCDVSNLVLIEALRERHMGYLPGLTWDDAMNKSPGVFKGFANFEVKNGLDFDGRNHEFPDGGESLNQLSERCISYLNKVAQNHIGERVIVVGHGAAILELYRHTDPPNSSIRRKIPNTSLNIFRISDVTGRWILERCGDVGHLSENGFLENAFGGQERLCCFKARSLAALLPSPLSDAHLAAAVSSLPDPDLAVALLSWSQSPDHHVALQDPTPLAHSTLLRLLARSRRFDAVDDTLHSMSLAGAAPTRACLGALVAAYADAGMLGKATEMCERVREQYGSLLEVTHCNHLLKLLVEQRRWDDGRKLYDEMLGKDSGADNYSTCVLVRGLCLERRVEEGLKLIEARWGAGCIPHVVFYNVLIDGYCRRGDMGRGLLLLGEMETKGFLPTLVTYGSLINWLGKKGDLEKIGSLFLEMRKRGFSPNVQIYNSVIDALCNCRSATQAMVILKQMFASGCDPDIITFNTLMTGLCHEGHVRKAEHFLREAIRRELNPNQLSYTPLIHGFCMRGELMVASDLLVEMMGRGHTPDVVTFGALIHGLVVAGKVSEALIVREKMTERQVFPDVNIYNVLISGLCKKRMLPAAKNILEEMLEKNVQPDEFVYATLIDGFIRSENLGDARKIFEFMEHKGVCPDIVSCNAMIKGYCQFGMMSEAILCMSNMRKVGCIPDEFTYTTVISGYAKQGNLNGALRWLCDMIKRKCKPNVVTYSSLINGYCR

SEQ ID NO: 22678 - protein, 428 aa, Pyrococcus abyssi [sequence omitted]

SEQ ID NO: 22679 - protein, 195 aa, Vogesella indigofera
MALTQLFVHPLKSCRGNALQRAEVTPQGLRDDRVWLASRADGQFISARSHPRLVQVGVTQQADGQWCFTAPGMPPLLTSPADYRQRVPATVWKSAFSALHGDAAADAWLSHYLGEPLQLLWLGESTRVQKTTADRLSFADGYPYLLLSEASLLDLNSRLAQPVTMRHFRPNLVVDDTFAFEEDEWRRFRIGAVEF

SEQ ID NO: 22680 - protein, 294 aa, Synechococcus sp. CC9311
MLQLPPGVQQAPPRFDPSVPIALGVIGLGRMAQALVIPLIEQELISADEVIAVVGREHSVATVSARVPSGVKVIAASDSAAEHAWAASVQLLAVKPQMLDGVAASAPPPIETPASGSSLLLSVLAGVPLARLQALFPGRICVRAVPNTPCLVGQGLTGLAWGDGISDPQKQQVRSFFEPVSEVLELPEERLDAFLALTSSGPAYVALIAEAMADGAVAMGMPRSQAHHLAHRTLAGTAALLQEQELHPGELKDMVASPGGTTMAALRHLEKSGLRSALIEAIVAATQHGRGMAN

SEQ ID NO: 22681 - protein, 508 aa, Zea mays
MAALPVHPFLLLPLVAVISFLWLRLAALSRRGSGPRLPPSPWALPLIGHLHHFAGALPHRAMRDLAARHGPVMLLRLGGLPVVVASSADAAREVMKTRDLEFATRPVTRMVRLAVPEGAEGIIFAPYDDRWRQIRKICTVELLSARRVQSFRPVREEEVWRLVRSVAAAAPSARAVNLSELLAVYAADSSVRATIGSRFKDRDTFLSMLQRGLELFANMSLPDFYPASRLALLVSRMPGRMKRHRQEVVAFMDAMVQEHAESRVPDGDDDKEDFLDVLLRIQREGDLQIPLTTDNIKSVVGDMFAGGSETPATALQWIMAELMRNPRVMKKAQDEVRQAVAAAGRQRVTEDDLSNLRYMHLVIKEGLRLHPPLPLLLPRECRSSCQVQGFDVPAGTIVFVNAWAIARDPSHWDRPEEFVPERFESSSVDFKGTDFDYLPFGAGRRMCPGMAFGLVSMELALASLLYHFDWELPPGMTAADVDMTEKMGVTARRLHHLLLVPSARVPVT

SEQ ID NO: 22682 - protein, 159 aa, Brassica napus
MEPPKDQHTPEKSSTDPPSSAYPPSGCCTNCGGPTISEPSPLASLPEMSPPPNYRPIRAPAINLPHNSQAIILSPVPHAERVPVVSPPYQFERPVKRIHSPDDIRRFQESPSFKNFLGFVVSLSESIRGHKISDPCLVSPTVAAVVSILETLLQWIDEI

SEQ ID NO: 22683 - protein, 347 aa, Halobacterium sp. NRC-1
MRAAVYQGPGEIAVEEVPKPDIESPEDAVIRVTHTAVCGSDLWFYRGDSDREAGSRVGHEPMGIVEEVGDDVTSVAPGDRVIAPFAISCGECEFCRQGLYTSCVEDESWGSEANGGGQGEYVKCPFADGTLVRVPDRYADDEDVLESLLPLTDVMGTGHHAAVSAGVGEGDTAVVVGDGAVGLCGVLAAQRLGAERIIAMGHHEDRLELAAEFGATDTISARGDDAIERARDLTHGGANHVMECVGAASAMDSAIAIARPGGTVGYVGVPYGVEDGGLDVFTMFSDNITIRGGVAPVRAYAEELMADVLQGTLDPSPIFTKTVDLDGVPEGYAAMDDREAIKVLVKA

SEQ ID NO: 22684 - protein, 251 aa, Lactobacillus plantarum WCFS1
MFNFTDKVVIVTGARTGIGLSAATLFAKAGAHVILAGHHEPKDEAQQLVDHGYSAVSFKCNVADPKNVAGMVKFAVAQFGHLDYAYNDAGIQSPVTDTADLSVEEYDHVMDTNLKGMFLSMKYELRQMRAQGTPAAIVNCSSMGGLVGIADRTAYHASKHGVLGLTKSSALEYADRNVRINAVCPGIIDTPMVARMDDTERQEMDDLVREIPMGRLAKPEEVAQVVLFLCSDAASYMVGQAVAVDGGYTIH

SEQ ID NO: 22685 - protein, 405 aa, Thermus thermophilus HB8
MALVVQKYGGTSVGDLERIHKVAQRIAHYREKGHRLAVVVSAMGHTTDELIALAKRVNPRPPFRELDLLTTTGEQVSVALLSMQLWAMGIPAKGFVQHQIGITTDGRYGDARILEVNPARIREALEQGFVAVIAGFMGTTPEGEITTLGRGGSDTTAVAIAAALGAKECEIYTDTEGVYTTDPHLIPEARKLSVIGYDQMLEMAALGARVLHPRAVYYAKRYGVVLHVRSSFSYNPGTLVKEVAMEMDKAVTGVALDLDHAQIGLIGIPDQPGIAAKVFQALAERGIAVDMIIQGVPGHDPSRQQMAFTVKKDFAQEALEALEPVLAEIGGEAILRPDIAKVSIVGVGLASTPEVPAKMFQAVASTGANIEMIATSEVRISVIIPAEYAEAALRAVHQAFELDKA

SEQ ID NO: 22686 - protein, 532 aa, Synechococcus sp. CC9311
MSFPDFSAIDSQTQWQRFCDLLWYHDDLGLWLDVSRMHLNSSALETLTPRLEQAFKAMEDLEGGAIANADEQRQVGHYWLRQPQLAPDQQVGASISAEIDAIDEFGKSILAGSIQAPNGQPFTDVLWIGIGGSALGPLLMVRALQDHQVGLPFHFFDNVDPNGMSRVLAGLGDRLRTTLVITVSKSGGTPEPHLGMEQARHRLEAHGGSWAKQAVVVTMAGSKLDQQAEKENWLQRFDMFDWIGGRTSITSAVGLLPGALIGCDIRGFLAGAAQMDEATRCPDVRRNPSALMAAAWYAAGEGKGKRDMVVLPYRDRLEVFSRYLQQLVMESLGKHLDRDGKEVHQGIAVYGNKGSTDQHAYVQQLRDGIDNFFVTFIEVLRDVDDIPSIEGERPGDFLDGFLQGTRSALTEGGRQSLSISMRSFDARRLGALIALFERAVGLYGELVNVNAYHQPGVEAGKKAAAAILNLQKQVEEVLSDGVSRSAVEIQKAIGSGTDEAIFWILRHLTGNNRGYVAQGSWDHPASMRFSKG

SEQ ID NO: 22687 - protein, 248 aa, Xanthomonas campestris pv. vesicatoria str. 85-10
MAVSGQLLAQVFDALDRLPLEGRSTLELNGFVERMIVDELDARPASKGQYGFEFVLNASIDDVVCHGVPSADDVLRSGQIVNLDITLEKNGYIADSSTTYLVGEVAYPARRLVQATYQAMWKGIAAVRPGARLGDIGHAIARHARAHGYSVVKEYCGHGIGREMHEDPQILHYGHAGTGLELQEGMVFTIEPMINQGRAAIRSQPDQWPVHTRDGRLSAQFEHTVAVTRTGVRVLTLRPAEVPLCVVE

SEQ ID NO: 22688 - protein, 122 aa, Zea mays
MAAKLAQLRTQVTRAAEFASKHGCSYYKEVMEKNKQYVVQPPTVEKCQELSKQLFYTRLASLPGRYESFWKELDCVKQVWKNRKDLTVEDLGIASLFGVELYAWFCVGEIVGRGFTLTGYKV

SEQ ID NO: 22689 - protein, 391 aa, Thermus thermophilus HB8
MPLTGVARQGRWVLNLHEYQAKEILARYGVPVPPGKVAYTPEEAKRIAEEFGKRVVIKAQVHVGGRGKAGGVKLADTPQEAYEKAQAILGMNIKGLTVKKVLVAEAVDIAKEYYAGLILDRAKKRVVLMLSKEGGVDIEEVAAERPEAIHKFWIDPHKGFRPFEAREMVKRAGLEGNLNKLAQVLVALYRAYEGVDASIAEINPLVVTTDGGIVAADAKIVLDDNALFRHPDLAELREVEAEHPLEVEASNYGFAYVKLDGNIGIIGNGAGLVMYTLDLVNRVGGKPANFLDIGGGAKADVVYNALKVVLKDPDVKGVFINIFGGITRADEVAKGVIRALEEGLLTKPVVMRVAGTAEEEAKKLLEGKPVYMYPTSIEAAKVIVAMVGGAA

SEQ ID NO: 22690 - protein, 253 aa, Triticum aestivum
PRVRALITTSGLLYTFGDGTFGALGHGNRETISYPKEVESLKGLRTISVSCGVWHSAAVVEVIMTQSNASSGKLFTWGDGDKYRLGHGDRASKLKPTCVSSLIDYNFHKSACGHTLTIGLTTSGHMFTVGSSVYGQLGNPNNDGRYARLVEDKVGGGGVVEVACGSYHVAVLTNAGEVYTWGKGANGRLGHGDIADRKVPTLVEALRDRSVKRIACGSGFTAAICQHKWVSGMEQSQCSACRQPFGFTRKRHN

SEQ ID NO: 22691 - protein, 260 aa, Xanthomonas campestris pv. vesicatoria str. 85-10
MHVQDLANIHPTKHAGKIALVTGGSSGIGLAAAKRLALEGATVVISGRRQQELDRAVAEIGHGATAVRADISVGTELDAVMDVITTVHGRLDLLLANAGGGEFAPIESITEAGFDKYFNINVKGTLLTVQKALPLMRAGSAIVVTGSIAANQGVANFGVYAATKAALRSFVRTWASELKGRDIRVNLIAPGVVVTPAYKSELGMSDEDIDAYLAEIQLKAPLGRAASPDEMAKAMSFLASDDASYITGIELTVDGGLTQI

SEQ ID NO: 22692 - protein, 525 aa, Legionella pneumophila subsp. pneumophila str. Philadelphia 1
MNDLKKSPLLILDFGSQYTQLIARRVREMGVYCEIYPYHINHEQFKKLNPCGVILSGGPSTVTHDANPRAPQWLFDSGLPLLGICYGMQTMAVQLGGQVHSSALREFGYAELRLHGHSQLLNNIEDRILADGSALLDVWMSHGDKVTELPPGFKIICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTEIKWLAQGTIYPDVIESAATSTNDAAVVIKSHHNVGGLPDTLNLKLLEPIRELFKDEVRQVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 22693 - protein, 185 aa, Synechococcus sp. RS9917
MSGSAAPTSLSTVQKVLLLACALVLAGLLFLLRGGLTAESPLDQLARRSLLPEQALTSGRPTLLEFYADWCEVCREMAPAMLANEQRYRDQLNVVLVNVDNPRWQDLIDRYDVNGIPQLNLFDAEGQPRGRSLGRRSQTELEALSEALIDNSPLPQLAGVGDTTPLTPATVATPAPSGVGPRSHG

SEQ ID NO: 22694 - protein, 538 aa, Arabidopsis thaliana
MADEKNGGRLSDASDYSSEDEGTEDYRRGGYHTVRVGDTFKNGSYVIQSKLGWGHFSTVWLAWDTLNSRYVALKIQKSAQHYTEAAMDEIKILKQIAEGDAEDKKCVVKLLDHFKHAGPNGQHVCMVFEYLGDNLLSVIKYSDYRGVPLHMVKEICFHILVGLDYLHRELSIIHTDIKPENILLCSTIDPEADARKSGIPLVLPTVKDKAVPERPVEKEKPKSYTYSADLTKNQKKKIRKKAKKVEGSEENERDSSNSEARPNGNATVERLEESSERVKDAENVSQKGRGNRRGSQSTRQKLLADVDRKCKLVDFGNACWTYKQFTSDIQTRQYRCPEVVLGSKYSTSADMWSFACICFELATGDVLFDPHSGENFERDEDHLALMMELLGMMPRKIALGGRHSRDFFNRQGELRHVRRLRFWPLSKVLTDKYDFSEEDAIAMQDFITPILQFVPEKRPTAAQCLTHPWLNPVPKSLKPSSSPQNPKEEEEEASDEDKDKEKVEREAMEAGVGNIAIDGSERKTSAREGRQSARDLRT

SEQ ID NO: 22695 - protein, 621 aa, Zymomonas mobilis
MLSFSAITVRLGGQLILDQATASLPPGSHVGLIGRNGAGKSTLMKVVAGLLEADSGELSMPRGTRIGYIAQEAPEGSATPYETVLAADEERSRLMEASETESDLEKLAEIHERLNTIDAYTAPQGAARILAGLGFDETMQHQPLSAFSGGWRMRVALGALLFSAPDLLLLDEPSNHLDLEAVLWLENFLRGYRGTLLLISHERDFLNKVADHILHLQQGKLTLYPGGYDAFERQRAERLSQLESARNRQLAEREKLQSFVNRWRTKAHSARQAQSRMKALERMEPIAAAVEDPSLSFSFPSPDDNLKPPLITLDQAAVGYDDKPILTKLNLRIDPDDRIAFIGRNGNGKTTLAKLIVGQLPTVDGQMVTSSKIKVGYFTQYQVEELDVDDSPLDHMTRLMPGASTTAVRSQLGRFGFSGDKATQKVGSMSGGERARLALALITRDAPHLLILDEPTNHLDVDVRQALIEALADYQGAVIIVSHDRHMLELTADRLILVDNGKATDFDGDLNDYTNFILGKSDKPTSEAPVKAQDKKADKRARAEKRQQNKALRDEIKKLEGEISKLTSCRSEIDQALFDPDQASPKDKKLTVTQLMKSRADIEDELNKKEAIWLEKSEMLE

SEQ ID NO: 22696 - protein, 281 aa, Aspergillus oryzae
MKNFFSMHAILLACSAGAGLAAITQGISEGTYSRIVEMATISQAAYANLCNIPPAITSAGKIYNAETDINGWVLRDDSRQEIITVFRGTGSDTNLQLDTNYTQAPFDTLPQCSGCAVHGGYYVGWVSVKDQVEGLIHQQASQYPDYSLVVTGHSLGASMAAITAAQLSATYNNITVYTFGEPRTGNQAYASYVDETFQATNPDATKFYRVTHTNDGIPNLPPTSQGYVHHGTEYWSVEPHGPQNMYLCLGDEVQCCEAQGGQGVNDAHVTYFGMASGACTW

SEQ ID NO: 22697 - protein, 218 aa, Populus trichocarpa x Populus deltoides
MSCPHISGVAALLKAAHPTWSPSAIKSALMTTAYVSDNTNSPLQDAAGGALSNPWAHGSGHVDPQKALSPGLVYDISADEYVAFLCSLDYTIEHVQAIVKRPNITCSRKFNNPGNLNYPSFSVVFTNNRVVRYTRELTNVGAAGSIYEVAVTGPQAVQVTVKPSKLVFKNVGDKLRYTVTFVARKGASLTGRSEFGAIVWRNAQHQVRSPVAFSWTQL

SEQ ID NO: 22698 - protein, 434 aa, Streptococcus intermedius
MSIITDVYAREVLDSRGNPTLEVEVYTESGAFGRGMVPSGASTGEHEAVELRDGDKSRYGGLGTQKAVDNVNNIIAEAVIGYDVRDQQAIDRAMIALDGTPNKGKLGANAILGVSIAVARAAADYLEIPLYSYLGGFNTKVLPTPMMNIINGGSHSDAPIAFQEFMIVPAGAPTFKEALRWGAEIFHALKKILKSRGLATAVGDEGGFAPRFDGTEDGVETILAAIEAAGYVPGKDVFLGFDCASSEFYDKERKVYDYTKFEGEGAAVRTADEQIDYLEELVNKYPIITIEDGMDENDWDGWKKLTERLGKKVQPVGDDFFVTNTSYLEKGINEACANSILIKVNQIGTLTETFDAIEMAKEAGYTAVVSHRSGETEDSTIADIAVAANAGQIKTGSLSRTDRIAKYNQLLRIEDQLGEVAEYRGLKSFYNLSK

SEQ ID NO: 22699 - protein, 333 aa, Legionella pneumophila subsp. pneumophila str. Philadelphia 1
MHSYLKKDLILHYIQINNPGPHSELTLVEGPNPGFNESQILVRVKATALNRADLMQKYGKYPPPPGESDIPGLEVAGEVIVTGSKVKQFKPGDKIYGLVGSGGYAEICPVDASLAHHIPSHWNYSLAAALPEALTTVYATLYDLGALSAGQTLLIHGAGSGIASLAIQMAKLTNTKVITTVGDSSKIEKALALGADQVIHYKEQDFELLIEDNSVDLIIDFVGGDYFNKHLHLLKPQGKLIQIACLKGSKVECSLALLMQKRLHIIGFVLRSQSIKEKARLWKLAHDHWFNAFENDKIKPVIDSELDLNQIETALQRMQQGSHFGKIVIRVGK

SEQ ID NO: 22700 - protein, 271 aa, Yersinia pseudotuberculosis IP 32953
MNDHKKRSDLEKRPDLEKQSYPEKQSLSGKRALVTGAGQGIGAAIAEGLAATGAEVICTDISRERAAATAQALNAKGYNVRAEELDVTDSAAIDALAAALPPLDVLVCNAGIVTHTPAEEMTDADWDKVIAVNLTGVFRTCRGFGRRMLEAGRGSIINIGSISGQIVNVPQPQCHYNASKAGVHHLTKSLAVEWATRGVRVNAVAPTYIETPLIQGLTSQPGRVSRWLDMTPMGRLGSPHEIASVVQFLASEASSLLTGSIITADAGYTSI

SEQ ID NO: 22701 - protein, 189 aa, Populus trichocarpa x Populus deltoides
MASSVISSAAVATVNRTPAQANMVAPFNGLKSTSAFPVTRKANNDITSIASNGGRVQCMQVWPPTGLKKFETLSYLPDLTTEQLAREIEYLLRNKWVPCLEFELEKGWVYREHHQSPGYYDGRYWTMWKLPMFGCTEASQVLIELEEAKKAYPNSFVRIIGFETRVKCSASVLSPPSRRVSRFQDLMSP

SEQ ID NO: 22702 - protein, 559 aa, Mycobacterium avium subsp. paratuberculosis K-10
MVFSTTELIRINSKLRPPDGKEAAAAMDKVMAAPAKADPVSFADEHRRLVGELNAKLAAAALGGNERARERHVSRGKLLPRERVDRLLDPGSPFLELSPLAADGMYDDESPGAGIITGIGRVSERECVIVANDATVKGGTYYPMTVKKHLRAQEVALQNRLPCIYLVDSGGAFLPRQDEVFPDREHFGRIFYNQATMSAKGIPQVAAVLGSCTAGGAYVPAMSDEAVIVREQGTIFLGGPPLVKAATGEVVSAEELGGGDLHSRISGVTDHLADDDEHALRIVRSIAATFGPREPSPWQVRTPVPPKAAQNELYDVVPPDPRVPYDVHEVIVRLVDGGEFSEFKANYGKTLVTGFAHIHGHPVGIVANNGVLFSESALKGAHFIELCDKRKVPLLFLQNIAGFMVGRDYEAGGIAKHGAKMVTAVACARVPKLTVVIGGSYGAGNYSMCGRAYSPRFLWLWPNARISVMGGEQAASVLATVRGEQLTAAGKPWSAEEEEAFKAPIRAQYEDQGNPYYSTARLWDDGIIDPADTRTFVGLALSVCAQAPLEPVGYGVFRM

SEQ ID NO: 22703 - protein, 498 aa, Yersinia pseudotuberculosis IP 32953
MSEYHEKNNALFKSITALDGALFINGEFRKGAGGRLPVENPATGKVIGHLAAATPEEIEEAVAAARRAFPAWAAERPKARANALHRLGDLIAADALNMARIMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVAACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYIYARDLAAIHRLSAALDYGNVAINNVDASMMNAPYGGRKQSGVGYEHGREGLLEYFNFKHIRLYHGIGD

SEQ ID NO: 22704 - protein, 848 aa, uncultured delta proteobacterium
MIDLFTLDNGLRVVTLADHLTPIVSIQVWFGYGSANETDRESGLSHLIEHMIFKGTHNRKNSEIAGAVESLGGDINAFTSFDHTVYYINISGRHFVKAMEILADAVQNAIFDQVDLEREKMVVIEEIRRGMDMPETRLMQSLFKTAFKNHPYGRPILGLEEHIHSFKREDILAYMDKWHNPLNTVISIAGNFNPEQAKETIAELFGMWNKKSAYIRAEQGEPLTLSPRIKILDFNSRQSMLAIGFPSIRSGDLDVAALDCISFILSADDSSRLQIKLKEGKKLLQKAEIQIFTPRDPGLIILKIFISENNIRELIPNLRYEIENLRQHPVSEEELKTAKYNLRAGMLRGRKTIDDQAGRLGFFLLELQEVNFEKSYLKKLEELNIEDIQKAAQKYLAPEHVSISLIMPMGYDNPITSEEFVDLWEKTLPISPNFIHKNKSLTQKTVLKNGITILTKINKRVPLFSICALFKGGQLTEQPWEQGISSFTAQLMTKGTKKNNPVAFLRDISSISAEFSSFSGRNTIGVNGEFLSGDWRKALDIIADILLEPAFDEKEINKLIPFYLSDIKYQKEHLGPYTIQLLYKHLFKGHPYSFNQLGAEETIGILKQEDVIAYYKKIAHPENLAIAVTGDIIHEEIIKRFDRLFSNFTGGDFNTFPYPTSARLEKNINIYKQRDITQSHIAIGYHSAPLDNPDRHAINIISSAFNGQGGRLFPLRDKHGVAYTVNAFSMAGVGTGSFIFYIACAPESTDMSIDFLYREIKNMIKNGLSQKELERAKEYFIGNYEMSLETNGSKSMQMAINELYGLGYDFSKTFINHIKSVSVDDVLETAKKYFDVPGHVRVVVGKNT

SEQ ID NO: 22705 - protein, 581 aa, Streptomyces coelicolor A3(2)
MSLLVVGLSHRSAPVSVLERASLNADAQLKLLQDTVAAEPAAEAAVLATCNRIELYADVDKFHAGVAELSTLLAQHSGVGLEELTPYLYVHYEDRAVHHLFSVACGLDSMVVGEGQILGQIKDSLARAQDLHTAGRLLNDLFQQALRVGKRAHSETGIDRAGQSLVTFGLEQLSAGADVEQWARGKKALVIGAGSMSSLAAATLARAGVAEIVVANRTFERAERLALLLEEQYGQRLSEGDDTDVLARAVPMDAVPGELTRADVAVSCTGATGLVLTADSVAATVEGRTGAPAVEDTAVQETAVREAGETPLPGAGSAADENCPLDLSSVSSVPSGFSVMGEAAVAGMDAATLEQHGAWAAGGTAVDRTREAGRSGPEADAELIGALAATATRVGRIPERRRPEPVAEAPRPQPVLFLLDLAMPRDVDAAVHRLAGVRLVDIESLADASADAPMAADVDMVRRIVADEVAAFGAAQRAAHITPTVVALRSMAADVVAGEIARLEGRLPGLDDKHRAEITQTVKRVVDKLLHAPTVRVKQLAAEPGGAGYADALRTLFDLDQETVASVSRAENSTEKNRGPA

SEQ ID NO: 22706 - protein, 111 aa, Zea mays
MMLRATGRRLLGVGGGDPAPAVAAAVAASRSRGYHERVVDHYNNPRNVGSLDKDDADVGTGIVGAPACGDVMKLQIRVDEGSGRIVDARFKTFGCGSAIASSSVGAQWSSH

SEQ ID NO: 22707 - protein, 147 aa, Francisella tularensis subsp. holarctica
MRKLAIVVSEFNSLITDKMLEGALEEAYAQGLKDSQICIKKVTGAVELPYAAKLLAETKEFDAIVLLGCVIRGETDHYDYVCDQVSYGTQKVMHQYNLPVIFGILTTHNKEQALERVGGKKGHKGKYSIQAAITMAKMKKDILEQGV

SEQ ID NO: 22708 - protein, 783 aa, Oryza sativa Indica Group
MPRRTDNAASANSVEPEKSEECLEFDDDDEEEVEEEEIEYEEIEEEIEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRTKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGGRYGGGGGSSGSSRPEERVSETRLYMRILPVSQSAESDGALYRQFTPVSHMDYEISGPESEVDSEVWLGWVAQRRRRRATAPYSGRRRVHEASDAGDDTAIRRSWQQVKEIPTSLDDFLPSIRTTCTHTHTCNPPGPSATEHTHTCYHTHTRVFSSDDDSCGGDKAKPKKSRKPLGNREAVRKYRQKKKAHTAHLEEEVKRLRVINQQLVKRLQGQAALEVEVVRLRSLLVDVRSRINGALGSCPIQAQCGVDNVLGCDGMAQCFAGKPELGVRQSCAPSTVNCHISSDSGQNLVVPHALSPSDVIGSFMVSSTSKDE

SEQ ID NO: 22709 - protein, 360 aa, Burkholderia xenovorans LB400
MDDELNTRLKPLRERIDALDAQLIALLNQRAAVALEVGEVKKHFNAPVFRPEREQQVIARLQDMSEGPLASEHISAIWREIMAASRALEKTIKAAYLGPVGTYSEQAMHEYFGQSIEGLPCSSIDEVFRSVEAGAAEFGVVPVENSTEGAVSRTLDLLLQTQLTIGGELALPIHHNLLTLNGGLTGVTRVCAHAQALAQCQRWLSTNAPHLERQAVSSNAEAARMAAEDPTVAAIAGDRAATHYGLQVAYALIQDDPHNRTRFVMIGKQPAGPSGYDQTSLIVSVHNEPGAVFKLLEPLARHSVSMTRFESRPARVGTWEYYFYIDLEGHRDDPAVAAALAELGEKAAFLKILGSYPRAR

SEQ ID NO: 22710 - protein, 403 aa, Francisella tularensis subsp. holarctica
MFEQIKNNVENAIEALKQGKPVVVLDDYDRENEGDLILPGQKATEENITFMLEHTSGIICLAMDSKKARELNLTPMVAADQNNSTFTTPFTVTIEAKEGVTTGVSAKDRAHTIQVASKADAKAEELARPGHIFPLIANDKGVLGRNGHTEATVDLMKLSGFNSAGVLCELMNKDGTMMKAAELEAFAKKHDLPLLTIAELYQYRLATEIFVTKMASSTIPFKKIGELEMSVYKDNFSGDEVVVLSKPYSGNNPLVRMHSSCITGDIFGSLRCDCQDQLHKGIEMISEEGGFFIYLDQEGRGIGLTNKLKAYNLQMNENMDTLEANLALGLPADARKYDLAIQVLKYNNVNRCRLISNNPEKLAALRNVDIETQPVYCEAFVNSHNRNYLITKKIKAKHTIKGI

SEQ ID NO: 22711 - protein, 428 aa, Pseudomonas syringae pv. phaseolicola 1448A
MAKIVDIKGREVLDSRGNPTVEADVVLDNGIVGSACAPSGASTGSREALELRDGDKSRYMGKGVLKAVANINGPIRDLLLGKDPVDQKALDHAMIKLDGTENKASLGANAILAVSLAAAKAAAQDQDLPLYAHIANLNGTPGVYSMPVPMMNIINGGEHADNNIDIQEFMIQPVGAKTFAEGLRWGTEIFHHLKAVLKARGLNTAVGDEGGFAPNLASNKEALDAIAEAVANAGYTLGTDVTLALDCAASEFYKNGKYKLSEEGEYSSAEFAEYLAELTRKHPIISIEDGLDESDWDGWKVLTDKIGEKVQLVGDDLFVTNTKILKEGIDKKIANSILIKFNQIGSLTETLEAIQMAKAAGYTAIISHRSGETEDSTIADLAVGTSAGQIKTGSLCRSDRVSKYNQLLRIEEQLGSKAAYRGRAEFRG

SEQ ID NO: 22712 - protein, 105 aa, Rhodobacter sphaeroides
MTNPTPRPETPLLDRVCCPADMKALSDAELERLADEVRSEVISVVAETGGHLGSSLGVVELTVALHAVFNTPTDKLVWDVGHQVLPPQDPHRPARADAHPAPEGR

SEQ ID NO: 22713 - protein, 209 aa, Neisseria gonorrhoeae
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKELIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 22714 - protein, 142 aa, Brassica napus
  misc_feature (41)..(41): Xaa can be any naturally occurring amino acid
MEQTFIMIKPDGVQRGLVGEIICRFEKKGFTLKAVLIVGMXGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDG

SEQ ID NO: 22715 - protein, 355 aa, Synechococcus sp. CC9311
MSLSAYSKELIATANALAESGKGILAVDESTKTIGKRLGGIQVENTEANRQAYRGMLFTTAGLGDFISGAILYEETLFQSHADGETMVQKLNKAGIIPGIKVDKGLCPLPGAKSVETVCTGLDGLVERAADYYAQGARFAKWRAVLQITADGCPSDLAIRENAWGLARYARSVQESGLVPIIEPEILMDGDHSIEVTAAVQEQILKEVYFACQLNGVLLEGTLLKPSMTIQGADCAHKSDPQIVAEMTVRTLERCVPASVPGIVFLSGGLSEEAASVYLNNMNKISRKAQWNLGFSYGRALQHSCLKAWAGKDQVAGQAALLARAKANSEASQARYVPGSQPSSDEQLFVAGYTY

SEQ ID NO: 22716 - protein, 371 aa, Oryza sativa Indica Group
MSTTAKLLALAVFAAAAILSLDSRSDVRQLEIRDGDVELIPLLNGAAGPESIVFGDAGEGPYTSVSDGRVLKWLPPPERRWVEHSCSVPELLDSCRGSKDTKREQECGRPLGLKFNSKTGELYVADAYLGLRVVSPGENVSRPLVPKWTESPFSFSNGVEIDHETGVIYFTETSTRFQRREFLNIVITGDNTGRLLKYDPKENKVEVLVDGLCFPNGLAMSNDGSYLLLAETTTGKILRYWIKTPKASTIEEVVQLPGFPDNIKMSPRGGFWVGLHAKRGKIAEWSISYPWLRKVILKLPAQRIQRITSFLTGFGRQVIALRLSEDGKTIEAMSVHGDVRKLFKSISEVEEKNGNLWIGSVLSPFLGLYRI

SEQ ID NO: 22717 - protein, 349 aa, Vitis vinifera
MDPHQHQPIGQADETSPPPSNTATTSCRCCGGPTTCPPPPAWSDISPPPPYRPIRAPAINLPPSNSQQAIILAPNFLGFVVSLSESIRSHKISDPCHQSPILNSILSILQSLIDWVDEIPPVQQSSRYGNLSFRVWQSRLFDNSEQLMLQFLPDDLRSATVELVPYFADSFGNSSRIDYGTGHETNFAAWLYCLARLGLLKEEDYQALVSRVFVKYLELMRKLQFVYCLEPAGSHGVWGLDDYHFLPFIFGSSQLIDHKYMKPKSIHNQDILDNFSKEYMYISCIAFVKQVKKGLFAGHSPLLDDISGVANWNKVNSGMLKMYKAEVLEKVPIMQHFLFGWLIKWYDHC

SEQ ID NO: 22718 - protein, 824 aa, Salinibacter ruber DSM 13855
MFGTSAHASSGHRSSSFLSSVVPPSPMPNATTPSRTASAIRWFETLDNEDISLVGGKNASLGEMIGALKDSGIRVPDGFATTADTYRRFLEANDLTEHIRAELDAWNAGEQSLNETGTTIRTRIRQGAFPEDVAEEIREGYRSLSAAYGADAADVAVRSSATAEDLPDASFAGQQESYLDVRGVTAVLTACKRCFASLFTDRALGYREKQGFDHLDVALSVGIQKMVRADKSGVLFTIDTETGFPDTSVINAAYGLGESVVKGIVNPDQYTVYTPFVEDETLSPILEKTQGDQAQKIVSTGEGGTTTMPTTEDEQSGFVLSDEEILALTRWGKIIEEHYDRPMDVEWARDRDSGDLFVVQARPETVQSQQAAGTLRTYRLTEEASPLVTGVGIGTSIVSGTTRVLDSVDEAERFEDGDILVTEMTDPDWGPILERAGGVVTNRGGRTSHAAIVSRELGIPAVIGSETATEALRDDQTVTLSCAHSDAGQVYEGELDYESEEIDLDALPDPDTRVMLNLASPSAALDWWKLPVEGVGLARMEYVINNIIKVHPLALVAFDEVEDKTAQRRIEKLTEGYDDKGEYFVDHLSRGIATIAAAQHPHPVIVRLSDFKTNEYADLIGGGGFEPEEANPMLGWRGASRYYSDAYEKGFALECRALKRVRDEMGFTNVVAMVPFCRTPEEADRVLDVMADHGLKRGTNGLEVYVMAEIPANIALADKFAERFDGFSIGTNDLTQLTLGVGRDAERLTHLFDERNAAVKRRIAELIEDAHAAGRPVGICGQAPSDYPEFAEFLVEAGIDSISVTPDSVPNVLRHVAQAEARAA

SEQ ID NO: 22719 - protein, 481 aa, Corynebacterium efficiens YS-314
MTTALTEQNAQQAATAGRVVRVIGAVVDVEFPRGELPALYNALTAEVTLESVAKTVVLEVAQHLGDNLIRTIAMAPTDGMVRGATVTDTGKPISVPVGDVVKGHVFNALGDCLDVPGLGRDGEQWGIHREPPSFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPSIVGERHYEVSQRVIGILQKNKELQDIIAILGMDELSEEDKITVARARRLERFLGQNFFVAEKFTGLPGSYVPLADTIDAFERICNGDFDHYPEQAFNGLGGLDDVEAAYKKLTGK

SEQ ID NO: 22720 - protein, 373 aa, Lactobacillus plantarum WCFS1
MKIKAAVVDKVNDPFVIKDDIELAEMKATDLQIKMVATGICHSDEAIRRGDASLGYPVILGHEGSGIVEKVGSEVTNFEVGDHVILSFYADGTCDNCLKGMPTKCRNYADYNLSGTRPDGSDHFQENGHHISDMFDQSSFTTHTVVDQRNAVKVPKELDLRRLGPLGCGYVTGSGTVLNSLQPRPGQTIAVFGTGAVGLAAMMAGKISGCTEVIAVDIVDSRLELAKELGATHAINSKEEDPVEAIKKLTHGYGVDFAVDTTGVEPVMVSAIHALAQGGTAALIAVTAKNITISSWNDLCVDDKKVIGVNMGDAIPGVDIPRLIDFYQHGMFPFEKTEKFYKFEDINQANADSGSGKTIKPVLIIDEDYQPGK

SEQ ID NO: 22721 - protein, 320 aa, Erythrobacter sp. SD-21
MSEFGFESTADEVLADKDLKGRTALITGGYSGLGQETARAMAAKGAHIILSGRDATKLSATADELATATGAKVDTLVCDLASLDSVRKAGKEANDRFEKIDLLINNAGVMACDEAKTEDGFEMQFGTNHLGHFLLTNLLMPLVEKGERPRIVNLSSRGHHIAPVDFDDPNFENRAYDKWVSYGQSKTANVLFAVGLEERLTDKGIHAYALHPGGIHTNLGRHMSEEDVANLMARIQKAAEERGEEPQPFKTIPQGAATTCWVATTDELEGAGGLYCEDCHVANEDNEDTGGGVRSYAVDKENADRLWTISEEMVGQTFAY

SEQ ID NO: 22722 - protein, 297 aa, Erythrobacter sp. SD-21
MRTFAKPAVDMVDTMRRAAAADPARAIAFGGAPGSNSHQAAMQFDPECLPLPYLGFEDALDAVKSGKAGCAMIPIENSQHGRVSDIHFLLPESGLAIVAEHFMRITHALMATGPGPFEAAYSHPQALGQSREFLQQRGIVALAHADTAGAAAYIAELRDPKFCAIAPPMAAELYGLDIVEEAVEDAADNTTRFVVLAKEQRDPALIEAATKMTTFIFEVKNVPAALYKALGCFATNGVNMTKLESYQKGASFAATRFYADIEGAPGDPGVDSALEELVFQTNDVRLLGSYAQARKRG

SEQ ID NO: 22723 - protein, 388 aa, Arabidopsis thaliana
MKTIQEQLPNDLVEEILCRVPATSLRRLRSTCKAWNRLFKGDRILASKHFEKSAKQFRSLSLRNDYRIFPISFNLHGNSPSLELKSELIDPHSKNSAAPFEISRVIHCEGLLLCSSQLDESRVVVWNPLTGETRWIRTGDFRQKGRSFDVGYYYQKDKRSWIKSYKLLCYYRGTKYFEIYDFDSDSWRILDDIIAPRGSIGYSELSVSLKGNTYWFAKGVTEERPRTISLLKFDFYTEKSVPVLLPYQSRRLFQASSLSVVREDKLSVLLQLDQSSKTEIWVTNVIDETTKGAVSWTKVLALDLSPHLQIGNDGSFFLGEDKKVVMFCEKLIDENKVKDMVYIVGEDNVVTEVGFGVDEMDGCRAVILNYVPSLVQIERAGGNRKRGH

SEQ ID NO: 22724 - protein, 282 aa, Zymomonas mobilis
MMSPISIPSIRLNDGNDLPAVGFGTYKLNGSAGVSDIVSAIKVGYRLLDSAFNYENEGAVGEVFREAGIARDKLRIVSKLPGRHHHFEEAIATVEESLYRAQLDYYDLYLIHWPNPSKDLYVEAWQALIEARKKGLIRSIGVCNFLPEHLERLIKETGVTPVVNQVELHPYFPQEEQRAWDKAHGIVTESWSPLGRASKLLQDDTIKKIADRLGKSIPQVILRWHVQLGAIPIPKASSKERQIENLSLFDFELSPQDVEIIATLARPDGRLADQDPARYEEF

SEQ ID NO: 22725 - protein, 380 aa, Aspergillus oryzae
MSAEQNVANTEAEKDVQNVLAELKGEAETNGAEKKEEPSTEDAEEARIVAAAAQLGEKSAKAEEDKERENRGRGPRRNNAKFDPSSQKETDDPVEIRKQVEFYFSDSNLPMDKFLLSKVGGSQNRAVPLELLHSFKRMRRFQPFSAIVEALKTSEVLDLVDNETAVRRKTPLPENVTEAHDPNVVKVFEDKAMDRSIYAKGFGEEGPTTQLEIEEFFAPHGPVNAIRLRRANDKTFKGSVFVEFESEEKQKAFLALAPKPQWKGQDLIIKSKREYCDEKVRDIEAGRIKPSGHRPRGRGGFRGRGRGRQNDNRDWRERRAEDQKRGFNGDKKEESKEPREIQKDARGVPVVQSTADAGQKRARENEANGDHPAKKVDAKE

SEQ ID NO: 22726 - protein, 293 aa, Beta vulgaris
MPGGEVSAPSSVVLPTAESIENDEAWVWGQIKAEARRDADSEPALASYLYSTILSHSSLERSLSFHLGNKLCSSTLLSTLLYDLFLNIFSSDSSLRVAVVADLRAARVRDPACVSFSHCLLNYKGFLACQAHRVAHRLWNQERQPLALALHSRISDVFAVDIHPAARIGKAILFDHATGVVIGETAVIGDNCSILHHVTLGGTGKAVGDRHPKVGDGVLIGAGATILGNIKIGDGAKIGAGSVVLIDVPPRATAVGNPARLLGGKEKPSRNVDVPGESMDHTSFISEWSDYII

SEQ ID NO: 22727 - protein, 419 aa, Bacillus cereus ATCC 14579
MIEIKVPELAESITEGTISQWLINVGDKVEKGGSVVELETDKVNVEIIAEDSGIVSKLLGEPGDTVEVGATIAILDANGAPVAVSTPAPAAEQPKQETAETPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMSAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 22728 - protein, 326 aa, Zea mays
MASPIPREWVGLQQFPAATQTKLHELLGKLKEEDVSTLTILVMGKGGVGKSSTVNSIVGERVASVSAFQSEGLRPMMCSRTRAGFTLNIIDTPGLIEGGYINEQAVDIIKRFLLGKTIDVLLYVDRLDAYRMDTLDEQVIRAITNSFGKDIWRRSLVVLTHAQLSPPDGIDYNDFFTRRSEALLRYIHSGAGINKREYGDFPLPIALVENSGRCKTNEHGEKILPDGTLWVPNLMKEITVVISNGSSPTHVDQKLIDGPNPNNRRKLFIPLILAVEYFLVVKGIRRAIHADIANGKVDDWEQRYRDLVGSRDLVEQKGSTSRNRKA

SEQ ID NO: 22729 - protein, 453 aa, Rhizobium leguminosarum bv. viciae 3841
MKSFDAIVIGAGQAGPFLAARMVEKGMKVALIERKFLGGTCVNAGCMPTKTLVASARAAHVARNSAAYGVNIPGEIAIDMTVVRARAETVTMNARNGLIGWFAGMDGMTVIYGHARFEGPKTVSVNGETLTAPRIFLNVGARPVIPELSGVNDIDYLTSTSIIHLDTLPRHLVVIGGSYIGLEFAQMYRRFGAEVSVIEHGPKLASREDEDISDAIADVLRSEGIDIHTGVSDIAFAKSSDGITVATDSARIDASHVLIATGRKPNTDDLGLDAAGVITDGRGFITVDDRLATNVDGIWALGDCNGHGAFTHTSYNDFEIAAANLLDGDDRKVSSRIPAYALYIDPPLGRVGMTEKQARASGRKIMISTRPMSRVGRANERGETKGFMKVIADAETKKILGAAILGIEGDEVIHGIIDAMNAGTTYPALQWSVPIHPTVSELIPTLLGDLKPV

SEQ ID NO: 22730 - protein, 270 aa, Glycine max
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQLAYPLLKASEKGSIVFISSVAGVVSLGTGAVFAASKAAINQLTKNLACDWAKDNIRSNCVVPLATRTPVVEHLFKDQKFVDDIMSRTPIKRIAEPEEVSSLVNFLCLPAASFITGQVICVDGGLTVNGFQPSMRIT

SEQ ID NO: 22731 - protein, 115 aa, Oryza sativa Indica Group
MAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINR

SEQ ID NO: 22732 - protein, 318 aa, Burkholderia thailandensis E264
MSSHDGLMVFTGNANPALAQEVVKILGIPLGKAMVSRFSDGEIQVEIQENVRGKDVFVLQSTCAPTNDNLMELMIMVDALKRASAGRITAAIPYFGYARQDRRPRSARVAISAKVIANMLEIAGVERIITMDLHADQIQGFFDIPVDNIYATPILLGDLRKQSYPDLLVVSPDVGGVVRARALAKQLNCDLAIIDKRRPKANVAEVMNIIGEVEGRTCVIMDDMVDTAGTLCKAAQVLKERGAKQVFAYATHPVLSGGAADRIAASALDELVVTDTIPLSAESLACAKIRALSSAGLLAETFSRIRRGDSVMSLFAES

SEQ ID NO: 22733 - protein, 284 aa, Streptomyces coelicolor A3(2)
MTPDHAHTPEGTEPMTQKVAVLGTGKIGEALLSGMIGAGWAPADLLVTARRRERADELRARHGVTPVTNAEAAKAADTLILTVKPQDMGTLLDELAPHVPADRLVISGAAGVPTSFFEERLAPGTPVVRVMTNTPALVDEAMSVISAGTHATAAHLTHTEEIFGAVGKTLRVPESQQDACTALSGSGPAYFFYLVEAMTDAGILLGLPRDKAHDLIVQSAIGAAKMLRDSGEHPVKLRENVTSPAGTTINAIRELENHGVRAALIAALEAARDRSRELATGTKD

SEQ ID NO: 22734 - protein, 522 aa, Oryza sativa Japonica Group
MDKAMAFIPPRDLVVVLPFLALLLPLYIYLRYSRSAKANPSLPTEWPLVGMLPSLVANIHNLFDYATALLAASGNSFEARGPPMSSLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLAEDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 22735 - protein, 260 aa, Arabidopsis thaliana
MITTSSFNSQRIYTTMASSSSSSLSFSTSKKNKTFFKKPNSAFSSSRATSLIKRQQTVFKKAKELSILCDIDVCVICYGSNGELKTWPEEKVKAIARRYGELSETKRRKGSVDLHEFLEKMNKDDPEKEEKKKIKVRRVPKVKYPVWDPRFDNYSVEQLMGLVQSLERNLTRIQHRTCAVVEAQGQRRVQYTNMANQELMMANTMNQLQQHSNQVSMYLWNHGNGAFSQIPVSALASNQTQSLAPIPPELKGRIRLNLQD

SEQ ID NO: 22736 - protein, 370 aa, Synechococcus sp. CC9311
MAQLLITGGAGFIGSHTCLVLLEAGHQLLVLDDFSNSSAIALERVAELAGARLQRDQPTLRAAPETLTLVEGDIRDAQCLDALFTSTKTFDQPIEAVIHFAGLKAVGESVQQPLRYWDVNVVGSQRLLSAMDRHSCRTLVFSSSATLYGYPDQVPIPETAPIQPINPYGASKQAAEALFADIAGCSGKPEPIQASQGGWRIARLRYFNPVGAHPSGRIGEDPNGIPNNLFPFITQVAIGRRPELTVFGDDWPTPDGTGVRDYIHVMDLAEGHREALHSLLNTDPQLLTLNLGSGQGASVLDVVKAMEAASQRAIPYRIAPRRPGDAALTVANPTLAAQHLHWRTQRSLAEICRDGWAWQQANPQGYIRQT

SEQ ID NO: 22737 - protein, 484 aa, Silicibacter pomeroyi DSS-3
MKFQPEASHFINGAYVEDTAGAVIDVIYPATGEVIARLHSATPAIIDQALEAARQAQAQWAAMTGTERGRILRRAADIMRARNHDLSVIETHDTGKPIQETTVADATSGADALEYFGGLAGSLTGEHIPLGGGDFAYTVREALGVCVGIGAWNYPTQIACWKGAPALACGNTMVFKPSETTPLSALKVAEILIEAGAPKGIYNVVQGYGDVGASLVTDPRVAKVSLTGSVPTGRRVYAAAAESIKHVTMELGGKSPLVVFDDADIENAVSGAILGNFYSSGQVCSNGTRVFVQKGIKEAFLSRLAERLATAVIGDPMDPATNFGPMVSEAQMNIVLGYVDKGKAEGARLVYGGTRLDRDGFYLLPTVFADVTDDMTIAREEIFGPVMSVLDFDTEEEVLERANATEFGLAAGVFTRDITRAHRMVAGFEAGTCYINSYNLAPVEAPFGGSKQSGVGRENSKLAINHFSEMKTVFVSMNDIQAPY

SEQ ID NO: 22738 - protein, 553 aa, Thermus thermophilus HB8
MTALLLSLAYLVGALPLGYWLARRRGVDLRTASPYTLGLESALRRLGLGLLLLSFLLDFLKGYLPLLLGRALGLDLAGLLALGVAVYLGHLYPLFFRDPWPLRAKGAGVLLGILSGLPLPPALGLVPVALGLVLYALTGYASLAALGLPLGLLGATLFGGFGLAERLSALALFLLALWRYKENLGRVLEGTEPKLGDPLPLPSEKQVVCAFLIHPLTVEDFWQSPRFRWLRPLVRLGLLKQEWIERLAERFRPMKVGEVRGVRTADGREVLCHLISAPLLPHQIKAKPELAVRRAIQGARLAKELGATVVGLGAFWSVVGEKGKRVQEAVPGIEVTNGGAYTAGTVRAAIPKILAHFAQSGKDLKGATAAVVGANGVVAFGIARQIAPLVGRLILVGRDLERLKRAAESLRKNLERKGEAPEILATTEIAAIREADLVFTATSDPNPVIYPEHVKPGAWIYDEGVPPDVHPSVREVPGVRVTPGGVVRLPGEARATLDLHFGAPDQVPACLAETMILAAEEAFDRKSLGGEVRAENVQFFVERAEALGFRVVE

SEQ ID NO: 22739 - protein, 793 aa, Oryza sativa Japonica Group
MALLFVPFLFSLLITTFPPAATDTVTAGRPLAGGNKLVSGNGKFALGFFQMAGGNGSSSTAPKWYLGVWFNTVSKFTPAWVANRENPLADGGASWQLAISGDGNLVISNRANNNSMTAAAWSSQANTTTSNNTVAVLLNSGNLVLSDASNSSIIFWESFSHMTDTFLPGAKMGWNKATGFTHGLVSSKNSGDLSPGVYSATPSSDFANPGLFLAWNSSVVYWSTGPWNGDYFSNTPELTARALFTFDFVSNDHEEYFTYRLRNDTMVTRYVLAASGQAKNMIWSSVSEDWVTFYAKPGAQCDVYAVCGAFALCREDMLPFCNCMEGFSIRSPQDWELGDQTGGCVRNVPLNCGVTDRFYAMSDVRFPANAKNMEAGTADGCKQACLNDCSCTAYSYNGSCNVWSDGLFNVARQYNYNQSSSGGILYLRLAAEDDVSESSKHTRGLIIGVVAVASVLILSLFTIVIMFVRRNKRNCSSVGRIICGTVAFRYKDLQHATKNFSERLGGGSFGSVFKGVLTDSTVIAVKRLDGARQGEKEFRAEVRSIGIIQHINLVRLIGFCCEGSNRLLVYEYMPNGSLDSNLFGSKVASLDWSTRYKIALGVARGLAYMHGNCLDCIIHCDIKPQNILLDASFVPKIADFGMSKLMGRDFSQVLTTVRGTIGYLAPEWISGMAISSKVDVYSYGMVLLEIVFGRRNFRGECTSNATYFPVQVVGKLLQGNVQCLLDQNIQSDINSEEVERACRVACWCIQDDELNRPTMAQVVHILEGVLEVDMPPMPKLLQAISGNMDSTKT

SEQ ID NO: 22740 - protein, 377 aa, Xanthomonas campestris pv. vesicatoria str. 85-10
MSSPLPSPSAQAFGDPAAIRCERAASELRAGRPVLLTAADGQARAVLALDSSTAQSYAAFARAARGRHYLFVTPTRAQVLGLSAPQGARVGLLDHSYDQLAALAYLRDTPVPAQWTAGDALDAGGVEIARLGLLLPALLAVELRDVHDHAAFAGSQSLALDDLSRGCATSAAAGYELVTRTPVPLRGLGMSEFVVFRGGVAQRDQVAIVVGQPDLGTAVPVRVHSSCLTGDLFGSLKCDCGDQLRHGLAKLKDLGGGVLLYLDQEGRGTGIAAKMRAYGYQHAGLDTIDADAQLGFGPDERRYGSAVAMLRGLGISRIRLLTNNPAKAERLRAAGIVVEDRIAITGDITAENEQYLRTKAARAGHALDVDALILAAQ

SEQ ID NO: 22741 - protein, 157 aa, Haemophilus influenzae R2866
MKVLEGSVAAPNAKVAVAIARFNSFINESLLEGAIDALKRIGQVKDENITIVRAPGAYELPLVARRLAESKKFDAIVALGTVIRGGTAHFEYVAGEASSGLGKVAMDAEIPVAFGVLTTENIEQAIERAGTKAGNKGAEAALTALEMVNLIQQIDAA

SEQ ID NO: 22742 - protein, 165 aa, Lactobacillus plantarum
AVDLGAHPEFLGPNDIQLGKKESISDTAKVLGSMFDGIEFRGFKQSDVEILAKDSGRPVWNGLTDVWHPTQMLADFMTIKEHFGHLQDLTLAYVGDGRNNVANSLLVTGAILGVNITIISPESLQPALEIQKLARKYAMKSRSKISIRTDLNGLENCLGQYGWGS

SEQ ID NO: 22743 - protein, 361 aa, Roseovarius nubinhibens ISM
MPEIQAAVCHAFGEELRIETVHLRGPAAGEVMVDLDAVAICHSDISYADGIWGGSLPAVYGHEAAGRITAVGDHVTGLAPGDPVVVTLIRACGQCGTCATGTPTQCETPYDGDAGPLSMPDGSKLHQAMACGAFAEKVTVHHSQVVKLPESVPMDSAALIACGVITGIGAVVNAAHLRPGQDAVVIGAGGVGLNAIQGARIAGARRVVAVDLNADKLEVAREFGATDTVLASDPKPWRAAKTALGRGADAVLVTVGAIPAYDSAPRYLAPGGKIVMVGMPASGAVSSYEPVNFAAVGQSMIGSKMGDVVIRRDIPWMIDLYGQGRLKLDELISRRWRLDEINEAIADTRSGSAKRNVIMLK

SEQ ID NO: 22744 - protein, 364 aa, Shigella flexneri 2a str. 2457T
MKINRIVNEGFMKTMLAAYLLGNSTVDLREVAVPTPGINQVLIKMKSSGICGSDVHYIYHQHRATAAAPDKPLYQGFINGHEPCGQIVAMGQGCRHFKEGDRVLVYHISGCGFCPNCRRGFPISCTGKGKAAYGWQRDGGHAEYLLAEEKDLILLPDALSYEDGAFISCGVGTAYEGILRGEVSGSDNVLVVGLGPVGMMAMMLAKGRGAKRIIGVDMLPERLAMAKQLGGMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYVLMASGKCGKVVINFPD

SEQ ID NO: 22745 - protein, 239 aa, Arabidopsis thaliana
MARIRRRIQKRHIHENRYIDFFGERLIVTVTHTTSTIRRWIHSIRFFSRLRSSHPLVVGLDVQWTPGGSDPPPDILQLCVGNRCLIIQLSHCKRIPEVLRSFLEDETITFVGVWNSQDQGKLERFRHQLEIWRLLDIRHYLPTRLLNSSFEKIVEECLGYKGVRKDKEICMSNWGARSLSHDQIVQASDDVYVCCKLGVKECIWKERSNVKERIWKESSNVKEHIWKESSKLYFVGVCF

SEQ ID NO: 22746 - protein, 148 aa, Bacillus subtilis
MEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 22747 - protein, 261 aa, Legionella pneumophila subsp. pneumophila str. Philadelphia 1
MEPLLNIAVNAARQAGEIINRYVEQVDRLKITPKNSHEYFSEVDIKAEQVIINTIHKAYPEHGILAEESGIQQSDSDTVWIIDPLDGTSNYLHGFPFYSVSIALKIKNRLEHGVIYDPLRHECFAASRGRGARLNDRRIRVSKQTQLNASLLGTGFHFRDATLAQRYLPTFEALIGKCAGVRRTGSAALDLAYVASGRLDGFWEFGLRPWDIAAGALLVREAGGLISDVQGGEDFLNYGDVVAGTPKVFKSLLQTISPVLK

SEQ ID NO: 22748 - protein, 514 aa, Triticum aestivum
MLITHTTLLLSLIQQWELIFLALASVVSLLLLTRSRSRSSQKEMKLPPGPAPVPFLGNLHQLGRLPYRTLRDLARLHGPVMQLHLGKAPTVVLSSADAAWEGLKVHDLDCCTRPVSPGPKRLTYDLKNVAFAPFGSYWREIRKLLVVELLSGRRVKAAWYARQEQVEKLISTLSRAGGKPMALDEHILSLSDGIIGTVAFGNIYGSDKFTQNNNFQHALDEAAEVLSSSSAEDFFPKAIGWLIDRITGAFARRERIFKQLDAFFEMVIEQHLDPKRTKPENGGDLVDVLIAHWKEHRGTLKFTKDHVKALIFDTFIAGVDTSSVTILWAMSELMRSPRVLSKVQAEIRALVGGNDRVRSEDVSKLEYLKLVVKETLRLHPPAPLLVPRETMRHIQIGGYDVPAKTRIYVNAWAIGRDPASWPDNPEEFNPERFEANEIDFKGEHPQMLPFGTGRRICPGISMGMATVEFTLANMLCCFQWALPDGMVPQDVCMEEEGKINFHRKTPLVLVPTIR

SEQ ID NO: 22749 - protein, 324 aa, Zea mays
MADHGVRSHDDAKNQFGGNRELRSYDGRSEARDGALGTNHTQIVTGSTTRNLSFYDKILNDKEHGVTALLNLSICDENKATIVEAGAIRPLVHALKSAVSPAARENAACVLLRLSQLDGASTAAIGRAGAIPLLVSLVETGGARGKKDAATALYALCSGARENRQRAVETGAVRPLLDLMADPESGMVDKAAYVLHSLVSSSEGRAAAIEEGGIPVLVEMVEVGTSCQKEIATLSLLQIYEDNIVYRTMVAHEGAIPPLIALSQSSSARPKLKTKSLIEMLRQPRSPSLRTRPAAVVATRAHQVPRSPIPSTTPSGGIHFHWKK

SEQ ID NO: 22750 - protein, 433 aa, Burkholderia xenovorans LB400
MSTASHATSSSEESKVKTVFRVVSGNFLEMYDFMVYGYYASAIAKTYFPSGNEFASLMLSLSVFGAGFLMRPLGAIVLGAYIDHHGRRKGLILTLGLMALGTLTVAAIPGYATIGVLAPALVLFGRLLQGFSAGVELGGVSVYLSEIATKGNKGFYCAWQSGSQQVAVVFAALIGVFLNKLLPADQMGAWGWRVPFLIGCLIVPFLFLIRRSLQETEEFKARKHHPKMGEIMKTMAANWGIVLGGMGMVIMTTVSFYMITAYTPTFGKEVLKLSSIDTLVVTVCIGLSNLIWLPLAGALSDRVGRRPVLLAFTILTIITAYPALQWLVADPSFARLLAVELWLSFLYGSYNGAMVVALTEVMPVEVRTAGFSLAYSLATTIGGFTPAISTLLIHTTGNKAAPGLFLGVAAICGLIATLVLYRTPESRDQYRTA

SEQ ID NO: 22751 - protein, 1159 aa, Aspergillus oryzae
MATLNSLKEALGQKAVTTPSSSRQQLSDTQYSAGFDIFAGGPEYQDFIIPQLPQLLAPLFNSRLHVSVLEIGPGPKSVLGYLPHSLRKKVRRYAAFEPNELFATKVEKWLCTSLEAEFPLPCLASPPGIHRLPFVLNSNINSDASTSTNISDERFDLVLFCHSMYGMKPKDKFIEQALEMLVEAPQGGMVVVFHRDGTLSLNGLVCHRTACFPTGAIRVLDEDEVLDNFASFVAGFVMEDTEADKATRLEWRKVCRALGRREEAYPDHLLFSSPSVMAAFTQHATTLPELTAQVPLVKDKTVKNREAFHHGSASIVRPTEVQHVQQCVQWARKHEVGLTVVGGGHSGQCLWPNVVSVDMSAFDHIHILTAGKDGGESSSASVVIAGAGCKTGDIVRKTMAAGLTVPLGARPSVGAGLWLQGGIGHLARLYGLACDAIIGAVVVSVDSGEALCIGHVPSQHRPAGAVRPKNEYDLLWAIKGAGSNFGIVVSITFKAYVAPVHLIRSWVIPLSDSLEARRRLSDSDNLIASKLPRNCSADAYLYWEFGQLHLGITMFEASTTRLISDTSTPTPPPVDVDTILGLDGKIDVVDGIGLFDAEMYMSQMHGGHGGCKTSAFKRCVFLKNIGAVNVADILTTAVGTRPTPLCYLHLLHGGGAVSQVASGATAFGCRDWDYACVITGVWPRDQDGTEIAHAVERWVYNVARDLLPLSSGVYGADLGPDPRDAILAAKAFGPNRPRLARLKHCSDPHNVLAYACPLPRVSMKQRLIILVTGDSCAGKDYCADIWVSALLAYNHKGLTARAVSISDATKREYATATGADLNRLLSDRAYKEQHRPALTAFFQDQVRHRPRLPEEHFLNVVDSAADVDVLLITGMRDEAPVATFSHLVPDARLLEVRVQAGEEMRRARGGCHGSDDDSNDNKNNDNGRLNLTALDHHPDLIFHNDTTGDKAAKAFADYYLLPFCHEDLQRLTDMVRQVPDFPRLGIEFRHVLDISQQPGGLTLCTSLLQSHFTGDWAKVDAVACCEAGGFVYASALASQVGVPLALIREAGKLPPPTISVAKSPSHVSLSTSNGMNEKRIEMARGLIPRGGSVVVVDDVLATGNTLCAVLQLLDEAGISSKDVTIMVVAEFPLHRGREFLRQRGFGGVKIQSLLVFDGA

SEQ ID NO: 22752 - protein, 544 aa, Ralstonia metallidurans CH34
MCTHTGHSAAPSLSGLIDAEPCHFWLPLMPNEPTDVLPPTSFNVPFGTRPGIAALGERFFTRLSPTPLPSPYLVSVAPAAAALLGWNETDLQDAVKDPAFIDSFVGNAVPDWADPLATVYSGHQFGVWAGQLGDGRAIRLAEAQTPGGPWEIQLKGGGLTPYSRMADGRAVLRSSIREYLCSEAMYALGVPTTRALSIIGSDAPVRRETIETSAVVTRLAPSFIRFGHFEHFAAREDHASLRQLADFVIDNFYPACRNAANPYQALLRDVSLLTADMVAHWQAVGFCHGVMNTDNMSILGLTIDYGPFGFLDAFDANHICNHSDQQGRYAYSQQPQVAFWNLHCLAQALLPLWRDANAADPEAEKAAAVEAAREALDPFRDRYAEAFFRHYRAKLGLRSEQEQDETLMTNLFRVLHENRVDYTSFWRNLSRVSSLDNSHDAAVRDLFLDRAAWDAWAAEYRARLQSEQSDDAARTTAMLATNPKYVLRNHMAETAIRAARDKDFSEVDRLMAVLSKPFDEQPEAESYAKLPPDWASGLEVSCSS

SEQ ID NO: 22753 - protein, 525 aa, Mycobacterium avium subsp. paratuberculosis K-10
MIHPRLPDLSFFRYVSVNSKLRCGSGPAPIAASRRRPMTKNSDHRCYDELFIGGQWRKPANPQQLDVISPHSEQPIGHAQAAGPEDVDAAVAAARRAFDHGPWPRMSHAERMAKIEQLATIYAAHMDEMADLITDEMGSPRSFSRMGQGAAAATLIHLTLAAARDFPWTERRQGVLGEVHLHRAPVGVVGAIVPWNVPQFLIMPKLIPALIAGCTVIVKPAPETPLDALWLAEMIEQLELPQGVVSVLPGGTDVGEALVRHPGVDKIAFTGSSAVGRRIAALCGERLKRVSLELGGKSAAIILDDADIDKTVAGLKSAGLMNNGQACVAQTRILVSDRKHDEVVDALAAMMAELNVGDPADESTDIGPLVAQRQQRRVQEYIKSGRSEGARMVLGGEDSPAGRGWYVRPTLFADATNDMRIAREEIFGPVLTVLRYRDEDDAIRIANETDYGLAGSVWTADVAHGLEVAAAVRTGTYGINMYTLDIGAPFGGFKQSGIGREFGPEGLHEYVELQTLVCKGQLPPL

SEQ ID NO: 22754 - protein, 445 aa, Prosthecochloris aestuarii DSM 271
MKITIFGSGYVGLVTGACFAEVGNDVLCVDIDEEKISRLKKGEIPIYEPGLEDMVIENSREGRLKFTSDVAEGVAYGLFQFIAVGTPPDEDGSADLRHVLSVAESIGRHMDDYRIIIDKSTVPVGTADLVRDKVLSVLAERNVSIDFDVVSNPEFLKEGDAINDFMKPERIVVGVDNPRTKELLRTLYGPFNRSHERFIAMDIRSAELTKYAANAMLATKISFMNEIANIAERVGADVEAVRRGIGSDSRIGFPFIYPGVGYGGSCFPKDVQALERTARKFGYDSRILQAVEAVNHDQKLSLVDKMRDHFKGDLKGKTIAIWGLAFKPNTDDMREAPSREIIEALWSEGAKVRAYDPVAIDEARRIYGERDDLELLEHPDETLKGADALAVVTEWMVFRSPDFDVMKSELTSPVIFDGRNIYNPDMMEQLGFTYYSIGRLPRCNA

SEQ ID NO: 22755 - protein, 122 aa, Picea sitchensis
MGCIGSKTKTVEQPPGYEDPVVLAAETAFTVSEVEALYELFKKLSSAVFNDGLIHKEEFQLALFRNSQKENLFADRVFDLFDTKRNGVIEFGEFVRSLSIFHPNASKEDKIACETDVDSSSK

SEQ ID NO: 22756 - protein, 311 aa, Staphylococcus aureus subsp. aureus MW2
MKRKIIMDCDPGHDDAIALILAGAIDSPLEILAVTTVAGNQSVDKNTTNALNVLDIMGRQDIAVAKGADRPLIKPAAFASEIHGESGLDGPKLPSTPSRQAVAMPASDVIINKVMTSDTPVTIVATGPLTNVATALIREPRIAEHIESITLMGGGTFGNWTPTAEFNIWVDAEAAKRVFESGITINVFGLDVTHQVLADDHVIERFESINNPVAQFVVELLQFFKKTYKTHFNMDGGPIHDACTILYLLQPELFTMVPVNIDIEHQSPLTYGTMAVDLNHVTGKPANAYFATAVDVEEVWNLIDHKLRTYE

SEQ ID NO: 22757 - protein, 393 aa, Idiomarina baltica OS145
MSVIAMTDLDLQNKRVLIREDLNVPVKDGKITSDARLRAALPTIKLALEKGAKVMVMSHLGRPTEGEYEEQYSMAPVADYLNDALEQPVSLAKEYLDGIDVAQGQVVVFENVRFNKGEKKNDDALAQQLANLCDVFVMDAFGTAHRAQASTHGVAKYAPVACAGPLLAAELDALGKALDNPKRPLVAIVGGSKVSTKLTVLESLSTVVDQLIVGGGIANTFIAAQGHNVGKSLYEKDLVPEAQRLMAAAKAKNAEIPLPVDVVTGQAFSADTVAETKAVESIKDSDMVFDVGPKTSEMLAEKLKAAGTIVWNGPVGVFEFEAFSKGTESMANAIASSEAFSIAGGGDTLAAIDQFNIADKISYISTGGGAFLEFLEGKKLPAVEILEQRAQDA

SEQ ID NO: 22758 - protein, 324 aa, Glycine max
MPSSSTMPLSPDPPFLCTEDASEVTSDHHHPPSPFPDSDEAAIAGLLDAETHHMPEKDYLRRCRDRSVDVTARLDAVNWILKVHAFYEFSPVTAFLSVNYLDRFLSRCSLPQESGGWAFQLLSVACLSLAAKMEESHVPFLLDLQLFQPKFVFQPKTVQRMELWVMSNLKWRLRSVTPFDYLHYFFTKLPSSSSQSITTASNLILSTTRVINFLGFAPSTVAAAAVQCSANGQLPLSFHDRLNSEMVRCCHQLMEEYVVDTCPASIKVRITDAAAPSSPVGVLDAATCGSCDTPSERNFAGSAEEQAEPPNKRRRSSASDAPRR

SEQ ID NO: 22759 - protein, 336 aa, Idiomarina baltica OS145
MTKRIAINGFGRIGRSFLRSFYERGWQQRFSIVLVNEPAPSESMAHLLKYDSSHGRFQFPVTLSDDDLTVAGDTIKLSHETEIERVDWQARGVDIVVDCTGVFGSHADGERYLNAGVSRVLFSQPGTPDMDATIIFGVNQDVLLPEHRIVSNGSCTTNCIVPVIKLLDDAFGIESGAVTTIHSAMHDQQVIDAYHPDLRRTRAAGRSIIPVDTKLARGIERILPHLHGRFEAIAVRVPTTNVTAMDLSVTLQTDVDGEQVNRLIKNAASKGLRAILDYTEEPLVSIDFNHDPHSCIVDGTQTRVSHRRLVKLLCWCDNEWGFANRLLETTELMTQQ

SEQ ID NO: 22760 - protein, 211 aa, Thermus thermophilus HB8
MGLPQVLERIARACRCAGRRPEEVRLVAVTKGRSVEEIREKVLAYGTFPLGESRVQEALKKMDLLQAEWHLVGHLQRNKAKFAPRFALVHSLDSLRLAEALEKVGEKAGVRLKVLVEVNLGREPQKHGVLEEELPELLHRLREMPHLEVLGLMTVPPIGPEAVVRPIFRRLSELADRYGLPERSMGMSDDYEWAVEEGATLVRVGRALFVD

SEQ ID NO: 22761 - protein, 479 aa, Synechococcus sp. CC9311
MSSNPTIQSICCIGAGYVGGPTMAVIADRCPDVKVTVVDINQDRIAAWNNGDLSKLPVYEPGLDAVVERARGRNLFFSTAVEETIASADMVFISVNTPTKTKGLGAGQASDLRWVEACARTVAKAAQGYTIVVEKSTLPVRTAEAVKAILGSVDPSSELKTFSVLSNPEFLAEGTAIRDLASPDRVLIGGDNAEAIDALAEIYQQWVPEEKILRTNLWSSELSKLTANAFLAQRISSINSVAALCEATGADVREVAKAIGTDSRIGPKFLSAGPGFGGSCFQKDILNLVYLCRHFGLPDVADYWESVVLLNTWQQHRIARLVVQKLFGTVTGKRLAILGFAFKADTNDTREAPAIRICRDLLEEGAQLAIHDPKVDPEQISRDLKLIASHAPEADAGPTRGALSGEATWWPSPDVASALRGADAVLILTEWKQYRELDWAALAPLMRKPAWLFDARGVADPKQVASAGLNVWRVGEGDA

SEQ ID NO: 22762 - protein, 230 aa, Streptococcus suis
PWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAA

SEQ ID NO: 22763 - protein, 169 aa, Triticum aestivum
  misc_feature (9)..(9): Xaa can be any naturally occurring amino acid
MAPTVMASXATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMCKLPMFGCTDATQVINEVEEVKKEYPDAYVRIIGFDNMRQVQCVSLIAYKPPGC

SEQ ID NO: 22764 - protein, 327 aa, Salinibacter ruber DSM 13855
MHVCVTGGAGFVGGHLCRRLLDEGHRVTAIDNFDPFYPRAIKEEGIEDFPRERFTLIETDICNTDAFLQALHARDVDAIVHLAARAGVRPSIEAPMAYEETNVGGTQSMLEVAQELGIGTFIYGSSSSVYGTNDTVPFAEGDPVDAPISPYAATKRSGELLAHTFHHLYGLTVHCLRFFTVYGPRQRPDQAIHKFARQLLTGQPITMYGDGTSRRDYTYVADIVDGIVRSLRRAKGLDAPEHEIINLGGSETTQLRDLISGIAEAMDIAPEIEQLPTQPGDVERTYADISKAKRLLDWTPETPIDEGLQKFADWVKAYYEDRPVLEV

SEQ ID NO: 22765 - protein, 180 aa, Glycine max
GQHSFYQLIHQGRVIPCDFIGVVKSQQPVFLKGEVVSNHDELMSNYFAQSDAHAYGKAAEQLQKENVSPHLIPHKTFSGNRPSLSLLLPSLNAYNIGQLLAIYEHRIAVEGFIWGINSFDQWGVELGKSLATQVRKQLNASRTKGEPIQGFNFSTTTMLTRYLQASSDVPADLSTVLPKI

SEQ ID NO: 22766 - protein, 388 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIAINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 22767 - protein, 450 aa, Legionella pneumophila subsp. pneumophila str. Philadelphia 1
MMAIYQTQLHKILSGTRNKHHSGLLHCGRISRAIGLTIEAKGFNQPVGARCLVKINDEHSVQAEVVGFSNESVYLMSIGDIQGIAPGMKIIPTGRIAQVSVGHQLLGRILNGSGMFIDDGPPGEMVETYPLIGQVINPLKRAPIEVPLDVGIRAINGLLTVGRGQRIGLFAGSGVGKSVLLGMMTRFTEADVVVVGLIGERGREVKEFIECNLGLEGLRRAVVVAAPADESPLMRLHGAKVATSIAEYFRDQGKHVLLLIDSLTRFAQAQREIALSIGEAPATKGYPPSVFAKLPKLVERAGNGTSGGGSITAFYTVLTEGDDLQDPIADAARAILDGHVVLSRALAEQGQYPAIDLEASISRVMQGVVSEQHMKDMLLFKKYLSVYEKNKDLILLGAYAKGSDPLVDKAILAVNKLKDYLAQGMDEQVSYDESLSSLTKLISTLVGNDQ

SEQ ID NO: 22768 - protein, 213 aa, Oryza sativa Japonica Group
MGEEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 22769 - protein, 251 aa, Bacillus cereus ATCC 14579
MKTTENFTDRADIYAKYRPSYPNEYIDYLLSANQLKGNRIVADIGSGTGIFSHQLLESGLHVIGVEPNDDMRKMAEQSLKLYSRFQSIKATAENTTLKENSVDLVTVAQAFHWFDKEAFKIECQRILKQKANVALVWNSRDLTSPLIKENAEICQKTCPNFKGFSGGIDETPEVFNNFFKDGKYDFKEYQNDLLFDYEGFLGRNLSASYAPKENDEQYKNFIFLLSELFEKYSKDGKIILPNLTRSYLGNV

SEQ ID NO: 22770 - protein, 352 aa, Cryptococcus neoformans var. neoformans JEC21
MPRPPEDPDVRNSKTLAYILRHGAEKEGLYIRSDGFIKLADVLARPKLKGVDEPTILHLVQTNAKKRFELFWGYDPSPPRPKKKPTQGKTKKQLQRDRETAAAAAASAAVAASGTGEGQEKGKEPDAATIDIIASSLASTDLTAPPSSLSINSTAPAPAQSSTSVDPPELPLISLPDPHTSASDSDANASANSDNPKGEYFIRATQGHSIQLESTAHLEQVKDDEEGKRKVGLMVHGTRWELWDTLKEQGLQKMTRQHIHLAPGFSGPITPRPNSTLYIYLDLSKLVAAGIPVYVSANGVVLTPGSKGGENGEGAGVGKEFWRRAVRRKEGKRWVVWEDGREVEREELSGEE

SEQ ID NO: 22771 - protein, 160 aa, Zea mays
  misc_feature (121)..(121): Xaa can be any naturally occurring amino acid
  misc_feature (129)..(129): Xaa can be any naturally occurring amino acid
  misc_feature (141)..(141): Xaa can be any naturally occurring amino acid
MEQTFIMIKPDGVQRGLVGQIICRFEQKGFTLKGLKLITVDRPFAEKHYQDLSAKPFFSGLVDYIISGPVVAMIWEGKNVVLTGRKIIGATNPAASEPGTIPVGDFAIDIGRNIIHGSDSXVESANREXGALWFPGWNLVXNWQSSLHSWDLRMILSIVL

SEQ ID NO: 22772 - protein, 541 aa, Ralstonia metallidurans CH34
MPTDLQAWNALRQHHDVVRETPMQQWFAEAGAAQRVDAFSLEASGLYLDYSKNRITGETLALLMKLAEEAGVPARRDAMFAGEHINATEDRAALHVALRALPDAPFKVDGASVMPAIHDVLRRMREFAGRVRSGVWTGSTGQGITDIVNIGIGGSDLGPRMVCRALAHLADPRGPRVHFVSNVDGTELAETLQRLDPARTLAIVCSKTFTTLETMANACSMRDWFLRHGVAENQLARHFVAVSTNRDAVVDFGIDPNNMFEFWDWIGGRFSLWSSVGLSIALAVGFDAFEDLLLGARAMDDHFRTAPLAQNMPVVMAMLGIWYRNFHDMPTSCMAPYSTSLELFPAFLQQLEMESNGKSVQLDGRPVDADTAPVVWGTAGTNGQHAYFQMIHQGSQIVPVDFVAPLVPPRELPGHHVKLLANCFAQAEALMRGRSAEELQAAGVDAARIPHMVFEGNRPSNMLLMENLTPHVLGALIALYEHRTFVQGIVWNINSFDQWGVELGKILARPIEAELSGNATEAHDASTAALIARARRSLARS

SEQ ID NO: 22773 - protein, 108 aa, Triticum aestivum
  misc_feature (25)..(25): Xaa can be any naturally occurring amino acid
  misc_feature (47)..(47): Xaa can be any naturally occurring amino acid
PNPPTSPLKPSPATDATQAPNPSEXERGGGGGNPVDRRGDGVLRAAXWGQELDGLTNLQPAGGCDDPSYPYYLKLRCESCGETNAKTTCVSLNEVFKLPTGKLQSPQK

SEQ ID NO: 22774 - protein, 332 aa, Paracoccus zeaxanthinifaciens
MTDAVRDMIARAMAGATDIRAAEAYAPSNIALSKYWGKRDAARNLPLNSSVSISLANWGSHTRVEGSGTGHDEVHHNGTLLDPGDAFARRALAFADLFRGGRHLPLRITTQNSIPTAAGLASSASGFAALTRALAGAFGLDLDDTDLSRIARIGSGSAARSIWHGFVRWNRGEAEDGHDSHGVPLDLRWPGFRIAIVAVDKGPKPFSSRDGMNHTVETSPLFPPWPAQAEADCRVIEDAIAARDMAALGPRVEANALAMHATMMAARPPLCYLTGGSWQVLERLWQARADGLAAFATMDAGPNVKLIFEESSAADVLYLFPDASLIAPFEGR

SEQ ID NO: 22775 - protein, 119 aa, Magnaporthe grisea 70-15
MTSTIGIPIKLLNEAQGHIITLEITTGQTYRGKLIDAEDNMNIQLRDITVTARDGRVSHLDQVYIRGSHVRFFIVPDMLRNAPMFRSRNVRGRGVGLARGRATVNRARGGGGRGGRGDR

SEQ ID NO: 22776 - protein, 169 aa, Brassica napus
  misc_feature (165)..(165): Xaa can be any naturally occurring amino acid
MVSLFSSRKRSRKERKNPYSDLGLEKFSALLSELDEKRQSIYATRVDSDGPPLVRFVFKSSGECVPIMIKTKKVTKKKDSQYDLKVKIETKVEEENETKKTELVTEQKQSCVLNENLKKISRPKHFLPVTTILVLIFFVFFGRTVSIMCTCIVWYLVPLIKEHCXRRGS

SEQ ID NO: 22777 - protein, 287 aa, Paracoccus zeaxanthinifaciens
MQARLAEIRPLVEAELNAAIDALPAGDLSDAMRYAVQGGKRLRAFLVMESARLHGLDDDASLPVAAAVEALHAYSLVHDDLPAMDDDDLRRGQPTVHVKWTEATAILAGDALQTLAFQLLADPRVGDDAARMRLVGSLAQASGAAGMVWGQALDIAAETSGVPLDLDAIIRLQGGKTGALIRFAATAGPLMAGADPAALDDYAQAVGLAFQIADDILDVEGCEAATGKRVGKDADANKATFVSLLGLEGARSEARRLADAGQDALAGYGDAAGNLRDLARFVIERDS

SEQ ID NO: 22778 - protein, 143 aa, Paracoccus zeaxanthinifaciens
MMTDGPATPILDRVQQPSDLASLDDAQLRLLADELRAETIDIVSRTGGHLGAGLGVVELTVALHAVFRAPRDKIVWDVGHQCYPHKILTGRRDRMRTLRMGGGLSGFTKRQESAFDPFGAGHSSTSISAALGFAMARELGGDP

SEQ ID NO: 22779 - protein, 596 aa, Aspergillus nidulans FGSC A4
MKGLQHGLSLLVILCLAHWVSSRAVRFDLRLTWEDRNVAGVVRKVILSNGQFPGPTLRVKQGDEVEFRVRNLMPFSTSVHFHGISQLGTPWSDGTPGLSQEPIEPGHQFIYRWTADEYGSYIYHSHSRGQLIDGLYGAIYVEPRGSVEKPFRLITQDATDLAAMISAESKTEPVMLSDWRFLTSEDIWQVEIASGVESVCSNAILINGKGSAWCLPQQRINDLTSVGQRQLLGNETMTDIGCFPPIDSFFGNYPRDPSILPKGFNSGCIPGYGPEEIVMVDASTRYISRDLISMAGSASLIFSIDEHPMYIYAIDGRYIEPVLVEAVRIVPGSRYSVLIELKQNRTAKDYTIRVAQNGLNQIINGSATMLYTSHRPQQNASIPYITETGDATTPQTVYLNESLIVPFPVQLPAPTVDQTIILNINHYHAAYRWQLGNGSFPMELEEVRPALFNASAIPYPYSVSTLNDTWVDIVFNVSGANQPPHPMHKHSNKYFVIGEGSTPFIWSSVAEAMEEMPENFNLVNPQLRDTYPTPFVPEATGVWLAIRYKVVNPGPFLLHCHLQMHQSGGMTLAILDGIGDWPLVPAEYQLSAAAAL

SEQ ID NO: 22780 - protein, 244 aa, Salinibacter ruber DSM 13855
MCRLPSAPDRVFFLMPASPTMPTLAPSIIASDSGRFAACADEVLGAGPDWLHVDVMDGHFVPNITIGPDVVRTLRPVADEHDAQLDVHLMIEEPQQYVDTFADAGADMLTVHVEACPHLHRVAQTIRAAGCEVGVALNPATPLGHLEGILPFVDLVLVMSVNPGFSGQSFIPESTAKVQRVRRQLNALGSSAYVEVDGGVTPNNAMELVRAGADVLVSGSAVFGGEQSVPQNVEALRNALTLTV

SEQ ID NO: 22781 - protein, 258 aa, Xanthomonas campestris pv. vesicatoria str. 85-10
MTTHRWRLDGQTALITGASAGIGLAIARELLGFGADLLMVARDADALAQARDELADEFPERELHGLAADVSDDEERRAILDWVEDHADGLHLLINNAGGNVTRAAIDYTEDEWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 22782 - protein, 356 aa, Salinibacter ruber DSM 13855
MSHALSDGPAPSGALESVMTLEQFILDRRGRFPQSTGAFSRLLRDVSVAAKIINHNIRRAGILDVMGESGTVNVQDEKQKKLDEIADRELERALRRGGECCLVGSEEQADTISLSPRGDFQERFAVFFDPLDGSSNTDVNASVGTIFSVYTLPEGADEGDALDVALRPGAEQVAAGYVAYGSSTMFVFTTGNGVNGFTLDPGIGEFLLTHPDLQIPQAPAMYSINEADIEDFSPELRAFLQWLKTKDPDTGHRIRARYIGSFVSDFHRNLLTGGLYMYPATSDHPDGKLRLMYEANPMAFLVEQAGGRASTGHQRILDLQPEGLHERTPLFIGSAPLVKAAEAYLQGRGAEAVGGA

SEQ ID NO: 22783 - protein, 411 aa, Brassica napus
MAATAGATPSSHLLLSSSRHVAASPQPRILFPSLSGKRVAVGKNHHATGVRCMAVAADATAETKPAAKKKSGYELQTLTSWLLRQEMKGEIDTELTIVMSSIAMACKQIASLVQRAGISNLTGVQGAVNIQGEDQKKLDVVSNEVFSNCLRSSGRTGIIASEEEDVPVAVEESYSGNYVVVFDPLDGSSNIDAAVSTGSIFGIYSPNDECLPDSDDTSALGSEEERCIVNVCQPGNNLLAAGYCMYSSSVIFVLTLGKGVFAFTLDPMYGEFVLTQENIEIPKAGKIYSFNEGNYQMWDENLKKYIDDLKDPGPSGKPYSARYIGSLVGDFHRTLLYGGIYGYPRDAKSKNGKLRLLYECAPMSFIVEQAGGKGSDGHHRVLDIQPTEIHQRVPLYIGSKEEVEKLEKYLA

SEQ ID NO: 22784 - protein, 614 aa, Staphylococcus epidermidis ATCC 12228
MEFLSLVIVVVAAFMTPIIVHRFNINFLPVVVAEILMGIVIGHSFLNLVERDAFLNILSTLGFIFLMFLSGLEIDFNAFKKDSRPRQGEDKHEKDVPGHLKLALTVFAFIMMISVVLAFAFKWLGLVNDVLLMVIIISTISLGVVVPTLKEMNIMRTTIGQFILLVAVLADLFTMILLTVYGAIYGEGGSTIWLTGILVVFTVVFYVIGVLFKRMSFLQKLMDGTTQIGIRAVFALIILLVALAEGVGAEYILGAFLAGVVVSLLKPNEEMVEKLDSFGYGFFIPIFFIMVGVDLDIPSLIKEPSLLLIIPVLIFSFIISKLIPVFYIRRWFDTKTTIASAFLLTSTLSLVIAAAKIAEKLKAISPETSGILILSAVITCVFVPVIFKKMFPIPNEVGRRIEVSMIGKNQLTIPIAQNLTSQLYDISLYYRKDLSDSRKLSDDITMIEIADYEEDLLERLGLFERDIVVCSTNDDHINKSVALMAKKHGVKRVICRLESTNEDPTLKHQGIEVFSNYLSNKILLKSLIETPNMLNLLSNVETSLYEIQMLNYQYENIQLRNFPFGGDIIFVRIIRDNDSIVPHGDTQLRYKDRLIVTGTKEYVDELKQELEFYY

SEQ ID NO: 22785 - protein, 338 aa, Salmonella enterica subsp. enterica serovar Typhi str. CT18
MRVLVTGGSGYIGSHTCVQLLQNGHDVVILDNLCNSKRSVLPVIERLGGKHPTFVEGDIRNEALITEILHDHAIDTVIHFAGLKAVGESVAKPLEYYDNNVNGTLRLVSAMRAANVKNLIFSSSATVYGDQPKIPYVESFPTGTPQSPYGKSKLMVEQILTDLQKAQPEWSIALLRYFNPVGAHPSGDMGEDPQGIPNNLMPYIAQVAVGRRESLAVFGNDYPTEDGTGVRDYIHVMDLADGHVVAMEKLADKSGVHIYNLGAGVGSSVLDVVNAFSKACGKPINYHFAPRRDGDLPAYWADASKADRELNWRVTRTLDEMAQDTWHWQSRHPQGYSD

SEQ ID NO: 22786 - protein, 268 aa, Bouteloua trifida
ASYAAAAMPALDLLSEKSHHGWDGTGAAAVAPTPAPRRLDGKVAIVTGGARGIGEAIVRLFVKHGARVVIADIDDAAGDALAAALGPQVSCVRCDVSVEEDVKRAVEWAVARHGRLDVLCNNAGVLGRQTRAAKSILSFDAGEFDRVLRVNALGTALGMKHAALAMAPRRAGSIVSVASVAGVLGGLGPHAYTASKHAIVGLTKNAACELGAHGIRVNCVSPFGVATPMLINAWRQGHADAVPSDEEVEKMEEVVRGFATLKGPTLRP

SEQ ID NO: 22787 - protein, 236 aa, Brassica napus
MQKREFAKSGGQSGGSSAPPAKRGRPFGSTSANSAAAAAAAAAAEAMSPSALLGPSLLVHNSFVEQNNKRIVLALQSGLKSEVTWALNTLTLLSFKERDDIRRDFTPLAKIPGLLDSLLLIIDDWRDIALPKDLTRGTRVRSLGVNSSVTGFGSEYDALASLQPPGSGAGSAAGEVLGKKSKHLSSQGWNEEDGLFNLDDEGRAEKQLCAVAASNVIRNFSFMPDNGAFMAQHRHC

SEQ ID NO: 22788 - protein, 317 aa, Triticum aestivum
  misc_feature (299)..(299): Xaa can be any naturally occurring amino acid
MGNTGSTSPASLGKAHVPHLQWKVHDFSALLETGAKSAKSAHFHCSGYKWFLKVTPPMHNKPGAETPYVGLSLKLGRTTLKPGDTVNAVFELSVYNHAKKIYCGRKASHNFDLNNTCSKDECLIPLQKLLKSSAFLVDDSCVFGVKILKIKVCSPEKKAVMVLKKATTLQNLFIQKKGLIKGTYTWTMDNYHELDLKRYVCSPTFEVGGHKWHVGMYPHGCRHITGHISLFLYLESSDKLCYESGKVVELTLSILDQKNGKHSTITSGLSVFGGDSSWGWPKFLTVNRFKDPSPRLCPXESRCLVKADFTIVGSNDG

SEQ ID NO: 22789 - protein, 149 aa, Crocosphaera watsonii WH 8501
MERTFIMIKPDGVQRGLVGEIIGRFEAKGFTLVGLKSLSVSRELAEEHYDVHKERPFFGGLVDFICSSPVVAMVWEGDGVVASARKLIGATNPLSAEPGTIRGDFGVSVGLNLIHGSDAIETAQKEINLWFSEKELLSWEPTVNAWLYE

SEQ ID NO: 22790 - protein, 375 aa, Crocosphaera watsonii WH 8501
MIVQPLTSPPSAPNSKTITPSSDVKPWPGLIETYRPYLPVTEKTPVFTLLEGNTPLIPVPYISQQVGKGVKVFVKYDGLNPTGSFKDRGMTMAISKAKEEGAKAVICASTGNTSAAAAAYARRAGMRAFVIIPDGYVALGKLAQALLYGAEVIAVEGNFDDALTVVKNMAKDYPVTLVNSLNPYRLEGQKTAAFEVVDVLGNAPDWLCIPVGNAGNISAYWMGFCQYRSFGKSDKLPKMMGFQAAGAAPFIAGKPVPNPETLATAIRIGNPANWDKAWGAKDASQGEFNAVTDEEILEAYRILAAHEGIFCEPASAASVAGLLKVSDRVPANSTVVCVLTGNGLKDPDSAIKHSKNQVKSGIKPELSQVAKVMGF

SEQ ID NO: 22791 - protein, 233 aa, Sinorhizobium meliloti 1021
MKRINRSIFRTFFILSTATIGAVIVTTDADAVQRQRMTARQCSPLSEDNFAACCVAINRTKILTPAQIKMCPPLTTASIGAGTGRHDRSDSTASGPMRGGGKGGGSKGGGGVGGGGGGGGGGGGGGGGGGGGGGGGGGDNGGGGQDPGKGDQDNGKGNQDGGKGHQDNGKGGQDGGKGHQDNDKGNQDGGKGHQDNDKGNQDGGKGHQDNNKGDQDGRGKGGKDKGGKAKGDK

SEQ ID NO: 22792 - protein, 455 aa, Bacillus cereus ATCC 14579
MSISSIVSRQKEYFLKGHTRSIEMRKNNLKKLYEGIQHFEEEIFQALKLDLNKSVHESFTTEVGYVLKEISFQLKHISSWSKPKRVRTALTHLGSKGKVVPEPYGVTLIIAPWNYPFQLAIAPLVGALAAGNTIVLKPSELTPSVSKVLKRMLDELFPEELVAVVEGGVEESTSLLREPFDYIFFTGSVGVGKVVMEAAAKQLTPLTLELGGKSPCIVHKDAKIEMTARRIVWGKFLNAGQTCVAPDYMYVHSSVKEKLIEALRHEIIEQYSKEPLQNENYVRIVSERHFERLCGFLQDGQVVIGGNYKKDTLHIEPTVLADITWKDTVMEDEIFGPILPIIEYDNIEDVIGTIQQHPKPLALYVFSEDKEVQKKVTSNISYGGGCINDVVYHLATPYLPFGGVGSSGLGGYHGKESFRTFSHYKSILAQSTAFDMKIRYSSTKSALKFIRKLLK

SEQ ID NO: 22793 - protein, 216 aa, Ralstonia metallidurans CH34
MTRNDLLDRLATTQASALETQGLGLVPMVVEQSGRGERAYDIYSRLLKERVVFMVGEVNDQTANLVVAQLLFLESENPDKDVSLYINSPGGSVSAGLAIYDTMQFIKPDVQTLCMGMAASMGAFLLAAGAKGKRSALPNSRIMIHQPLGGARGQASDIEIQAREILYLRERLNSILSEVTGQPVEKIARDTDRDNFMSGDQAVDYGLIDKVITRRS

SEQ ID NO: 22794 - protein, 268 aa, Coccidioides immitis RS
MPSPSRASALLANLSSVTSRISAASVPGSSVRLVAVSKLKPASDILALYNPPTSHLHFGENYLQELLEKSKILPPEIRWHFIGGLQSNKCVTLARDVRGLWAVESVDTQKKATLLDKGWGERLKNHSAQQQQQQQGRAEPERLRVFVQVNTSGEESKSGVEPSQAVELCRFIREQCPRLKLEGLMTIGAIARSKATTPETQNEDFDCLRETRDRICQELGLEGEEKLELSMGMSEDFEGAIAMGSNEVRVGSTIFGARPPKGEAKVVP

SEQ ID NO: 22795 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 22796 - protein, 449 aa, Nicotiana plumbaginifolia
MEHIQTRTTLSQLSTLPSDKRLGAIRFKCLLVMKVEMINRIAGVFARRGYNIESLAVGLNKDKALFTIVVSGTERVLQQVMEQLQKLVNVIKVEDLSKEPQVERELMLIKISADPKYRAEVMWLVDVFRAKIVDISDQSLTIEVTGDPGKMVAVQRNLSKFGIREIARTGKIALRREKMGESAPFWRFSAASYPDLEGAMSAGTISRTIKRTPNGESMSMAEGDVYPVETDDNSGVSQVLDAHWGVLNDEDTSGLRSHTLSMLVNDTPGVLNIVTGVFARRGYNIQSLAVGHAEVEGLSRITTVVPGTDESVSKLVQQLYKLVDIHEVRDITHLPFAERELMLIKIAVNAAARRNVLDIASIFRAKAVDVSDHTITLELTGDLHKMVRLQRLLEPYGICEVARTDVWHWYVNQVWIRSTCEDIHTLCSLKSSNLRKIPALCGMCANVDD

SEQ ID NO: 22797 - protein, 376 aa, Thermotoga maritima MSB8
MDALEIHRFLKGKIRTALPVEKVDRETLSLLYTPGVADVARACAEDPEKTYVYTSRWNTVAVVSDGSAVLGLGNIGPYGALPVMEGKAFLFKAFADIDAFPICLSESEEEKIISIVKSLEPSFGGINLEDIGAPKCFRILQRLSEEMNIPVFHDDQQGTAVVVSAAFLNALKLTEKKIEEVKVVVNGIGAAGYNIVKFLLDLGVKNVVAVDRKGILNENDPETCLNEYHLEIARITNPERLSGDLETALEGADFFIGVSRGNILKPEWIKKMSRKPVIFALANPVPEIDPELAREAGAFIVATGRSDHPNQVNNLLAFPGIMKGAVEKRSKITKNMLLSAVEAIARSCEPEPERIIPEAFDMKVHLNVYTAVKGSA

SEQ ID NO: 22798 - protein, 352 aa, Thermus thermophilus HB8
MDWLLTPGPVRLHPKALEALARPQLHHRTEAAREVFLKARGLLREAFRTEGEVLILTGSGTLAMEALVKNLFAPGERVLVPVYGKFSERFYEIALEAGLVVERLDYPYGDTPRPEDVAKEGYAGLLLVHSETSTGALADLPALARAFKEKNPEGLVGADMVTSLLVGEVALEAMGVDAAASGSQKGLMCPPGLGFVALSPRALERLKPRGYYLDLARELKAQKEGESAWTPAINLVLAVAAVLEEVLPRLEEHLALKAWQNALLYGVGEEGGLRPVPKRFSPAVAAFYLPEGVPYARVKEAFAQRGAVIAGGQGPLKGKVFRLSLMGAYDRYEALGVAGMFREVLEEILPAS

SEQ ID NO: 22799 - protein, 125 aa, Triticum aestivum
MAASAATATAAAVGAGEVISVHSLEQWTMQIEEANAAKKLVVIDFTASWCGPCRIMAPIFADLAKKFPAAVFLKVDVDELKSIAEQFSVEAMPTFLFMKEGDVKDRVVGAIKEELTNKVGLHAAQ

SEQ ID NO: 22800 - protein, 272 aa, Salinibacter ruber DSM 13855
MPVRGNHRPEIRVRDGPFLSLSGTPTDSMVDDFVKFSRGLTSLPGGIYDGDLGDQPMSGLVPMVVEQTTRGERAYDIFSRLLKERIVFIGTPINDQIANLTVAQLLYLASESSEKPINLYINSPGGVIYSGLGVYDTMQYIGAPVSTICVGLAASMGSVLLAAGEDDSRACLPNSRVMIHQPMGGAEGQASDIEIQAEEIMWLKERLYEILALHTGQDIDQIEADADRNYWMSAEEAEEYGLVDNVLNPDNLEGLKSIQPNGEAADDSEDDA

SEQ ID NO: 22801 - protein, 637 aa, Saccharophagus degradans 2-40
MAKQIINVPDIGGADNVDIIEICVAVGDTVSAEDSLLVLESDKASMEVPSPVSGKVVGILVKEGGKVSEGDAIFEIEAEGAADAPAAEPAAAPAAAPAPEAAAPAASSEQLVKVPDIGGSENVEVIELCVAVGDEVAEGDSIIVLESDKASMEVPAPASGKVVSFAIKEGDKLSEGDDILVLEVSGGAAAPAAAPAESAPVAAAPAPAPAASGGVTDVNVPDIGGSENVEVIEVCVAEGDEISEGDSIVVLESDKASMEIPSPASGKVVSITVKEGDKVSEGAALLKLEIVGAAPAAAPAPAAAPAAPQAPAKPVEQPVKTTQELHPAEVSATTGEVYAGPAVRKLARQLGVNLSEVKPTGPRKRHTKDDVREFVKTVMKQRSTGGAAVTGGSGIPAVPAVDFSQFGEIEMQKMSKIKKVTAAAMVRNWLNVPHVTQFDDADITELEAFRKNMKAEAEAAGVKLTPLPFLLKACAAALKAEPSFNVSMHPDGEHIVQKKYIHIGMAVDTPNGLVVPVIRDVDKKGLFELAAETVALAKKARDGKLMPKDMQGGCFTISSLGPIGGTGFTPIVNAPEVAILGVSKADIKPRWNGKEFEPRQMLPLCLSYDHRAINGGDAGRFFTFLSAVLSDVRRLLL

SEQ ID NO: 22802 - protein, 230 aa, Bacillus subtilis subsp. subtilis str. 168
MRVVDNLRHINERINEACNRSGRSSDEVTVIAVTKYVSPERAQEAVDAGITCLGENRDAELLRKQELMKGNPEWHFIGSLQSRKAKSVVNSVSYIHSLDRLSLAKEIEKRAEGTVRCFVQVNTSLEPSKHGMKKEEVIPFIQELSGFEHILVAGLMTMAPLTDDQDQIRSCFRSLRELRDQVQKLNQPNAPCTELSMGMSNDFEIAIEEGATYIRIGSSLVGNETGGVQQ

SEQ ID NO: 22803 - protein, 413 aa, Aspergillus oryzae
MTDPTTEIDVDLDVQEILLAASQHDIPKLRQLIRSNQTIANPVNVKDPETGYAPLHAAIAACEPDDEEPNGVQTNGEQGDEQKSVEEKGSATVRFLLQEGAIWNDLDNNNETPGCVARRLGLTELYEQLVDAGVRAELLLNRLDGYEELEDDDEEEEEGQEEQTGTEEVEVEGESAPQLVEATTTTETAMETGPDVTNSRYLDSNLTFQNDRLLDQDQNGVMMAWETDIMAKSAKKLLPTSGLRVLNVGHGMGIVDGFIQEQSPAEHHIIEAHPEVVAEMKRKGWGEKPGVTIHEGRWQDILPDLVGQGVMFDAIYYDTFAESYGDFREFFSEQVIGLLEQEGKWSFFNGMGADRQISYDVYQKVAEMDLMDAGFDVEWEEIALPKLDNEWDGVRRAYWQIESYRLPLCKYMD

SEQ ID NO: 22804 - protein, 756 aa, Haemophilus influenzae R2866
MTEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAIPNADIFLGCSAAGALTQDMVKTMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 22805 - protein, 330 aa, Oenococcus oeni PSU-1
MISEFWKSIKDASQKKGEPFFSLAPMEAVTDSVFRRVVFKAAPPDLFYTEFTNAISVTHPKAKFSVMGRLYVKKDEQRPIVQLWGNHASDFAKAALSVKNQGFKAIDINMGCPDSTVVKNGGGSDLIRHRSAAAEVIQASKEAGLPISAKTRLGFSKIDEMYDWLPWLLKQDLQVLTVHLRTRKEMSKVPAHFELIDEIIKMRDQIAPETLLQINGDIKNRSEGIELAKKHPGIDGIMIGRGVFENPYCFETKAATHSLNDCLDLFEMQLDLYDQYVQEVGLKRFETLRRFFKIYIRGIRDAAKYRDLLINTHSTDEARKIINELRTLNN

SEQ ID NO: 22806 - protein, 316 aa, Musa acuminata
MDSFPVIDMEKLSGGERGAAMEILRDACEKWGFFEILNHGISHDLMDEVEKVNKEQYNKCREQKFNEFANKALENADSEIDHLDWESTFFLRHLPVSNISEIPDLDDQNAMKEFAAEIEKVAERLLDLLGENLGLEKGYLKKAFSNECKGPTFGTKVSSYPPCPRPDLVKGLRAHTDAGGIILLFQDDQVSGLQFLKDGEWLDVPPIRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 22807 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 22808 - protein, 523 aa, Oenococcus oeni PSU-1
MALLDVTGLTMAYADKKLYTDAGFTLERGEHLGIVGQNGAGKSTLIKILTGKVLPIAGRVEWKKKIQIGYLDQYADIPSGMSLIDFLHTAYSDLYDKEKKMTDLYSKYAELVDDKLLERATRFQNELDAADFYSIDNNVEQVITGLGLDSIGRDHIISEMSGGQRAKIILAKLLLEGNDVIILDEPTNYLDVSHIKWLEGYLQNYDGAALIISHDFDFLNNVANVILDVSFNTLTKYRGNFDQAMRQKTEKTEQQLRAYNKQQEVIKKTKTFIQKNKARASTTGRAKSREKMLAHMDIIEPPQTNPKATFKFPYIESQSTDALKAERLVVGYDPKKPVLNPITFSMSSGDKIVFTGFNGAGKSTLIKTLLGILPAISGKSKFSPSAKTNYFDQDLIWDDDKKTPLQIMQAAYPLEEQKQLRQRLGAAGINADNATKQMCLLSGGEQTKVKLALMELTPSNFLILDEPTNHLDEATKNSLKKAIQKFDGSLILVTHERSFYEGWIDKVIDIASMSNMQPGEVEE

SEQ ID NO: 22809 - protein, 329 aa, Oenococcus oeni PSU-1
MTNLFTELADKIKEKKLRLVFPEGDDSRVQGAAIRLKKDGLLTPILLGDQAAVEKTAADNHFDLSGIKLIDPLKFDEKQFNQLIDKLVTRRKGKTDPQTVAMWLQEVNYFGTMLVYTGKADAMVSGAVHPTGDTVRPALQIIKTAPGVSRISGAFIMQKNDERYLFADSAINIELDAQTMAEIAVQSAHTAKIFGIDPKVAMLSFSTKGSAKHALVDKVAQATKLAQEMAPDLADNIDGELQFDAAFVESVAKLKAPGSKVAGHANVFIFPSLEAGNIGYKIAQRLGGYEAIGPILQGLAAPVSDLSRGASQEDVYKVAIITAAQALKN

SEQ ID NO: 22810 - protein, 429 aa, Salmonella enterica subsp. enterica serovar Typhi str. CT18
MTTDDLAFDKRHIWHPYTSMTSPLPVYPVERAEGCELVLASGERLIEGMSSWWAAIHGYNHPQLNAAMKAQIDAMSHVMFGGITHQPAVNLCRKLVAITPEPLECVFLADSGSVSVEVAMKMALQYWQARGESRQRFLTFRHGYHGDTFGAMSVCDPDNSMHSLWKGYLPENLFAPAPQSRMDGEWDESDIAPFARLMAAHRHEIAAVILEPIVQGAGGMRIYHPQWLRRIRNMCDREGILLIADEIATGFGRTGKLFACEHAGIAPDILCLGKALTGGTMTLSATLTTRQVAETISNGEAGCFMHGPTFMGNPLACAVACASLTLLESGEWRQQVASIESQLRAELAPAQSSPWVADVRVLGAIGVVETTHPVNMAALQRFFVGQGVWIRPFGKLIYLMPPYIIRPDQLRRLTQAVNDAVHNETFFSH

SEQ ID NO: 22811 - protein, 233 aa, Picea sitchensis
MASSADSWVKEFNEASKLADDINARLGERSSLPPSGPETQRHLSAIRRKITILGTRLDSLENLLPKLPSRQPISEKELHRRQDMLVNLRSKSNQMASALNMSRFGNRSDLLGQDNKPVSEINRTTGLDNYGLVGLQRQIMKEQDEGLGKLEETVISTKHIALAVNEELDLHSRLLDSLDQDVDGTNSRLQRAQKRLAMLSKKAKSSCSCMCSLVMVIVLVILAVVIWALIKFL

SEQ ID NO: 22812 - protein, 304 aa, Staphylococcus aureus subsp. aureus MW2
MTNKVVILGSTNVDQFLTVERYAQPGETLHVEEAQKAFGGGKGANQAIATARMQADTTFITKIGTDGVADFILEDFKAAHIDTSYIIKSTEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 22813 - protein, 529 aa, Mycobacterium avium subsp. paratuberculosis K-10
MKSRAAILHDVGGPWSVEEFELDPPRAGEVLVQMAAAGLCHSDDHILKGDMSAPNEVMRSLGLPTMFPTIGGHEGSGIVREVGEGVTDFAPGDHVVMSFVAVCGQCRWCASGMEYLCDVGIGTMIPGMPTDGTFRHHTAGGGNLGHIAKIGAFAEHTVVSTNSLVKIEQQLPLAPSALLSCAIPTGYGSAANRAGVRGGDAVVVIGAGGIGTGAIQGARISGAAQIVAVDPVEFKQKSALRFGATHSVATIAEALDLVRDLTYGVMADAVVVSPSLITADDVRDALKLTRKGGTCVLTGMTSQLTRSVNIELQDFILMNKTLAGTIFGSCNPRADISRLARLYQSGQLQLDEMITKRYRLDESTTPTTTCSTAKSCGASSISGSPERAAYILIAGNSLLRFHSRSLRADRHEIASATAVIAASTMIACHSRASMPPRMSCRSPLTPYVIGSKRCRTWNGRDVVSTGYIPPALTSCSMSRAMISTRPTAGPTRALMACVAATNAPEISTMNPSIATGWTACMPRANRTTQ

SEQ ID NO: 22814 - protein, 499 aa, Oryza sativa Indica Group
MTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVRAAIKVKASVIICFTSSGRAARLIAKYRPTMPVLSVVIPRLKTNQLRWSFTGAFEARQSLIVRGLFPMLADPRHPAESTNATNESVLKVALDHGKVSGVIKSHDRVVVCQKVGDSSVVKIIELDD

SEQ ID NO: 22815 - protein, 348 aa, Thermotoga maritima MSB8
MKLGILEKYRRFLPVTDKTPMLSLNEGNTPLIPLVNMSRELGINIYVKYEGSNPTGSFKDRGMVVAVAKALEEGSKAIMCASTGNTSASAAAYAARAGIKAIVLIPEGKIALGKLAQAMIYGAVVLQVRGNFDKCLELVKEITSKYPITLVNSINPYRLEGQKTAAFEIVDELGDAPDYHFIPVGNAGNISAYWMGYKEYYQHGFSTKLPKMMGFQAEGAAPIVRGHPIENPETVATAIRIGNPANWEKAVRARDESGGDIDMVSDEEILRAQRLLAQKEGIFCEPASAASIAGLLKKHRQGIFRGGEIVVCTLTGNGLKDPNIVISQLEPPRIIEGRVEEILEVLDI

SEQ ID NO: 22816 - protein, 877 aa, Francisella tularensis subsp. holarctica
MSKFVYAFSEGNKSMRDLLGGKGANLSEMLNSGLPVPDGFTVTTEACLKYYDDRQKLSNEVKEQIFAHIKDLEKRTGKTFGGGNNPLLVSVRSGARVSMPGMMDTVLNLGLNDTVAQAMVAKTNNEQFVYDSYRRFIMMFADVVMDCEKKPFDKVLEDKKAKRKVKNDCDLPAQDYKDIVTEYKKIYKDLVGKDFPTDPIEQLLAAVEAVFKSWNAERAIIYREINNISNNWGTAVNVQEMVYGNSGNNSGTGVAFTRNPSTGENELFGEYLINAQGEDVVAGIRTPAHISTLKDKMPEVFNDFVKIAKNLEKVYKDMQDMEFTIEDGKLFMLQTRNGKRTAKAALKIAVDMAKEDLITNEEAVMMVEPHLLEQLLHPKFDEKALASKRPLGSALGASPGAASGRIYFDVESLLAAKARGEEKTILVRIETSPEDIAGMNACNGILTLRGGMTSHAAVVARGMGKCCVSGLESARIDEEKKTITFERGQVFTEGDYLSLDGTKGTVYRGIIKTVDPEVTKDFEDFMKFVDSVRKLRVRCNADTYKDASIARAFGAEGIGLCRTEHMFFEEDRISYVRQMILAKDKKERQRALDKLLPVQQQDFEELFEAMDNLAVTIRFIDPPLHEFLPHEVDEIDDLAREFNISYSELEARIEALSEVNPMMGHRGCRLAVTYPEIIEMQTKAIIYAAISSKRMGIEVKPELMIPLVSTLGEFKLLSGIVREVADTILKREKIDIDYKVGVMLETPRGAIGAGMLAAAGSEFFSFGTNDLTQMTFGFSRDDANKFIKDYLEKGILSFDPFARLDIKGVGKLMQIAKEGVKAVNPNAKMGICGEHGGEPYSVGFCHDLDLDYVSCSPFRVPIARLAAAQAKIYADRR

SEQ ID NO: 22817 - protein, 739 aa, Thermotoga maritima MSB8
MRTYRSFKMFTNSSQGVRKVRVGIAGLGTVGGSIYRILKERGNEIEKRIGEKFIISKVINRSPQKYELLGVPKEEIAFDFDDLILNSDVVVEAIGGTDVAVDLVRRALELGRIVVTPNKNLISEYGNEFSEYIKKRKLFFEASVGGGIPIISLLQDYLIFQKVTRIRGIMNGTTNYILTEMSKGRHFEEVLKEAQELGYAEADPTNDIEGYDVAYKVSVLAGVVTGRFPGINSVQFEGITRIDPEYLKEIVRSGKKLKLIGELDFSTNRYEVRLREVTPEDPFFNVDGVDNAIEVSTDLAGDFLLKGRGAGGYPTASAVIADLFRVAKYKVLGGAEKFSVVVMKFGGAAISDVEKLEKVAEKIIKRKKSGVKPVVVLSAMGDTTDHLIELAKTIDENPDPRELDLLLSTGEIQSVALMSIALRKRGYKAISFTGNQLKIITDKRYGSARIIDINTDIISRYLKQDFIPVVAGFQGITETGDITTLGRGGSDLTAIALAYSLGADLCELYKDVDGVYTADPRIVKDARVIKELSWEEMIELSRHGAQVLQARAAEFARKYGVKVLIKNAHKETRGTLIWEGTKVENPIVRAVTFEDGMAKVVLKDVPDKPGVAARIMRTLSQMGVNIDMIIQGMKSGEYNTVAFIVPESQLGKLDIDLLKTRSEAKEIIIEKGLAKVSIVGVNLTSTPEISATLFETLANEGINIDMISASSSRISVIIDGKYVEDAVKAIHSRFELDRE

SEQ ID NO: 22818 - protein, 171 aa, Thermotoga maritima MSB8
MTDQIREHLVSMLVHNKPGVMRKVANLFARRGFNISSITVGESETPGLSRLVIMVKGDDKTIEQIEKQAYKLVEVVKVTPIDPLPENRVEREMALIKVRFDEDKQEIFQLVEIFRGKIIDVSREGAIIEITGARSKVEAFINLLPQKQVEEIARTGIVAMNRWNVKEGEGF

SEQ ID NO: 22819 - protein, 248 aa, Cocos nucifera
MGYLNSIAGIQADGSPVSGGGLSRNGKFSYGYASSPGKRASMEDFYDTRIDGDDGEIVGLFGVFDGHGGARAAEYVKQNLFSNLIRHPKFISDTKLAIADAYNHTDSEFLKSENNQNRDAGSTASTAVLVGDRLLVANVGDSRAVICRGGNALAVSKDHKPDQSDERQRIEDAGGFVMWAGTWRVGGVLAVSRAFGDRLLKQYVVADPEIQEEVVDGSLEFLILASDGLWDVVSNEEAVAMIKPIEDP

SEQ ID NO: 22820 - protein, 404 aa, Ustilago maydis 521
MRPQAILPDALSAVGETPLIQLNRIPQSEGIKCNVMVKCEFFNAGGSVKDRIARRMLLQAEQDGTLIPGKSVVIEPTSGNTGIGLALACAIRGYRCIIVLPEKMSAEKVNTLRALGAEVIRTPTEAAHDDPRSNIMVARRLAKSMPNAVILDQYNNPNNPTAHWATAEEIIQAIKAGPAPPSSTSLLHGMDSLSLTNDKEPLDSANARPLTPDSNRGADELNGSTQTFSNKVDVFVAGVGTGGTISGIASRLKRADHNPDCFVLGVDPIGSDLALPVSLNALPEGSDGSYKVEGIGYDFDPNTLNKKVIDEWYKTEDEQSFVYARRLIKDEGILAGGSSGAAVNAAINWLKPGGAGWDKFGSKAGLNAVVVLPDSIRNYITKPWLVSEAKAERRQDEIDFDHFQ

SEQ ID NO: 22821 - protein, 434 aa, Vibrio vulnificus CMCP6
MTPIQAQSLPLVLDGKDVIGQGKTGSGKTATFALGLLSNLNVSRFRVQSLVLCPTRELADQVATEIRTLARGIHNIKVLTLCGGMPMGPQILSLEHGAHILVGTPGRILDHLSKGRIDLAELNTLVLDEADRMLEMGFQDAIDAIIDVAPTQRQTLLFSATFPEQIETIASKVMQNPEMVKVESTHQKSTIEQRFYQLENTEERDNALEALLLTHRPESTVVFCNTKKEVQNVTDELNHRRFSVIELHGDMEQRERERALTMFANKSISILVATDVAARGLDVDNLDAVINFELSRDPEVHVHRIGRTGRAGAKGIAISFFSEKELYRVERIEEYMGIDVHPAKLPQPENPKPYYPSMRTIQILGGKKQKVRAGDILGSLTKEAGIDGKLIGKINILPMVSYVAIDNSVAKIAEQQLQNGKMKGRNFKARIMKG

SEQ ID NO: 22822 - protein, 338 aa, Bacteroides thetaiotaomicron VPI-5482
MKAVQIVNPSEMKVVELEKPTVGAGEVLVRIKYVGFCGSDLNTFLGRNPMVKLPVIPGHEVGAVIEEIGPDVPAGFEKGMNVTLNPYTNCGKCASCRNGRVNACEHNETLGVQRNGVMCEYAVLPWTKIIPAGNISSRDCALIEPMSVGFHAVSRAQVIDNEYVMVIGCGMIGIGAIVRAALRGATVIAVDLDDEKLVLAKRVGASYAVNSKTENVHERIQEITAGFGADVVIEAVGSPVTYVMAVDEVGFTGRVVCIGYAKKEVAFQTKYFVQKELDIRGSRNALPADFRAVINYMKEGKCPVEELISKIAKPEDALEAMKEWAADPGKVFRILVEM

SEQ ID NO: 22823 - protein, 344 aa, Zea mays
MNPTRPAQASFRDRTNEFRAAVESARRHAAPSSSSAPTAASSSSTGSLDGMISATSARSEFNNRASKIGLGIHQTSQKLARLAKLAKRTSVFDDPTLEIQELTSVIKKDITALNTAVVDLQALCNSQNESGSLSKDTTNHSTTVVDNLKNRLMSATKEFKEVLTMRTENLKVHENRRQIFSSSAAKDESNPFIRQRPLVARDPSESSVPPAPWASDSASTPLFQRKKTNGDHGASSSSQPFVQQQQLAVQQDSYMQSRAEALQNVESTIHELSNIFTQLATMVSQQGELAIRIDENMEETVANVEGAQGQLLKYLNSISSNRWLMMKIFFVLMVFLMIFIFFVA

SEQ ID NO: 22824 - protein, 311 aa, Thermus thermophilus HB8
MRVLVTGGAGFIGSHIVEDLLARGLEVAVLDNLATGKRENVPKGVPFFRVDLRDKEGVERAFREFRPTHVSHQAAQASVKVSVEDPVLDFEVNLLGGLNLLEACRQYGVEKLVFASTGGAIYGEVPEGERAEETWPPRPKSPYAASKAAFEHYLSVYGQSYGLKWVSLRYGNVYGPRQDPHGEAGVVAIFAERVLKGLPVTLYARKTPGDEGCVRDYVYVGDVAEAHALALFSLEGIYNVGTGEGHTTREVLMAVAEAAGKAPEVQPAPPRPGDLERSVLSPLKLMAHGWRPKVGFQEGIRLTVDHFRGAV

SEQ ID NO: 22825 - protein, 251 aa, Silicibacter pomeroyi DSS-3
MNHMRLDGKTAIVTGGAQGFGAGIVAKFVSEGARVMVADINLDTARETAAQMDGDAFAHQVDVSDGNSVDAMAAAALRRFGHVDILVNNAGVTHLPTAMEDVSEADFDRVYRVNMKSVYLTARALVPHMKDRGKGAILNVASTAGVSPRPRLNWYNASKGWMITATRTMAVELAPNGIRVNALNPVAGETPLLKSFMGEDTPEMRAKFLSTIPLGRFSTPQDMGNAACFLCSDEASMITGVAMEVDGGRCI

SEQ ID NO: 22826 - protein, 382 aa, Haemophilus influenzae R2866
MAKKDYYEVLGLQKGASEDDIKRAYKRLASKHHPDKNQGSKEAEEKFKEINEAYEVLGDDQKRTAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHHIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 22827 - protein, 412 aa, Salinibacter ruber DSM 13855
MRRRRTKMPPTRRTRPLPRRVEGLSGREKAPSTARLQRNSPGRTQFSMDDTRSYDIAWLPGDGIGPEVTREALRVLEAVGSAHGFSVTATEHRMGGVALDETGMPLPDSTRDACLESDAVLLGAVGGPKWADNTGDQRPESGLLALRKALGVYANLRPVRVPAALADASPLRPDRVGGTDILFVRELTGGIYFGTPEGRTDDGARSTMAYSDDEIERIAHVAFQRARRRDGNVTSVDKANVLEVSELWREVVTEVHDDCPDVTLRHLYVDNAAMQVVRDPRQFDVVLTGNLFGDILSDLAAALPGSLGLLPSASVGGTVGLFEPVHGSAPDIAGQDVANPTAAILSAALLLDEVGETAAADAVRHGVDAALDAGFRTADLAADNEEDASTSAFGREVATRAADSVPQNAPTP

SEQ ID NO: 22828 - protein, 478 aa, Oryza sativa Japonica Group
MMPHSGVVDAAAKGVKLGGGGGGALMVRRVASGKLLSASSHLLFRATILATLCLVCLFTVHYPSLLSHSFHLSSAAAAANGKHRAASRSSHRSLLGSSAAVAYGGAAWEKEVRRSAAPRRDGGLSVLVTGAAGFVGAHCSLALRARGDGVVGLDNFNSYYDPSLKRARQRLLASRGVAVLDADINDAALLERLFDAARFTHVLHLAAQAGVRYAMRAPQTYVASNVAGLVSVFEVAAKHADPQPAIVWASSSSVYGLNTDAPFSEEHRTDRPASLYAATKKAGEAIAHAYNHIYGLSITGLRFFTVYGPWGRPDMAYFSFARSIVAGEPITLFRTADGADARRDFTYIDDVVKGCLGALDTAGESTGTKSGKKRGPAPLRVYNLGNTSPVPVTRMVAILEKLLGRKANKRVVTMPSNGDVPFTHANVSHAARDFGYRPATPLDAGLRRFVDWFVHYYKLDTAKIAKGKRKSMAMSAAS

SEQ ID NO: 22829 - protein, 364 aa, Bacillus subtilis subsp. subtilis str. 168
MKRRLVLENGAVFEGEAFGSLEHNMGEVVFNTGMTGYQEILSDPSYCGQIVTLTYPLIGNYGINRDDFESITPFVKGLIIKELCELPSNWRSAYTLDEYLKMKNIPGLQGIDTRKLTRMIRTAGALKGTFASSDEDIEAVLKRLNETELPRNQVSQVSAKTAYPSPGRGKRIVLVDFGMKHGILRELNKRKCDVIVVPYNITAEEVLQLKPDGIMLSNGPGDPKDVPEAIEMIKGVLGKVPLFGICLGHQLFALACGANTEKMKFGHRGSNHPVKELATGKVALTSQNHGYTVSSISKTELEVTHIAINDDTIEGLKHKTLPAFTVQYHPEASPGPEDANHLFDRFIEMIETTEKEGEAVCQNA

SEQ ID NO: 22830 - protein, 362 aa, Erythrobacter sp. SD-21
MAKAAILEQVGGLTIGEVELADPAPHEVLIDTKACGLCHSDLHFIDGAYPHPLPAIPGHEAAGVIRAVGSEVKTVKPGDHVVTCLSAFCGHCEFCVTGRMALCMGADTRRPQTAAPRIMRADGSAPVAQMLNLSSFCEQMLIHEHACVAIDKDMPLDRAAVIGCAVTTGAGAIFNACSVVPGEAVAVVGCGGVGLAAINAAKITGAGKVIAIDPIPEKRALAETLGATHTVDAMADDAVEQVMKISGGGVHHAIEAVGRQASADLAVKILRRGGTATILGMMPLDCKVGLGAMDLLSGKKLQGAIMGMNHFPVDLPRLVDFYLRGLLDLDTIIAERIPLEKINEGFEKMKQGTSARSVVVFD

SEQ ID NO: 22831 - protein, 283 aa, Erythrobacter sp. SD-21
MRFDGKTVIITGAASGIGAQAVQLFASEGAVVYASDIDDEGGKTLEQETEGEVRYRHCDVCSPEDIRQLMDGAAAETGGIDTVFNNAGAGGTRAPIDEVEPEDWDRTMDLLLRSVAFGIRYAVPHMKGRKGASIVNVSSVAAVGPGYSPTTYAVAKAGVLHLTKCAATDLARHGIRVNAVQPGFINTNIFTSSMDMPEDMVHVAKAVIAQMSSNAQPVARGGQPRDIAEAVAFLASDAASFMTGASMLVDGGITLGPRHSWDPDTPTMFEALEAMEKQAQSGG

SEQ ID NO: 22832 - protein, 543 aa, Oryza sativa
  misc_feature (144)..(144): Xaa can be any naturally occurring amino acid
  misc_feature (402)..(402): Xaa can be any naturally occurring amino acid
MAPLPAAATATASSAATPADDEAHSLLPSTPSNEEDDDDLEERAYEATEKVIVSISDFPDADDDEEESGLATSTAASGIPPFSWRKLWLFTGPGFLMSIAFLDPGNLEGDLQAGAVAGDTLLWLLLWATSMGLLVQLLAARVGXVATGRHLAELCRDEYPSWARRALWLMAEVAMVGADIQEVIGSAIAIKILSRGFLPLWAGVVITALDCFIFLSLENYGVRKLEAVFAILIATMAVSFAWMFTDTKPNMKNLFIGILVPKLSSRTIRQAVGVVGCVIMPHNVFLHSALVQSRKIDPNKEHQVREALRYYSIESTIALAVSFMINLFVTTVFAKGFYGTKEAGNIGLENAGQYLQEKFGGGFFPILYIWGIGLLAAGQSSTITGTYAGQFIMGGFLNLKLXKKWIRSLITRSFAIVPTIIVALFFDKSDSLDVLNEWLNVLQSIQIPFALIPLITLVSKEKVMGVFKIGRNTQAVTWTVATLLITINGYLLLDFFSSEIRGLLSGSILCVAVLAYASFVLYLILRGTELPNQIITTIRKSFS

SEQ ID NO: 22833 - protein, 224 aa, Pseudomonas fluorescens PfO-1
MQPFVIAPSILSADFARLGEEVDNVLAAGADFVHFDVMDNHYVPNLTIGPMVCAALRKYGVTAPIDAHLMVSPVDRIVGDFIEAGATYITFHPEATLHVDRSLQLIREGGCKSGLVFNPATPLDVLKYVIDKVDMVLLMSVNPGFGGQKFIPGTLDKLREARAIIDASGRDIRLEIDGGVNVNNIREIAAAGADTFVAGSAIFNAPNYQEVIDKMRSELALARP

SEQ ID NO: 22834 - protein, 338 aa, Burkholderia xenovorans LB400
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 22835 - protein, 644 aa, Coprinopsis cinerea okayama7#130
MTTVAEGPKLTTERVPIKNKVCLMCVLHNIICEESLNWTNGCVVNSVHDGWGIAPKEGMEGNAIEAGETHFMDTIAKDHSYRTLRASGTAVGLSEGLMGNSEVGHLNVGAGRVVWQDIVRIDVAIKKKQFHENPTILEACKRAKEGTGRLHFLGLISDGGVHSHITHLFALLETAKEQGVPEVYIHFFGDGRDTAPRSATKYIQQLGEFTDEHKVGELATIIGRYYAMDRDKRWERIKLAVLGLTTGKPEEEGKSFESVQKEEGWKGAVTVVDENYKKDVTDEFLKPIVVNGEKGRVRDGDTLFFFNYRSDRMREISSVFGGLEEIEGLTVPKDLGIFTMSQYKKEFPFKVAFPPQAMTNVLAEWLAKKGLRQAHVAETEKYAHVTFFFNGGVEKQFEGEDRFMIPSPKVATYDLDPKMSVHGVAEKVAELLDKNEYDFVMCNFAPPDMVGHTGVYDAAVTAITETDKAVGTIYKAAEKNGYILLITADHGNAEQVGRGTVGAGPGIVSWGLGVGLDTLACRPCCGARGDELPAVDGALVTAQSVALKGAIEWQMRRMKDPKTGNPHTAHTTNPVPFIMTGNPKGEKGDAKTLKFADLPEAKPAGEDEAEDDSPALADVAPTILDVMGLDKPEDMSGKSLLAKD

SEQ ID NO: 22836 - protein, 469 aa, Enterococcus faecalis
MAEQTDLLILGGGTGGYVAAIRAAQKGLNVTIVEKYKLGGTCLHKGCIPTKALLRSAEVFDTLKQAASFGIETEAASIDFSKIQQRKEGIIEQLHKGVEGLCKKNKIKILAGEGAILGPSIFSPVSGAVAVTFNDPTREEEIIVPKNVIIATGSSPKTLPNLPLDEEFILSSDGMLELEELPESIAIIGGGVIGVEWASLLNSLGVNVTIIEFLDRLLINESATISKELKKRLEQRGINILLGSKVQEAKVTGQKVQVEVAGQESLTVDKVMVAIGRQPNINKLGLQNTSVKYTDKGIEVNEFYQTTEGHIYAIGDCIDTLQLAHVAMKEGELAVQHLLDETVEPLNYTNVPRGVYTNPEIASVGYTRETLPADKEVVIGTFNFNGNGKSLVYGETDGFIEVIRDKKTDDLLGVSMIGPHVTDLIAEASTAMYLDAAPIEIGEAIHAHPTMTEVLQEAALDTYGLAIHK

SEQ ID NO: 22837 - protein, 420 aa, Crocosphaera watsonii WH 8501
MTAIQEKTLASKVRKDFPILHQEIHGKPLVYLDNAATSQKPVTVLDALQNYYGKDNANVHRGAHSLSIRATEAYEGSRDKIAQFINAASRQEVIFTRNATEAINVVAYSWGLHHLQPGDEIITSVMEHHSNFVPWQMIAKQTGAVIKYVPLTDNEDFDLEEFKSLLSEKTKLVTIVHVSNTLGCINPVEEVIKLAHEKGVKVLIDACQSVPHMAIDVQAMDCDWLVASGHKMCGPSGVGFLYGKQEILEEMPPFLGGGEMINEVFFDSFTCGELPHKFEAGTPAIGEAIALGAAVDYLTDIGMDKIHACEEELTAYLFRKLADIPNLKIYGPLPTPEGKGRAALAAFNIEGIHGSDLSTLLDQEGVAIRSGHHCTQPLHRLFDASGSARVSLYFYNTYDEIDQFVMVLKETIDFFTNIMG

SEQ ID NO: 22838 - protein, 498 aa, Mycobacterium avium subsp. paratuberculosis K-10
MPKAQDWEETLADLQRRRQHAFDMGGPERLDKHRNKGKLDARARIEYLLDPGTFRELGTLVGGEIAADGLVVGSGEINGTPVMLGAEDFTTLAGSIGPGGNSKRYRIAELALRDKIPLVMLLEGAGFRPTGGHYGRTPTDLLAQAQCSGRVPTVAAVLGPSAGHGALVAPVCDFRIMSRQGAIFTAGPPVVKESTGEDISKEDLGGPDVALPSGVIHNVAENDEAALDDVRRYLSYFPPSAWSYPPSLPPGDAAMPRPTPELLDIVSRDNRRVYDMRAVLDVVFDSPDWFEVQPQFGKAIICALAHLGGHPVAVVANQPQVLAGSIDADAADKAAHFIMVADSFHLPIVFLADNPGMLPGSRSERSGVLRAGARMFAAQTAATTLKLHVTLRKAYGFGSMVMSLLGFDHQVATFAYPGATMGAMSAAALSRASHAGEDLSTKLRNAELQASYRSAEHMGFDELIDPRETRDALLASLRRGLSSRQAAAEPVSRTVIMP

SEQ ID NO: 22839 - protein, 297 aa, Glycine max
MAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFTVEQVDNLFYATFTKYNDDEL

SEQ ID NO: 22840 - protein, 432 aa, Enterococcus faecalis
MATKEIKMPHLGESVTEAAIVQWLVKPGDSVKRYDPLMEVVSDKVTTEVPSDFEWCSKRISDFSRYRVPIGTAVMTLETEETTEKTEVATLAPVKEASAEQAQEHETVATTSTATSHQKNNGRYSPAVLKIAQEKKIDLTQVTGTGRDGRITRKDVTNFTPTQARTPEKTVSPGTSPSISEEPVASQNESAATASPTETSPDKIVSADPVRKAIAKKMVQSVNEIPHAWLMVEADVTNLVQLRNSLKDEFKQQEGLSLSFFPFFAKAVIQALKKNPKINTSWDDGSIIYHKDVNLSIAVTTDEHLYVPVIQQADNYSIAGLAKEINRLAQEVRQGTLASKEMQGGTFTLNNTGTLGSVQSMGIINHPQAAILQVESINKRLVPTADGGFKVADMVNLCLSIDHRILDGQQAGKFLRDVKDNLAKYNADTDVY

SEQ ID NO: 22841 - protein, 384 aa, Zea mays
MTMKASMKPYCVAIIIQLIYTGMFVISRAAFTHGMNTYVFIFYRQAVGSLILLPTALLQRKNARPPVSLGVLVKLFFCALIGITVGVNLYHVSLKFTTATVASAADSSLPAVTFFLAVLLRMERVKLRSSSGIPKVAGVALCLAGVFPIALYTGPSVSPINHHRAFASQDPAPKPVVVPRGVWIKWTLLMVVANMCWSLWIICQAAVQKDYPDKMVVTVTQCLLSTAQSFVVAVVAERDFSKWKLRFDISLLAVLYSGVMVTGVSYYLQTWCLEMRGPMFFATWTPLCFVFTIFCSSFFLGEIVHLGSILGGILLVASLYTMLWGKSKEDKTDDATDDIEKCGEDNKSAESCPGEQQRQRTTATAAEVKESTLIGSADLRVQEH

SEQ ID NO: 22842 - protein, 354 aa, Thermotoga maritima MSB8
MKIAVLPGDGIGPEVVREALKVLEVVEKKTGKTFEKVFGHIGGDAIDRFGEPLPEETKKICLEADAIFLGSVGGPKWDDLPPEKRPEIGGLLALRKMLNLYANIRPIKVYRSLVHVSPLKEKVIGSGVDLVTVRELSYGVYYGQPRGLDEEKGFDTMIYDRKTVERIARTAFEIAKNRRKKVTSVDKANVLYSSMLWRKVVNEVAREYPDVELTHIYVDNAAMQLILKPSQFDVILTTNMFGDILSDESAALPGSLGLLPSASFGDKNLYEPAGGSAPDIAGKNIANPIAQILSLAMMLEHSFGMVEEARKIERAVELVIEEGYRTRDIAEDPEKAVSTSQMGDLICKKLEEIW

SEQ ID NO: 22843 - protein, 185 aa, Photobacterium sp. SKA34
MINTEIKPFSATAYKEGKFVEITEQDVLGKWAVFFFYPADFTFVCPTELGDLADHYAELQERGVEVFSVSTDTHFTHKAWHDSSDTIGKINYYMVGDQTGNITNNFNVMREGQGLADRATFLIDPQGVIQAMEITAEGIGREADDLMRKVKAAQYVAAHPGEVCPAKWKEGEATLTPSLDLVGKI

SEQ ID NO: 22844 - protein, 1634 aa, Shewanella oneidensis MR-1
MKLKKISIMTFAALYATGIGTLVANPLDRNQAEQKLIGIKLAPEQILANKNKPTHPALNRADRPGQIGMNVHRAVNGSSHKAPFAWEKDIDGTHTYIIQLMDAPVSLYQGDRPEFAATSPRSNQPAIRSNERFGTIDLKSNTVKNYQAFLTRSQDDTASQIKRVAPDAEIKRRFNVALNGMTMVLTQEQAAEVAKLPNVKVVTRAKEYQLFTDVGPKHIGADMIWQGTSTPDGVAMRGEGIIAGIIDTGINSDHPSFAAVSADGYKHVNPLGEGKYLGDCQEYPLMCNSKLIGVRSYDIITDTYKDPIFQPDLPPWEVDYKRPPNGEDYNGHGSHTASTVAGNVLYNVPFKLNGTDEKSDGFDTSLVFPEISGVAPRANIIAYQVCYPGGGSYGETFGGCPGDALVAAIEDAIIDGVDVINFSIGGLENLPWYDAVEMAFLAARESGISVAASAGNWGRYGPGYIDHVSPWLTSVAASTHGRQIEPVEGKLSFVGENAPEDMTGYAVTGDITGNLVDAAAHNDPLCLQPFPAGTFKSDDVVICKRGENGRVQKGINVAAGGAGGIILYNAVSFDDGTGANSLSLNPFPIPGMHIDAASGNQLVKWVANATAPTVTITAGKIITTEREADVLADFSSRGPSHTNPNVMVPNVSAPGVDVFAAYSDEMPFNLYPSPSDYVAISGTSMSGPHVAGALALLTQAHPQWTPAMIQSALMTTAVLGKAPTYENPPKLVDATFYDMGSGVINVARAVKAGLVMDENGDNYRAANPMEGGDVTALNVPYLVNAECKSSCTWMRTFTATTDGEWNVRATEITTEGAPFLELSVYPQTIKLKAGEQQSIMVTAKILDVTSVNANSSSNEVFGKIDLKPTDASLPAQYLPVMARFTGSSLPEIVTGKIHRDTGTMLTPELMTKEISELNVKVSGLTAGKVTEHKLSAAYVKFRDPETLVNNPGIVLQFFDVPEGTRRIVWEEVSADKSASTSLDIGMDLNNNGKVEWYDEAICYSYTDVTDYCAINDPTPGRYWVMLGNFKRPWGDEIDTKDNIKASLAIISDTDTKQLNVTGLASTNGIDPYQLQMNWSATGSKAGDRLYGLVEVGNGAQNVGSIGKMAVHLVHEGDDVSITTSQQQAKEGDVVEVKMVMAPNLLGLERDVNIALTLPEGLQLLPDTLKANSNNQDLKAGLTVAAQQITLKAMQQASNAQKRQYTFTTSETDESCRIPIGSNPYYLDLFTEAGIESETAIAGRVNDTVTVPLSTFGIDRIPLYNNPEEYSHKDTLSISPGGFIQLDQLPLFWAAHYPMEEQYFPDTVIAPLWRGDGITIPEYNMDSESFDGVSLAVTNDRRYLIVEWDNMRQEFAFGVNHDPDYDARYSFELLASTQLNFAPGEHEFIFAYDKLTGNKAHLGSIGLHGYHGPRGTFGPAYGYIGDGFAFNDLDKKIAEGLVVCANYTGPEATAIELSFSARVGAKAVGQDLQIIAKSDYTGSNSMTSSGSFKVPSNLAIGALGNMSVAENTSISFEVLVQDKENTANGIQVTGAHITSVVNGNKVTITPEKDWHGTTTVTVKAFDKVYQNDMVQTSFNLVVNSDGVEPTPPTPPTPPTPPVEETKDSSGGSLGWLAVLMLGLMAVSRQKWNVNK

SEQ ID NO: 22845 - protein, 392 aa, Thermotoga maritima MSB8
MSKKALLALEDGSFFFGQSLGAEGETFGELVFNTGMTGYQEVLTDPSYTGQIVVMTYPEIGIYGVNDEDVESDGIKVAGFVVYRSVDTPSNWRATMSFPDYLKKYNIVAIEGVDTRALTRKIRVKGAMKGAISTVDLDPDSLVKRVKESPSIVGRDLAGLVSPKEVIVENPEGDFSVVVLDSGVKWGILRDLKRVGAKVMRVPYSVDIDDIKKLNPDGVLISNGPGDPAALLKTIRLIKDLLKEEIPLAGICLGHQLLGLAVGGRTYKMKFGHRGINHPVKDLRTGRVLITTHNHGFAVDPKSFGLPELGSEDQDANVLTKNLQKISVLEGISPQGIKVEITHISLNDGTMEGMRLVDYPAFSVQYHPEASPGPHDAKYFFEEFKRLIKEVR

SEQ ID NO: 22846 - protein, 779 aa, Ostreococcus tauri
MKDYSCARDRDEREGAAAERAYGEFVREARRWTSYDPESPNGQRPPWEESLETAIREGPWPCWDSNIPESDFVDEPTFTSFASAPEKYDPFKERVMAHKARVRRENVEKMKKTREEVKAQRFMSLAEDVRLKNKPEDDESAWDHEKIVDLINFPDDIRAKMMNCSVEIYDPRVPYDFSGMGAPPPTTEEFLESIGRLQPEGESDLDRVAKIAAKYGSKVPELVEEDPAAILQTRSDYELQSAMDIGDDGEIASEEISDLEFSLKRYHRFPSSVGTASTMEEPSLERSSTSHPGSYVSMSANRSLRLAYSSGSSLIGPLGTSMFASLELSVSTCSDRRTFGTTTWVAGRLISIFANASSAFSIAVCLATVALSVPSLKEPAVDACSITASVTTSSRPLASLHSLSSGRYVDGSIVNVALASLAVRSLDSIVPLFSLTKSIKTSSFAIGTDAENRISARRIGKIVCNFGSASNACCFALLFGSIEKCMSRSALSIIPGGYGIFVEGFTHFSASVVTQSRNALSASALRSSSLTLPERFHEFIVPRHHALAHVRVHLGRLQDVIHVLFVPSTKAQHGVLVTRDLKPRAVRLQSHHGDVGELLDSHRLEHGRQRARADVDDASFADRGVDRALERHRRVRGTIEGNSINQSIDTARGSRGIIMLPLTLLKTSCGRPMLVELKNGETYNGTLASCDTWMNVHLKEVICTSKDGDRFWRMEECYVRGNTIKYVCVPDEVLDKVREEMKNRPQRESRGDGGRGGRGGRGRGGRGGRGRGRGDADES

SEQ ID NO: 22847 - protein, 326 aa, Triticum aestivum
MAAPIPREWVGLQQFPAATQTKLHELLGKLKEENVSTLTILVMGKGGVGKSSTVNSIVGERVANVSAFQSEGLRPMMCSRTRAGFTLNIIDTPGLIEGGYINEQAVEIIKRFLLEKTIDVLLYVDRLDTYRMDTLDEQVIRAITNSLGKAIWRRTLVVLTHAQLSPPDGIDYNDFLARRSESLLRYIRSGAGIGKREYADFPLPIALAENSGRCKTNENGAKILPDGTPWIPNLMKEITIVVSNGSKSIHVDQKLIDGPNPNNRWKKYIPLILAVQYFFVVKGIRRAIHSDISNGKLDDWEQRYRDLVGSGNPVDQKVSSSRNPKA

SEQ ID NO: 22848 - protein, 322 aa, Bacillus thuringiensis
MNAMKILVTGAAGFIGFHLTKRLLAQNFHVIGVDSINDYYDVSLKKHRLKILEKKSNFKFYKIDISNKENLNQIFKEQIVHIVINLAAQAGVRYSIENPDSYVNSNLVGFVNILEACRQYNVEHLIYASSSSVYGANTSIPFSTKDSVDHPVSLYAATKKSNELMAHTYSHLFNIPTTGLRFFTVYGPWGRPDMAYYSFTRNIIIENNTIRVFNNGDMRRDFTYIDDIIEGIIRLIGNPPQYNEKWDKANPGLSSSYAPYKIYNIGNNIPIKLMDFIHILEKLIGKKAKIEFLPMQPGDVKETYADISRICRLIWASNLQQQ

SEQ ID NO: 22849 - protein, 423 aa, Physcomitrella patens
MASATAGIINSTNMIGGGIAPTKAGSSGVELLPKEMHDMKLRDDKVDHSDDKEIEASIVDGNGTETGHIIATTIGGRNGQPKQTISYSAERVVGTGSFGIVFQAKCIETGETVAIKKVLQDKRYKNRELQIMRLLDHPNIVALKHCFFSTTDKDELYLNLVLEYVPETVYRIAKHYNRMNQRMPLVYVKLYTYQICRSLAYIHNGIGVCHRDIKPQNLLVNPHTHQLKLCDFGSAKVLVKGEPNISYICSRYYRAPELIFGATEYTTAIDIWSMGCVMAELLLGQPLFPGESGVDQLVEIIKVLGTPTREEIKCMNPNYTEFKFPQIKAHPWHKVFHKRMPPEAVDLVSRLLQYSPNLRCNALEACVHPFFDELRDPNCRLPNGRPLPSLFNFKTQELKGATPDILQRLIPEHARKQNPMLAL

SEQ ID NO: 22850 - protein, 371 aa, Brassica napus
  misc_feature (228)..(228): Xaa can be any naturally occurring amino acid
  misc_feature (234)..(235): Xaa can be any naturally occurring amino acid
  misc_feature (238)..(239): Xaa can be any naturally occurring amino acid
  misc_feature (241)..(242): Xaa can be any naturally occurring amino acid
  misc_feature (246)..(247): Xaa can be any naturally occurring amino acid
  misc_feature (249)..(249): Xaa can be any naturally occurring amino acid
  misc_feature (251)..(251): Xaa can be any naturally occurring amino acid
  misc_feature (266)..(266): Xaa can be any naturally occurring amino acid
  misc_feature (274)..(274): Xaa can be any naturally occurring amino acid
  misc_feature (277)..(277): Xaa can be any naturally occurring amino acid
  misc_feature (280)..(280): Xaa can be any naturally occurring amino acid
  misc_feature (283)..(283): Xaa can be any naturally occurring amino acid
  misc_feature (286)..(286): Xaa can be any naturally occurring amino acid
  misc_feature (288)..(288): Xaa can be any naturally occurring amino acid
  misc_feature (294)..(294): Xaa can be any naturally occurring amino acid
  misc_feature (301)..(301): Xaa can be any naturally occurring amino acid
  misc_feature (305)..(305): Xaa can be any naturally occurring amino acid
  misc_feature (308)..(308): Xaa can be any naturally occurring amino acid
  misc_feature (322)..(322): Xaa can be any naturally occurring amino acid
  misc_feature (326)..(327): Xaa can be any naturally occurring amino acid
  misc_feature (331)..(331): Xaa can be any naturally occurring amino acid
  misc_feature (334)..(335): Xaa can be any naturally occurring amino acid
  misc_feature (363)..(363): Xaa can be any naturally occurring amino acid
RGKKRFNIALLPGDGIGPEVISVAKNVLQQAGSLEGLEFNFQEMPVGGAALDLVGVPLPEESFAAAKQSDAILLGAIGGYKWDNNEKHLRPEMALFYLRRDLKVFANLRPATVLPQLVDASTLKREVAEGVDMMIVRELTGGIYFGEPRGIKTDENGEEVGFNTEFYAAHEIDRIARVAFETARKRRGKLCSVDKANVLDASILWRRRVTALASEYPDVELTHMYVDXCAMQLXXDPXXFXXIVTXXIXGXILSDEASMITGSIGXLPSAGLGXAGXGLXERXHGXAXDIAGQXKANPLAXILSXAMXLKYGLGEEKAAKRXEDAXXDTLXKGXXTGDIYSPGNKLVGCKEMGEEVLKSVDSXKLQLLFKF

SEQ ID NO: 22851 - protein, 571 aa, Marinobacter sp. ELB17
MSEQEIRVPDLGGADEVEVIEILVSAGDSVAEEDPILTVETDKASVELPSPGAGKIVKIIVKVGDKIKEGDVVGTLSSDGAGSSDGASDGASNENSAPEPEPKAQSDDAPAKSDDSTGKPAPQKKSGGTRTEIVKVSGLDGFDDIPIIELNVSEGDDVDVESALVTVESDKATMEIPSPFAGKIGKILVKEGDKISEGDDLLEMIITDDGADDGDDADDSAPADSSDVGKKEPAEPEQPAAASDTKAKPKPKPADTGSVTYEAPAAGSKVHAGPAVRKLARELGADLARVKGSGPKGRIVKDDVHGYVKAQLQQAQQGAVVPGAGSSGIPGVKLPDFSQFGEVEREGMSRMMSVTALNMHRSWLNVPHVTQFEDADISDMEDFRKSLKPLGEKKGVKMTPLPFMLKACAAALAELPQFNVALDMDRKEVVHKKYIHIGIAVDTPHGLMVPVIRNVDQKGLWELAAESAELAQKARDKKLKPAEMQGACFTITSLGGIGGTAFTPIVNTPEVAILGVSKAAMKPVWDGQAFQPRLMLPLSLSYDHRAVNGADAARFTSALARLMGDIRTLLL

SEQ ID NO: 22852 - protein, 270 aa, Pisum sativum
  misc_feature (1)..(1): Xaa can be any naturally occurring amino acid
  misc_feature (45)..(45): Xaa can be any naturally occurring amino acid
  misc_feature (79)..(79): Xaa can be any naturally occurring amino acid
  misc_feature (106)..(106): Xaa can be any naturally occurring amino acid
XASQQQTVREWSGINTFAPATQTKLLELLGNLKQEDVNSLTILVXGKGGVGKSSTVNSIIGERVVSISPFQSEGPRPVXVSRSRAGFTLNIIDTPGLIEGGYINDXALNIIKSFLLDKTIDVLLYVDRLDAYRVDNLDKLVAKAITDSFGKGIWNKAIVALTHAQFSPPDGLPYDEFFSKRSEALLQVVRSGASLKKDAQASDIPVVLIENSGRCNKNDSDEKVLPNGIAWIPHLVQTITEVALNKSESIFVDKNLIDKLAAADHHHHHH

SEQ ID NO: 22853 - protein, 521 aa, Pleurotus ostreatus
MVLSTKLAALVASLPFVLAATKKLDFHIRNDVVSPDGFERRAITVNGIFPGTPVILQKNDKVQINTINELTDPGMRRSTSIHWHGLFQHKTSGMDGPSFVNQCPIPPNSTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVHANQTIDNYWIRAPLTGGNPAGNPNLDISLIRAILRYKGAPAVEPTTVATTGGHKLNDAEMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRTSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 22854 - protein, 369 aa, Magnaporthe grisea
MFDIFAKLLSSIASFLFPLFASYKALKTTDPAQLTPWLMYWVVLACALLVESWTEWFLCWIPFYAYIRLLFLLYLILPQTQGARVLYQDYIHPYLQENEDHIDDFIASAHDRAKAMGVMYLRQLIEYVKVNVLGMAPSRVEEQQQPPQAQGYGGQQSSVTQNLLARFALPSARWNGAGGDSNGNSGAANDFYGMLAGAVGAAMSSAGGARDNQQGPGVSRSVIPSHVNEADKASFIATQRERLTTLLAALDREAAGVQSGASSASTPVPNSSSQGFFRVRDVVEGLADTAAGLTKSRSETDFENIDAMSGTEEVGGDEDGSVRRRVQGAGGSWMPWGWGGAQSPAAGDAANPDRSNVGHSSGVNTNAGQ

SEQ ID NO: 22855 - protein, 409 aa, Haemophilus influenzae R2866
MTIEILVPDLPESVADATVATWHKKLGDTVKRDEVIVEIETDKVVLEVPALSDGVLAEVVQAEGETVVSKQLLGKISTAQEGDVSSATLKATNEPTPSDRQNAAIENSHNHNADQSPAIRRLLAEHDLQADQIQGSGVGGRLTREDIEREIAKRQAQQVKQEAATEQNTISTVAYSARSEKRVPMTRLRKRIAERLLEAKNSTAMLTTFNEVDMQPIMTLRKTYGEKFEKQHSVRLGFMSFYIKAVVEALKRYPEVNASIDGDDVVYHNYFDISIAVSTPRGLVTPVLRDCDKLSMAEIEKQIKALAEKGRDGKLTVEDLTGGNFTITNGGVFGSLMSTPIINPPQSAILGMHAIKERPIALNGQVVIRPMMYLALSYDHRLIDGRESVGFLVAIKELLEDPTRLLLEI

SEQ ID NO: 22856 - protein, 144 aa, Triticum aestivum
  misc_feature (2)..(2): Xaa can be any naturally occurring amino acid
  misc_feature (6)..(6): Xaa can be any naturally occurring amino acid
  misc_feature (10)..(11): Xaa can be any naturally occurring amino acid
  misc_feature (17)..(18): Xaa can be any naturally occurring amino acid
  misc_feature (24)..(24): Xaa can be any naturally occurring amino acid
  misc_feature (33)..(33): Xaa can be any naturally occurring amino acid
  misc_feature (49)..(49): Xaa can be any naturally occurring amino acid
  misc_feature (58)..(58): Xaa can be any naturally occurring amino acid
  misc_feature (69)..(69): Xaa can be any naturally occurring amino acid
  misc_feature (71)..(71): Xaa can be any naturally occurring amino acid
  misc_feature (75)..(76): Xaa can be any naturally occurring amino acid
  misc_feature (90)..(90): Xaa can be any naturally occurring amino acid
  misc_feature (92)..(92): Xaa can be any naturally occurring amino acid
  misc_feature (94)..(96): Xaa can be any naturally occurring amino acid
  misc_feature (99)..(102): Xaa can be any naturally occurring amino acid
  misc_feature (109)..(109): Xaa can be any naturally occurring amino acid
  misc_feature (117)..(117): Xaa can be any naturally occurring amino acid
  misc_feature (123)..(125): Xaa can be any naturally occurring amino acid
  misc_feature (129)..(129): Xaa can be any naturally occurring amino acid
  misc_feature (131)..(131): Xaa can be any naturally occurring amino acid
  misc_feature (133)..(134): Xaa can be any naturally occurring amino acid
MXEQTXIMIXXDGVQRXXIGEVIXRFEKKGFYXKGLKLQNVEKSFAEQXYSDLSSKPXFAGLVEYIVSXPXFSMXXEGKSVVATGRKIIXAXNXXXSEXXXXRGDFAVXIGRNVIHXSDSVEXXXKEIXAXWXXEEIAGEEQPL

SEQ ID NO: 22857 - protein, 506 aa, Bacillus halodurans C-125
MVYKRPNEEGAVVSFKKRYDNYVNGEWTPPVKGQYFENVTPVTGEVFCEVARSTAEDIDLALDAAHAAKEQWGKTSPAERANLLNKIADRMEENLEKLAVAETWENGKPVRETLNADIPLAIDHFRYFAGAIRAQEGTLSQIDNDTVAYHFHEPLGVVGQIIPWNFPILMATWKLAPALAAGNCVILKPAEQTPASIFVLLELIEDLLPKGVVNIVNGFGVEAGKPLASSSRVAKVAFTGETTTGRLIMQYASENLIPVTLELGGKSPNIFFDDVMAKDDAFLNKAIEGFVLFALNQGEVCTCPSRALIQESIYDTFMERALARVQAIKQGNPLDPNTMIGAQASQEQLEKILSYLAIGKEEGAEVLAGGERNHLPGELANGYYVSPTVFKGTNDMRVFQEEIFGPVVSVTTFKDAEEALAIANDTLYGLGAGVWTRDMNKAYRFGREIQAGRVWTNCYHAYPAHAAFGGYKKSGIGRETHLMMLSHYQQTKNLLVSYSEDALGFF

SEQ ID NO: 22858 - protein, 320 aa, Salinibacter ruber DSM 13855
MPRPLMRASSNEHRVAIFGGRSNPALANKIAEAYGTTLGDLSIRDFADGEIYVRFEESIRGADLFIIQSTHPKADNWMELLLLIDAAKRASAERVTAVIPYFGYARQERKDQPRVSIAAKLMANMLTSAGVDRILTMELHAAQIQGFFDVPVDHLYGSTVLTDHVRQFDLDDFVVLAPDVGGLKMARAYAQRLGVDLALIDKRRPRQNEARVMNVIGDVEGKDVLIIDDIVDTAGTLTRAAKALKDHGALKIMAACTHGLLSGPAYDRIENSPLERLMITDTVPLKRPSDCIEVVSVSNLFAKAIRHIYTDRSVSTLFTD

SEQ ID NO: 22859 - protein, 281 aa, Brassica napus
  misc_feature (268)..(268): Xaa can be any naturally occurring amino acid
MACLNAKLLFSFLLVFFPTFTVSTLLFQGFKWESWMKEGGFYNSLHNSIDDLSNSGITHIWLPPPSQSVSPEGYLPGKLYDLNSSKYGSEAELKSLIAALKQKGIKAVADIVINHRTAARKDDHCGYCYFEGGTSDDRLDWDPSFICRGDTNYAGTGNPDTGEDYKPAPDIDHLNPRVQKELSEWMNWLKSEIGFSGWRFDFVRGYAASVTKSYVQNTSPDFAVGEKWDDMKYGGDGKLEYDQEEHRSGLKHWIEEGGGGVLTAFRFXTRKGILQSAVGGE

SEQ ID NO: 22860 - protein, 377 aa, Methanocaldococcus jannaschii
MFINGDVMLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 22861 - protein, 322 aa, Glycine max
MASSSSSGLTFKLHPLVIVNISDHYTRVKSQMNPTHAPPHTTTNNNNANGGDGVVSPPLHPRVYGCVIGVQKGRTVQIFNSFELLYDPSTHSLDRTFLEKKQELYKKVFPHFYILGWYSTGSDAEESDMHIHKALMDINESPVYVLLNPSINHSQKDLPVSIFESELHVIDGIPQLIFVRSSYTIETVEAERISVDHVAHLKPSDGGSAATQLAAHLTGIHSAIKMLHSRIKVLHHYLLAMQKGDVPCENSLLRQVSSLLRRLPAIESGKFQDDFLMEYNDTLLISYLAMLTNCSSAMNELVDKFNIAYDRHSRRGGRTAFM

SEQ ID NO: 22862 - protein, 386 aa, Medicago sativa
MAIHHHHHNHQQLQQHTSSLFDALYCDEEEKWEDDDEGEVVDEGAQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDNGVDYKNQLLNVLKISKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 22863 - protein, 523 aa, Magnaporthe grisea 70-15
MTSTTTTVTSVTPIKTTYSTPAEVDDAHSTLHATFRTGLTKDLAWRRWQLKQLWWMMDENMDRIFDALKADLNRHHFESLFTDIRSVKADIISHLKNLEDWTSTKPINTGIPLGSWLFKARIRKEPLGVAFIMGAWNYPMLLLLQPVISAITAGCCVLLKPSDLSVHSERLLQELVPKYLDPRAIRIVTGGPAETGYMLEKRFNHIFFTGSTKVGHIVAAAAAKHLTPVVLELGGQNPVIVHKTADIDYSARRIAFAKFQNAGQICLSVNHVFVDPEVADEFVERASYWCAKFVEGEARDHLTHIVNTRNFDRLCGLLDATSGKVVQGGGRDRETCYLQPTVVRDVTLSDPLMSEELFGPILPVITATPDEAIRTISSGPSPLALYMFARDDAFVEHVLDRTLSGGVTVNNIAVHVAFDDAPFGGVGDSGHGAYHGRHGVDSFVHRRPVVHIPSWVDRLLGFTYPPYSMDNAGKMTIKNSLGFKKGETMEDQRRVAGRGRLWYATAVGVGGVVAAVGARYLQA

SEQ ID NO: 22864 - protein, 624 aa, Francisella tularensis subsp. holarctica
MELFVHSSNYILLASGLILFFAIVSQFLSWRLKLPSILFLILSGIILGPLSEAIFQTGFKLVDGNVIFGEALSPFVSICVAIILFEGSLSLNFSKIKSVSSVVILLITVGLAITVVLTALFCYYVVGLNLELSMLIGGITCVSGPTVVPPFMRTVRPKKHIANILKWESILVDPIGALVVVFMLAWFVIGGNFANQPNAVSTFIAYMVFVCILGITSGFIFGYLIGLSFRKHYIPEYLKSFFVLAVIVLGFIISDAIMHGAGLLMVTVAGLVMANMKDIKMSDIVSFKENLSIVIISVLFIVLGAEIDFSLFKDYWLDLIEVFLFLQFILRPIVVFLCCLGSKTTFAERVVLGIIYPRGIVAASVAALVAVKIIKSHPELYSEANTLVFFVFMIIVFTVVFQSIVTPYISKALGVTEPEGKGFLIIGGNRFARELAEIFVKNDIEVVITDSSWGNVQKCRQLGLNTYYGSPVSIHADWSINLVGIGAMLGLSTSEYVNAVSAMKYKYEFGSNNVYVLRTAQKESYKGIGAIETNLANLLFDEGVDFNILIEMLNQGATIRSTNITPNYTLEKFFSDNPNAIGLFIIDDNGYAQPFSKNKKIKFESYNLISLRDDKSKDQLCLDV

SEQ ID NO: 22865 - protein, 380 aa, Photobacterium sp. SKA34
MSKRDLYEVLGVARDAGERDIKKAYKRLAMKFHPDRNQGDDESAEKFKEVKYAYEILTDGQKRAAYDQYGHAAFEQGGMGGGGGGFGGGADFSDIFGDVFGDIFGGGGGRRQQRAQRGSDLRYNMELTLEEAVRGCSKEIRVPTLVGCDSCDGSGAKKGSSATTCGTCHGAGQVQMRQGFFAVQQTCPHCHGRGQIIKDPCNKCHGEGRVEETKTLSVKIPAGVDTGDRIRLTGEGEAGEFGAPAGDLYVQVHVKEHNIFQRDGNNLHCEVPVSFTMAALGGEVEVPTLDGRVSLKVPAEMQTGRMFRMRGKGVDSVRGGMTGDLICKLVVETPVNLSSRQKELLQELEETFGGKAASKHKPKSEGFFKGVKKFFDDLTN

SEQ ID NO: 22866 - protein, 62 aa, Brassica napus
MRGILVDWLVEVAEEYTLVPDTLYLTVYLIDWFLNGNYVERNRLQLLGVTCMLIASKYEEIY

SEQ ID NO: 22867 - protein, 424 aa, Physcomitrella patens
MASSTAGAVSGTNMIGGGRAAPTKAGSSGVELLPKEMHEMKLRDDKVDHGDDKEIEATVVDGNGTETGHIIATTIGGRNGQPKQTISYSAERVVGTGSFGIVFQAKCIESGETVAIKKVLQDKRYKNRELQIMRLLDHPNIVALKHCFFSTTEKDELYLNLVLEYVPETVYRIAKHYNRMNQRMPLVYVKLYTYQICRSLAYIHSGIGVCHRDIKPQNLLVNPHTHQLKLCDFGSAKVLVKGEPNISYICSRYYRAPELIFGATEYTTAIDIWSMGCVMAELLLGQPLFPGESGVDQLVEIIKVLGTPTREEIKCMNPNYTEFKFPQIKAHPWHKVFHKRMPSEAVDLVSRLLQYSPNLRCNALEACVHPFFDELRDLNCRLPNGRPLPPLFNFKPQELKGATPEILQRLIPEHARKQNPMLAL

SEQ ID NO: 22868 - protein, 257 aa, Silicibacter pomeroyi DSS-3
MRGTARPMSDRSDKTTHFGFETVPEHEKAGRVQGVFGSVASKYDVMNDVMSMGIHRVWKDAMMDWLAPRPGQRLLDVAGGTGDISFRFLKRAGHGHATVLDLTEPMLVEGRKRAEAERMADSLDWVVGDAMALPFEDNTFDVYTISFGIRNVTRPQEALNEAYRVLRPGGRLMVLEFSQLPNDGLQKLYDLYSFNVIPRMGQLIANDSASYQYLVESIRNFPNQETFLGMVQAAGFGNAKYRNLSMGIAALHSGWKI

SEQ ID NO: 22869 - protein, 581 aa, Acinetobacter baumannii
MARTTWLTATAVATTEKEKYMTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAQVTLIERGTIGGTCVNVGCVPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 22870 - protein, 355 aa, Physcomitrella patens
  misc_feature (131)..(131): Xaa can be any naturally occurring amino acid
FIATTIGGRNGQPKQTISYSAERVVGTGSFGIVFQAKCIESGETVAIKKVLQDKRYKNRELQIMRLLEHPNIVALKHCFFSTTEKDELYLNLVLEYVPETVYRVAKHYNRMNQRMPLLYVKLYTYQICRSXAYIHSGIGVCHRDIKPQNLLVNPHTHQLKLCDFGSAKVLVKGEPNISYICSRYYRAPELIFGATEYTTAIDIWSMGCVMAELLLGQPLFPGESGVDQLVEIIKVLGTPTREEIKCMNPNYTEFKFPQIKAHPWHKVFHKRMPPEAVDLVSRLLQYSPNLRCNALEACVHPFFDELRDPNCRLPSGRPLPPLFNFKRQELKGASPEILQRLLPEHARKQNPMLAL

SEQ ID NO: 22871 - protein, 711 aa, Bacteroides thetaiotaomicron VPI-5482
MNLFEFNLALPITDPTWVFFLVLIIILFAPMILGRLHIPHIIGMILAGVLIGEHGFHVLDRDSSFELFGKVGLYYIMFLAGLEMDMEDFKKNRMKSVVFGLLTFLIPMALGIWSSMSMLGYGFLTAVLLASMYASHTLIAYPIISRYGLSRLRSVNITIGGTAITVTLALIILAVIGGMFKGTVDGLFWVFLVAKVAFLGFLIIFFFPRIGRWFFRKYDDSVMQFVFVLAMVFLGGGLMEFVGMEGILGAFLAGLVLNRLIPHVSPLMNRLEFVGNALFIPYFLIGVGMIIDVRSLFTGGEALKVAVVMTVVATFSKWLAAWITQKIYRMQPNERSMIFGLSNAQAAATLAAVLIGHEIIMENGERLLNDDVLNGTVVMILFTCVISSLVTERSARRFALNEDAQPEDKGAKKAMEQILIPVANPETIENLVNLALVIKDAKQKNGMIALNVINDNNSSENKELQGKRNLEKAAMIAAAADVPVTMVSRYDLNIASGIIHTIKEYEATDVVIGLHRKANIVDSFFGNLAESLLKGTHREVMIAKFLMPVNTLRRIIIAVPPKAEFETGFSKWVEHFCRMGSILGCRVHFFANERTLMRLQQLVKKKFSGTPTEFSLLEEWGDLLLLTGQVNYDHLFVVISARRGSISYDPSFERLPAQLSKYFSNNSLIILYPDQFGDPQEIVSFSDPRGYNESQHYEKVGKWFYKWFKKS

SEQ ID NO: 22872 - protein, 252 aa, Caulobacter crescentus CB15
MSNTSASFGFKDVDASLKAGLVRGVFDRVAKNYDIMNDLMSGGVHRLWKDAVAARLNPQPGEVIIDCAGGTGDMARRFAKMARKAQERRGGPDATINIVDYNAEMIMAGIERGGEPEITWTVGDAQRLPLPDAYADAYVISFGIRNVTDINAALREARRVLKPGGRFLCLEFSRPVTEPLAKAYDAYSFKVIPQVGEWVAKDRDAYQYLVESIRRFPDQRTFAGMIEAAGFKRVTFTNFTGGVAALHQGWAI

SEQ ID NO: 22873 - protein, 238 aa, Bacteroides thetaiotaomicron VPI-5482
MEENNWQQRTELLLGEEKMKRIRASHVLVVGLGGVGAYAAEMLCRAGVGRMTIVDADTVQPANMNRQLPAMHSTLGMPKAEVLAARYKDINPDIELTVLPVYLKDENIPELLDSAKFDFIVDAIDTISPKCFLIYEAMKRHIKIVSSMGAGAKSDITQICFADLWDTYHCGLSKAVRKRLQKMGVKRKLPVVFSTEQADPKAVLLTDDERNKKSTCGTVSYMPAVFGCYLAEYVIKRI

SEQ ID NO: 22874 - protein, 226 aa, Brassica napus
  misc_feature (213)..(213): Xaa can be any naturally occurring amino acid
MAEPTQPLLNDSNSSPPRSLDDTIESYIGSFGWAQFLQATLVSFSGVFDAQQTFISVFTDFEPKWHYTESFCHDSISNICILPKTSWSWDFPPHVSVISEWGLQCSGSFVKGLPESSFFVGCLIGGLILSTLADSSLGRKNMLFLSCLLMSISAMLTVFSPNIWVYAFLRFVNGFGRATIGTCALVLSTELVGKRWRGLVGIMSFFGFMLGFXSLPAMAYMNRGNS

SEQ ID NO: 22875 - protein, 107 aa, Fagus sylvatica
MAKFVATLFLALIALSMLQTMVMASHGHGGHHYDNTSKYGQGSLKSYQCPSQCSRRCSKTQYHKPCMFFCQKCCKKCLCVPPGYYGNKAVCPCYNNWKTKEGGPKCP

SEQ ID NO: 22876 - protein, 186 aa, Brassica napus
  misc_feature (25)..(25): Xaa can be any naturally occurring amino acid
DFKTGHLTLTSPRSMLVAQAIGTAXIGCVVAPLTFFLFYKAFDVGNPDGEYKAPYAIIYRDMAIIGVQGLSALPHNCLELCYGFFAFAVAANLARDFLPEKVGKWIPLPMAMAVPFLVGGSFAIDMCIGSFVVFVWQKVNRKKAEFMVPAVASGLICGDGLWILPSSLLALAKIRPPICMNFTPAH

SEQ ID NO: 22877 - protein, 258 aa, Saccharophagus degradans 2-40
MTMAVSIKTPEEIEKMRIAGRMAAEVLEMIGEHVQPGVTTAELDKICHDYITQVQKAIPAPLNYKGFPKSICTSVNQVVCHGIPSEKKVLKSGDTINIDVTVIFDGYHGDTSKMFFVGTVAPHAHRLVKVTQECLYKGIELVKPGCRLGDIGHVIQTHAQKNHYTVVREYCGHGIGAVFHEDPQVLHYGTPGTGMTLKEGMTFTIEPMINAGKPHTKLKKDGWTVETRDGRLSAQWEHTLAVTATGVEVLTARKEESF

SEQ ID NO: 22878 - protein, 568 aa, Streptomyces avermitilis MA-4680
MRTATLGPAERAESLAGMAERELDVLVVGGGVVGAGTALDAVTRGLSTGIVEARDWASGTSSRSSKLIHGGLRYLEMLDFALVREALKERGLLLERLAPHLVKPVPFLYPLQHKGWERLYAGAGVALYDAMSMAPGHGRGLPTHRHLTRSHALRVAPALKKEALVGALQYYDAQMDDARYVAMLVRTAAAYGAKAANRARVTDFLREGERVVGARVQDVEGGGEYEIHARQVVNATGVWTDDTQAMVGERGQFHVRASKGIHLVVPKDRIHSTTGLILRTEKSVLFVIPWGRHWIVGTTDTPWDLDKAHPAASSADIDYLLEHVNSVLSVPLSRDDVQGVYAGLRPLLAGESDATSKLSREHTVAHPVPGLVVVAGGKYTTYRVMAKDAVDEAVHGLDQRVADCVTEDIPLIGAEGYRALWNARARIAARTGLHVVRVEHLLNRYGSLAEELLDLVAADPSLGAPLQAADDYLRAEIVYAASHEGARHLDDVLTRRTRISIETFDRGTRSAREAAELMAPVLGWDKDQIEREIEHYEKRVEAERESQRQPDDLTADAARLGAPDIVPR

SEQ ID NO: 22879 - protein, 407 aa, Saccharophagus degradans 2-40
MNPDLSKLQPYPFEKLNALKATVSAPADKSHIALSIGEPKHQPPAFALKALTDNLARFANYPSTKGLPELRTAIANWANTRFNLQRATLDAEANVLPVNGTREALFAFAQACIDSSKADAKVLMPNPFYQIYEGAAFLAGAEPVFLNCLPENGFIPDFDAISEQTWQACQLLFICTPGNPTGAVMSRELLEKLIGLADKHNFIIASDECYSELYFDEANPPTGLLEACESLGKTDFKNCVVFHSLSKRSNLPGLRSGFVAGDAHIIDQFFQYRTYHGCAMSVPCQLASIAAWQDEAHVLENRNLYRQKFDAVIEILKDVLPVSTPDASFYLWPKTPIADTDFAQQLFAQQNVTVLPGRFLARDCDGVNPGENYVRLALVAELEECIEAAHRIKAFVQSLNQTLYTNS

SEQ ID NO: 22880 - protein, 328 aa, Zea mays
KKKKKKKKKKKKKVATHASLLLKAAAAKPCFSARAAARIPAPSHRPRPPAGRRLPTTVAALAAAARRFRWPSAAASARGLCAAPHFGGEGMGSDAGAGGRKRRVPAVNGLAKDAPAVNGMRKEEPVAAPPRLLTLPTVLTIGRVAAVPLLISSSFYMEGPWAAMATTGIFLAAAVTDWLDGYIARKMQLGTPFGAFLDPVADKLMVAATLVLLCTKPLESSLLNDGPWLLTVPSIAIIGREITMSAVREWAASQNSKVLEAVAVNNLGKWKTATQMTALTLLLASRDPSLPAQGALVAPGVALLYVSTGLAVWSLVVYMRKIWRTLLK

SEQ ID NO: 22881 - protein, 601 aa, Aspergillus nidulans FGSC A4
MGFLRRRSMMQALLLTIIFSAYAYGANVKTTGQMVSFQVNLTWSDYQPAGIPRKMILANGQFPAPALRLKQGDDVEFLVNNEMPFSTTVHFHGIEQQGTPWSDGVPGLSQRPIPPGESFLYKWRATNYGSYFYHAHSRGQQEDGLYGAIHILADDSIERPFALISEDEQEIQSMRRAESESIPIMLSDVRSLTSAEIWDAEKAMGRDALCANALLVNGKGSVTCLGQQTIDEYTSVAQRGVLGNQSLTDIGCLPPDNLLAQGPWSHNLSAIPPTVFSDCIPSHGLTERFYPDATNRYASFDLVSAALVSTITFSIDEHPMYVYAIDGSYINPIEADGITITNGARYSVLVKLDKPRGDYTIRVVNTGLNQILHGNALMTYHNGIGPIQQHPSTPSIDLVGTPTSNHTLLNESMIIPFAAQDVSRVDVAQTLTLTLERYNASYTWTMGDSSFPLQLEEESPLLFYPQTASKNFTATSKNGTWVDVVFDVANAIQPPHPIHKHSNKFYVLGGGNGKWNYTSVAEAAKHMPESFNFETPQIRDTFATLPAATGPTWLALRYHVVNPGPFLLHCHIQIHQSGGMALALLDGIDEWPEIPEEYQLA

SEQ ID NO: 22882 - protein, 455 aa, Salmonella enterica subsp. enterica serovar Typhi str. CT18
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGGRGRGQNQGGAGRSQQPRRQDSGAAKAKPKPRTGEGKPAGDKARPPRRPRRITPAQ

SEQ ID NO: 22883 - protein, 303 aa, Oenococcus oeni PSU-1
MNKLKELIVDTDPGVDDALALALAFRNSNLKIDLITTVYGNIGVKQSTNNALKLLTFWGKKVPVAAGSKASLLGRNFEARSVHGNNGLGDAKFPAPDKGLLLNTNAVSSIHKLLSNSDHKISILAIAPLTNLAILLKEYPEDRKKISEIIMMGGSWGRGNAGIFSEFNVFNDPEAANIIFQSTIPLTIIPLEIGRMAQINKNTITSIKASGIIGYSISLMFGGYHSGPDRNTFNIYDALTVSYLLHPEFFTLASAFVAVEIGGKYTRGATVIDDRGKLKQPFNAKVAKKVDVEAFSNWFQKQW

SEQ ID NO: 22884 - protein, 547 aa, Zea mays
  misc_feature (495)..(495): Xaa can be any naturally occurring amino acid
  misc_feature (514)..(514): Xaa can be any naturally occurring amino acid
MGEVATMSLEVMKLAAVPKANVDMFVAHRSKRRVVSSAGDSIEKATKLKAARNLDSSFAEVRRGRRDSIRGREGGSSLSQLAMAPAPHNGLNNNHPVAPMDVSVEAGNAGAAEWLDDDGRPRRSGTFWTASAHIITAVIGSGVLSLAWAIAQLGWVAGPAAMLLFAFVTYYTAALLAECYRTGHPETGKRNYTYMDAVRSNLGGVKVVFCGVIQYANLVGVAIGYTIASAISMKAVRRAGCFHAHGHADPCKSSSTPYMVLFGGVQILFSQIPDFDQIWWLSIVAAVMSFTYSSIGLSLGIAQTVSNGGFKGSLTGISIGAGVTSTQKIWHTLQAFGDIAFAYSFSNILIEIQDTIKAPPPSESKVMQKATRLSVATTTVFYMLCGCMGYAAFGDNAPDNLLTGFGFYEPFWLLDVANVAIVVHLVGAYQVFCQPIFAFVERRAAAAWPDSAFVSRELRVGPFSLSVFRLTWRSAFVCVTTVVAMLLPFFGDVVXGLLGAVSFWPLTVYFPVEXTLSVSCLLVSVAAAAGSIADVIAALKVYKPFSG

SEQ ID NO: 22885 - protein, 281 aa, Sinorhizobium meliloti 1021
MHDPIPTIAFPDGRKVPALGQGTWRMGENRAKTADEVRSLQTGLDLGMTLIDTAEMYGDGAAERIVGEAIKGRRDEAFVVSKVLPSNASRAGTVAACERSLRNLGIDCVDLYLLHWRGGYPLAETVAAFEELKKAGKIRAWGVSNFDVDDMEELSAVPDGGNVAANQVLYNLARRGIEFDLLPRCRAQGVPVMAYSPLDEGRLLHDADLIHIAKAHQATPAQVALAFLKTCSGVISIPKTGSPERARENRDAMDIHLTTENLAELDRHFPPPRRKTRLEVI

SEQ ID NO: 22886 - protein, 350 aa, Oryza sativa
  misc_feature (186)..(186): Xaa can be any naturally occurring amino acid
MAFASLSLRLPTPSTAPSSGASSSFLSLPPTLLRQARGGAAASSALVARAASGGSPNPLFNPRADPFLSTLAAASPEELQAAAAGGGRRGDDHLPFLEIFQNAKLMASPAQVERSSSSYSQHRPRRPPPDLPSLLLHGRIVYIGMPLVPAVTELVVAQLMYLEWMNSKEPVYIYINSTGTARDDGXTPLGMESEGFAIYDAMMRMKTEKIRIHTLCIGAAAGHACLVLAAGKKGKRYMFPHAKDSIMPAMIQQPRIPSYGMMQASDVVIRAKEVVHNRNTLVRLLARHTGNPPEKIDKVMRGPFYMDSLKAKEFGVIDKILWRGQEKYMADMLSPEEWDKVAGVRRPDIM

SEQ ID NO: 22887 - protein, 190 aa, Sinorhizobium meliloti 1021
MNAHLQPTGSAYFIAKETELAETHTLSVLVDNEPGVLARVIGLFSGRGYNIESLTVSETEHEAHLSRITIVTRGTPHVLEQIKNQLERLVPVHRVVDLTVRAAGLGHERPIERELALVKVHGSGEHRVEALRLADAFRASVIDANIDHFVFEITGKPSKIEQFIAIMKPLGLIEVCRTGIAAMNRGPQGM

SEQ ID NO: 22888 - protein, 184 aa, Populus trichocarpa
MTRYHSFSVPYHFLAFLVCFILVHASPAAADKPTELVDKVCNQTSNYTLCVEALYSDSRTPDADSYTLAFISFGLAYTNANNIRDYYIAELLKNTSSQDYHYRLETCSHDYLRAVSKLEEAYNDLNSETFFGLAELAGIASEASDHCQDAFKGISSPPLGSRNGDLKRLCEIGAIIAKLFTGSS

SEQ ID NO: 22889 - protein, 309 aa, Microcystis aeruginosa PCC 7806
MVTRGERGVEVRKNENFSLASYLEEKRLIVESALDSSLVIGNPAKIYEAMRYSLLAGGKRLRPILCLATCELMGGSLEMALPTACALEMIHTMSLIHDDLPAMDNDDYRRGKLTNHKVFGEDIAILAGDGLLAYAFEYVATQTLNVPPLQILEVIARLGRTVGAAGLVGGQVLDLESEGKPDISAETLGFIHTQKTGALLETSVVSGAVLAGAKGEDIAKLARYAQNIGLAFQIIDDVLDITATKEELGKTAGKDLQAQKATYPSLWGIEGSRQQAQHLIDSAINELSSYDEAAEPLRAIAEYIVNRKN

SEQ ID NO: 22890 - protein, 378 aa, Burkholderia xenovorans LB400
MTLASTPEIIAELKAGRMVILVDEEDRENEGDLVIAAEFVTPEAINFMARYGRGLICLTLTQERCKLLNLPLMTYRNGTQYGTAFTVSIEAAEGVTTGISAADRARTIATAVAPDAKAEHIVQPGHVFPIMAQPGGVLVRAGHTEAGCDFTALAGLTPAAVICEVINDDGTMARLPDLMEFAKEHGLKIGTIADLIHYRSRTESIVERICERTMQTAHGAFRAVMYLDQPSGQPHIALVRGTPCTDQDTLVRVHEPLSVLDLLEVGESTHSWTLDAAMKEIARRDCGVIVLLNCGDSKDHLIDVFKAFDSKERAEALKRRPVDFKTYGIGAQILRELGVGKMQVLSNPRKLGSMSGYGLEVTGFVPMPGSTAQAPQQG

SEQ ID NO: 22891 - protein, 255 aa, Thermotoga maritima MSB8
MTIGIVGVGNMGSIFAEKFSKEAERILLVEKDSEKLSRFNAPPYEIADLEKVREADLIVLAVKPQDAPIVLSALKGFDGILLSIVAGLKIEEIRKYGIHKVARIMPNVAVRVGEGVLATAFSADMSLEERELVKSLLEKLGFVVEIEEKLFSAVTALTGSGPAFIFVVVEAFLDAALKMGIPLDTAKELVYRLFKGSAELLTETGEHPALWKHRVSSPAGTTIEGLITMERFAVRSGVIESLISSYRRALELEEK

SEQ ID NO: 22892 - protein, 168 aa, Burkholderia xenovorans LB400
MEIGQYQPNLDGDGLRIGIVQARFNEPVCNGLADSCIEELERLGVTGEDVLLVTVPGALEIPLALQKLAESAQFDALIALGAVIRGETYHFELVSNESGAGITRIGLDFGIPVANAVLTTENDEQAVARMTEKGRDAARVAVEMANLAVALEQLGGDDDEEEDEEEEA

SEQ ID NO: 22893 - protein, 920 aa, Ostreococcus tauri
MLSATSSIGYGTTARARSRAGVPRGRGGLHVCANAKVDACDKKSIIVSPSILSANFAKLGEEIEAIDKAGAEWVHVDVMDGRFVPNITIGPLVVDAIRPVTDKVLDCHLMIVEPELRVADFAKAGADIISVHAEGAATIHLHRTINQIKDLGCKAGVVLNPGTPISVLDYIIEEVDLILVMSVNPGFGGQSFIESQVEKIAKIKAMCDAKGVNPWIEVDGGVSPANAYKVIEAGANALVAGSAVFKPLSDRVREHVASRERSIGACPSTPRSRTRCCHYSSHFANLHSALLVAAAAASRRGARVALVTPNPNGTIGEMSCNPSVGGLGKGTLVREVDALDGLMGRIADASGIQFRVLNSSKGPAVRGARAQMDRELYKKEALRLVSGIGGLEVSSNEGGGRVRGVMLDTGRALRSRTVVITTGTFLNGVLHIGSKRVVAGRLANASTENADVQAGKAAHSLAKTLYGVGFDMGRMKTGTPPRLDGNSIDWAACQPQPGDELPIPFTFTSSSRRVGAEPWRPTAPQIMCHSTYTTPETEKFIAAAPKSKYELDMEGSPTTPRYCPSIESKVRRFPGRNHRVWLEPEGLNTSVVYPNGITNNLEPDLQVKMVRTIPGLEKVDILKPGYGVEYDYVDPRELKINLETKKVRGLFLAGQINGTTGYEEAAAQGIIAGANAASTDGEEFILPRYSSYLGVLVDDLTSRGTSEPYRMFSSRVEYRLSIRSDNADLRLTELGERFGLVSAERARAGARRSALVKQASEALDAISLLPSRWQSYAPDLPIAKHGRPLSASNMLSQRWDIDEILRAATDALGASDARVQVLHAVNGEDRSAFECAAIEAYYRPYVERQAQDIEDIRREEELVIPDAFDYSTIDNLSLEDREKLEAVRPTTFARASRISGVTPAALLSLFRVVTRKKHRN

SEQ ID NO: 22894 - protein, 202 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIAS

SEQ ID NO: 22895 - protein, 434 aa, Thermotoga maritima MSB8
MLKEKLLSKTALLGVIGLGYVGLPLAVEKAKAGYRVLGFDIQKKRVDMVNRGENYIGDVVDEDLKDLVEKGMIRATTDFSEMKNCDVVTICVPTPLGKYKEPDLTYVINTAKEIAKYLHREMLVVLESTTYPGTTEEVVLPILESTGLKVGKDFYLAFSPERVDPGNKIYKTKNTPKVVGGVTEKCTELAKILYENVLEAPVHTVSSPRAAEMAKVLENTFRLVNISLINEVAIVARRMGINIWEVIDAAATKPFGFMPFYPGPGAGGHCIPIDPFYLAYKAKEYDVRLDLVEMAGEINDFMPEYVVMRVQDILNERKKPLNGSKVLLLGVAYKGDIDDTRESPALKVWDHLEKKKAVVEFFDPYVPEVKRGDRIHRRVELTEEYLKGVDIVVITTAHKNGVDYDFVVKNAPVVFDTKNITKDVKENRDKIILL

SEQ ID NO: 22896 - protein, 164 aa, Vitis vinifera
  misc_feature (11)..(11): Xaa can be any naturally occurring amino acid
MDSVKGKGKKXVMLKAWERWQSICPRAKKSILLIIPFSPSKTSEVGKPKKKSPMPPKGYFPVYVGAQKQRFVIKTQLAKHPLFKTLLEEAELEYGYSNGGPVLLPCDVDTFYEVLVQMESGGAQESSSRGGTFSFLSPSPRPGCGEMAEGYGHYSLLSPSRMVR

SEQ ID NO: 22897 - protein, 362 aa, Arabidopsis thaliana
MATVTDLPDDLVREIFSRVPLTSLRAVRSTCKKWNAISKYDILGKKAAAKNQFLEFMVTDSRVCSLRLDLQGIRSEEDLIDLSIKQISIPNKVDQVEISQVYHCDGLLLCIAKDNSSVMVWNPYLGQTKLIQPRKKLHRYDKFALGYDNNRNHKILRFLYEGSPRNVIIDVYDFSSDSWRVLDIDIDWHELFSHNSVSLKGNTYFFGRKGPRLPMLFKPPSRRFEYLTLSCVRNEKLAVLYSHLNRFGTIEICISTKIDPSAVSWTTFLRIDMTLINGLPDNFFVHSYATSFFFDEEKKVAVLFGTNRYRGRETCQYYQRACIVGDSGYFKAVNIELVFNSQLQSCQLVSSSYVPSLVQLQD

SEQ ID NO: 22898 - protein, 345 aa, Ostreococcus tauri
MSWGAPTAPANPNGDFTVANPPSDGISSLEWSPVGNFLVATAWDGDVRVYCYEVAQNGQAMPKASTKHEAPVLCSAWSADGASVFAGGCDNIAKKWDLATQQSTQVAAHDSAIRHMAWIQEVNLLVTGSWDRTLRYWDTRQQNPALKVQLPERCYALDVKHPLLVVGCAERQIQIFDLNRPDVAYKNVMSPLKYQTRCVATFPDRSGYLVGSIEGRVAVQHVEDNLQSKNFTFKCHREGTQDIYSVNSISFHPTFGTFVTAGADGNYNFWDKDSKQRLKNMNKCPAPISCGNFNRDGTIYAYAVSYDWSKGGDNPLSNTPNNIYLHAVQETEVKPRGARTGIGRR

SEQ ID NO: 22899 - protein, 91 aa, Zea mays
  misc_feature (81)..(81): Xaa can be any naturally occurring amino acid
GLNDQKGDGGGVKRGDRFSYKFFRRFLYMFGNVVMDIPHALVEEKLGSMKKGKGVKKRNDLTGTGLKEVGRQDQGLYLGAXGEAFPLEPKK

SEQ ID NO: 22900 - protein, 648 aa, Bacillus subtilis subsp. subtilis str. 168
MLIGKRISGRYQILRVIGGGGMANVYLAEDIILDREVAIKILRFDYANDNEFIRRFRREAQSASSLDHPNIVSIYDLGEEDDIYYIVMEYVEGMTLKEYITANGPLHPKEALNIMEQIVSAIAHAHQNQIVHRDIKPHNILIDHMGNIKVTDFGIATALSSTTITHTNSVLGSVHYLSPEQARGGLATKKSDIYALGIVLFELLTGRIPFDGESAVSIALKHLQAETPSAKRWNPSVPQSVENIILKATAKDPFHRYETAEDMEADIKTAFDADRLNEKRFTIQEDEEMTKAIPIIKDEELAKAAGEKEAEVTTAQENKTKKNGKRKKWPWVLLTICLVFITAGILAVTVFPSLFMPKDVKIPDVSGMEYEKAAGLLEKEGLQVDSEVLEISDEKIEEGLMVKTDPKADTTVKEGATVTLYKSTGKAKTEIGDVTGQTVDQAKKALKDQGFNHVTVNEVNDEKNAGTVIDQNPSAGTELVPSEDQVKLTVSIGPEDITLRDLKTYSKEAASGYLEDNGLKLVEKEAYSDDVPEGQVVKQKPAAGTAVKPGNEVEVTFSLGPEKKPAKTVKEKVKIPYEPENEGDELQVQIAVDDADHSISDTYEEFKIKEPTERTIELKIEPGQKGYYQVMVNNKVVSYKTIEYPKDE

SEQ ID NO: 22901 - protein, 217 aa, Bacillus subtilis subsp. subtilis str. 168
MIKVAPSILSADFAALGNEIKDVEKGGADCIHIDVMDGHFVPNITIGPLIVEAVRPVTDLPLDVHLMIEEPDRYIPAFAKAGADILSVHAEACPHLHRTIQLIKEQGVKAGVVLNPHTPVQVIEHVFDDLDLVLLMTVNPGFGGQKFIHSVLPKIKEVKRMADEKGKKDLLIEVDGGVNKETAPLVIEAGANLLVAGSAVYGQSDRKKAISEIRGSK

SEQ ID NO: 22902 - protein, 277 aa, Triticum aestivum
MWWPSSLLYPPPASAFVTAMSVVSFASLASAGLSELRGQHMAYSKFWHVVSGQQQKKGGTGGAQLPGRDGMLVAYAPALVAAAASFVVPGAVEGLRAELPLLSLAASLLFRALLLLLPFSSLANTSVKFYTLSPPPLVYSFFPLLFYSPQSFPPFLSLPLLLALTSSFCLSPLFSLPSFSLYPFPPSLFHLLSSYLFCFPSSLFFLLSYSLCYLFYICLLFIYYSHHSVLFSSRLILSICVSTPLSLSISSPSAHLSQSDFVSLPRPSARRDLPDAL

SEQ ID NO: 22903 - protein, 101 aa, Gerbera hybrid cultivar
MAISKPFLAFALLSMLLLLQLGQAYEMVNKIDEATIAASKINCGAACKARCRLSSRPNLCHRACGTCCARCRCVPPGTSGNQKVCPCYYNMTTHGGRRKCP

SEQ ID NO: 22904 - protein, 388 aa, Oryza sativa Japonica Group
MRHPGAGGGSGDAGFVRADQIDLKSLDEQLERHLGRPAERAASQHGGSGSRRGESARLGLGEEPPQAPHHQRRREDWEIDPAKLVIRGVIARGTFGTVHRGVYDGQDVAVKMLDWGEDGHRSEREISSLRAAFAQEVAVWHKLDHPNVTKFIGAIMGARDLNIQTEHGHFGMPSNICCVVVEYLAGGALKNFLIKNRRRKLAYKVVVQLALDLARGLSYLHSKKIVHRDVKTENMLLDKSRTVKIADFGVARIEASNPSDMTGETGTLGYMAPEVLNGHPYNRKCDVYSFGICLWEIYCCDMPYPDLSFSEVTSAVVRQNLRPEIPRCCPSSLANVMKRCWDANPDKRPAMAEVVSMLEAIDTSKGGGMIPTDQPQGCFSCFGRHRGP

SEQ ID NO: 22905 - protein, 247 aa, Streptomyces clavuligerus
  misc_feature (1)..(1): Xaa can be any naturally occurring amino acid
  misc_feature (95)..(95): Xaa can be any naturally occurring amino acid
  misc_feature (111)..(111): Xaa can be any naturally occurring amino acid
  misc_feature (120)..(120): Xaa can be any naturally occurring amino acid
  misc_feature (122)..(122): Xaa can be any naturally occurring amino acid
  misc_feature (140)..(140): Xaa can be any naturally occurring amino acid
  misc_feature (204)..(204): Xaa can be any naturally occurring amino acid
XPSALQGKVALITGASSGIGEATARALAAEGAAVAIAARRVEKLRALGDELTAAGAKVHVLELDVADRQGVDAAVASTVEALGGLDILVNNAGIXLLGPVEDADTTDWTRXIDTNLLGLXYXTRAALPHLLRSKGTVVQXSSIAGRVNVRNAAVYQATKFGVNAFSETLRQEVTERGVRVVVIEPGTTDTELRGHITHTATKEXYEQRISQIRKLQAQDIAEAVRYAVTAPHHATVHEIFIRPTDQV

SEQ ID NO: 22906 - protein, 394 aa, Staphylococcus epidermidis ATCC 12228
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKEQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 22907 - protein, 358 aa, Methanocaldococcus jannaschii
MVKYMEAVLILEDGTILKGKGFGAEKEVFGELVFTTVMTGYVEVLTDPSYKGQIVMMTYPLEGNYGVKKDWFESDGIKAEGFVVREVTSKALDDFLKEYDIPGIQDIDTRFLTRKIRDKGVVKSCLKVAEEISDDEISELLERVKRYSDISDIDLVPLVSTKEPKIHKTANPKARCVLIDCGVKLNIIRSLVQRNCEVIQVPYNTKYDEILEYKPDFVLISNGPGDPARLKEVIKNIKNLIGVVPITGICLGNQLLSLAFGGETYKMKFGHRGGNQPVKDLKTQKVYITSQNHGFAVRKESLPDDVEVSFINLNDMTVEGIRHKDLPIFSVQFHPEARPGPHDTMFLFDEMIKLKDRK

SEQ ID NO: 22908 - protein, 588 aa, Umbelopsis isabellina
MKVRVYEIIKLCISIPNLTSLFVVSGTAMHHTTRKALGVHGLAPSRIESLEIQKRRAMVQLRSKESMIEKYIFMAQMRNTNIRLFYKIVCDELEELAPVIYTPTVGHACVEWSNIYPFLAPPGTPDGLYLTQADLPNIKELIRTYQPFPTDPHPFSPEIAVISDGSRILGLGDLGVNGMGIPIGKLQLYVAGAGIDPRRTLPIMLDLGTNNEKFLEDDFYLGVRNKRPNDDVFYDAVDQVLSALYSEFPELLVQFEDWSSEHAFGLLEKYQHKTFCFNDDIQGTGAVILSGLMNAYKVVANEDKVAAKDHRIVFFGAGSAGIGVAKQIKDYFIIEHGFTEEEARKVFYIVDSKGLITNDRGDRLAEHKKYFSRDDNNGQQFKDLLDIINYVKPTTLIGLSSQPQTFTEPILRRMAELNKQPIVFPLSNPSTQAECTFAQAMEFTDNRVLFASGTAFPTYTITETGAVKIPGQGNNFYIFPGLGLGASIAKPAHITDNMVYQSAAALADCLTPEEKAERRLYPNLKRIRQISAEVAAAVCIEAVKEGLARNPQIETVVKDRDQLIKYVMERMWTPESDGYGAEKSISKI

SEQ ID NO: 22909 - protein, 331 aa, Debaryomyces hansenii CBS767
MKQLPKVKIFGMGGTIASKGTTNSQTAGYKVGLTVKDLVEAIPSLEDVAHLDYLQVANVGSKLLNSSHLLKLYAAITEAFDGNIDGAVVTHGTDTIEETSFFLDLTIKSDLPLVIVGAMRPSTAISADGLMNLYQAVKIASSETSKERGPLVVLNDRIASGFWTTKMSGFALDTFRSGEQGYLGVFQNNQIEWYYPPIRPYGHQYFDISKTDELPEVIILYAYQGLNPGLIYSAVELGAKGLVFAGFGAGHWTDEGNNVAKEVWEKYGVPTVYSHRTVEGSVPVANVNHFEGAVASGILNPQKARILLQLCINADYSIVEIRESFSSVYGG

SEQ ID NO: 22910 - protein, 319 aa, Physcomitrella patens subsp. patens
MSQDVFVPAASEKTFTAFMTDFLMGGVSAAVSKTAAAPIERVKLLIQNQDEMLKSGRLSHPYKGIGECFGRTIKDEGVMSLWRGNTANVIRYFPTQALNFAFKDYFKSLFGYKKDKDGYWKWFAGNLASGGAAGASSLLFVYSLDYARTRLANDAKSSKKGGGERQFNGLVDVYKKTLATDGIAGLYRGFMISCAGIIVYRGLYFGIYDSLKPVVLVGSLEGNFLASFMLGWGITIGAGLASYPIDTVRRRMMMTSGEAVKYNGSMDAFRQIVAKEGTKSLFKGAGANILRAVAGAGVLSGYDQLQILLLGKAYSGGSG

SEQ ID NO: 22911 - protein, 491 aa, Oryza sativa Japonica Group
MAVTIQSVKARQIFDSRGNPTVEVDVGLSDGSFARGAVPSGASTGIYEALELRDGGSDYLGKGVLKAVSNVNTIIGPALIGKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQVKYCLNNKTMSMHDSVIFSAHLAAVQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 22912 - protein, 460 aa, Ostreococcus tauri
MAFGVVLAKKSAVVLSESFRRVDERSWALDLSGGATAATHVECRDACFFLTSTGPKKRRARETDARFRRSIAVLDDNSALCFYIQAGDSAWEYCGCVANAKPSDVFALRWPKSADGGDFPNAAIGVSVEPLALALEKEAAMVQHKETFAKRVAEDLFNFMQSFQGPESTADHMVVPVNILTRWFDKFTAKFRRDPGFLDRPRLDRASLARTTGNTDAQQLSSSALHHASRVPTMPSRNQPVISPSLLSCDFARMADESKKVIACGADWLHLDVMDGHFVPNLTFGAPVIAALRPHVPDAYFDVHLMVTNPEDYVEPMAKAGANMFTYHAETTKTAGEAAELCRKIRASGMHVGVAIKPATKAEVVFGLVDEGAVDMVLVMTVEPGFGGQKFNPECCAKVKTLRERFPDLKIQVDGGLSASTIDVAAEAGANVIVAGSSVFGSADWKQAIDVLREGVLKHQ

SEQ ID NO: 22913 - protein, 537 aa, Clostridium difficile 630
MKFNAYQHKYSSIRNVVYAKNGAVATSTPLASQAGLEILKKGGNAVDAAVATAATLAVVEPTSNGIGGDAYALVWIEEEKRLYGLNSSGFAPENMELKNYNNMKEMPKYGFGAVTVPGIPAAWSELNKKYGKLSLMECLSPAINYAREGYVVSPNVAKVWKKSYELYEKELIGEEFKPWFDTFSKDGKAPEAGDIFICEEQASTLEEIANTQAESFYRGRLADKIDEYSKKFNGAIRKSDLECFYPTWVEPISTEYKGYKIFEIPPNGHGITVLMALNILKELELEGNIENVEDIHKIIESLKLAFADSKTYVTDIEHMKVKIQELLSQEYAKKRSLLIDNKEALYPTAGEPYCGGTVYLCTADKDGNMVSYIQSNYINFGSGIVIPRTGIALHSRGNNFNLDPKHHNVVKPFKKPYHTIIPGFLGKEDKAIGPFGVMGAFMQPQGHIQVLTNMIDFGLNPQEALDAPRWQWIKGKEIEVEPEMPKHIIDSLIEKGHEIKVIHDTVDMGRGQIIFKTEQESYICGTESRCDGHIAVY

SEQ ID NO: 22914 - protein, 307 aa, Picea sitchensis
MVYLNKVTEGCGAYVAAKLEMMQPCCSIKDRVGYAMILDAEEKGLISPEKSVLVEPTSGNMGIALSYIAASRGYKLVLTMPSYTSLERRVTMRAFGSELVLTDPVKGMGGAVKKAADLLQSTPNAFMLQQFDNPANVKAHFETTGPEIWEDTAGQVDIFVMGIGSGGTVSGVGRYLKSKNPNVKIYGLEPAESNILNGGKPGPHQITGTGVGFTPKILDLDILDGVIEVSSDDALKMARELAWKEGLMVGISSGANTVAALQLARRPENKNKLIVTVHPSFGERYLSSMLFQELRQEAEMMQPVSVD

SEQ ID NO: 22915 - protein, 183 aa, Glycine max
APPPSREKMSVKVNCVGGDTHNVFVYGSLLADEVVHTLLKRVPPTAPAILHDYHRFKIKGRVYPAILPVQNNKVYGRVLLGISGVELDILDEFEDVEYTRTDVEVSLKDKSEKLQVCAYVWSNPNDPNLYAEWNFEEWKQVHMNDFVKMTDGFRQELELPESKPRVQTYETFYKQENDKPLEP

SEQ ID NO: 22916 - protein, 433 aa, Physcomitrella patens subsp. patens
MFLAKSRLLWLVIGLFFLASVLGLPAPVVAARLLADAPTIVQDPNEGDVESSKSSAFNRVGIYVVGFGCAVLLIATISVVAVLYLRHKRKMTTVSPWRQGMSGQLQREPEIIVPLLEREALEVACEDFSNIIGSSPDCVVYKGTLPDGTEIAATSIQMSAANWPPHYELSFRKKVKALARMKHPHLVNFIGYCTKDDPWTRIFVFEYASNGSLYDHLHNKESEHLGWTARMRLVVGAAIGLKYMHHELVPPVHHSNFSAESVLLTDDYAAKVSTFGVTGVPMMRNDSQKSSWFAGKTSGHENGASIDHLDPDFENDIYSFGVFLLEVITGRPPESEGAPPLVEWAREYLSDPKMMWYMVDPTLKPYNHDELVAVCKVASMCLSTESPRPSLLRICDMLTDNLKLSPDVVAAKSPAALWAQLELHDDSSSEVST

SEQ ID NO: 22917 - protein, 289 aa, Picea sitchensis
MWPHSRPTIDCHTITGQILSIKKYPLFTENLYCLNYCHFPSLSSARSIKTRPLSPFPSLSQSHSLISSFKGLPGALFPQRSRVPIPRSLPCYYHFCLRVAANLDDTMSASEDGDARVQGIFDAIRVVPDFPKPGIMFQDITTLLLDHKAFRDCIDIFVERYKDKNISVVAGIEARGFIFGPPIALAIGAKFVPIRKPKKLPGEVISEEYALEYGTDRIEMHVGAVQPGDRTLVVDDLIATGGTLSAAMRLLERVGAEVVECACVIELPELKSVLVPKLLNVHVSLNCQS

SEQ ID NO: 22918 - protein, 162 aa, Glycine max
AASEPHDDNSSEGDLGNDLSPEEMKVAERAIEVVSNTLSFIKILIHSIIGLLKLEKPNDNSSFVNSLEKLLQLCHELGRQIDEIGACLYPPQEIPAINAALEKIHSIIDAVQVEVGELLGASDVFLEPCNDLRSSLRQLASELSNSSTADIEARVENITLNQ

SEQ ID NO: 22919 - protein, 450 aa, Acinetobacter sp. M-1
MTKHYDYIAIGGGSGGIASVNRAAMYGKKCALIEKSEIGGTCVNVGCVPKKVMWYAAHVAESIQKYGPDYGFNTKVEVFDWQVLIKNRQAYIDRIHQSYQNSLSKNNVDLIQGAAYFIDQHTIEVNGERFTADHILIATGTQPSLPKIDGVEYGIDSNGFFELSALPKTTAVIGSGYIAVELAGVLNALGSQVGLFIRKDLPVRRFDSFLSETLVEVMQTDGITVHTQAVPLKVTKNADGSVVLHLENGERHTVDCLIWATGREPNTASLNLEKTNVQLDERGYIQVDKFQNTSQQGIYAVGDIIGKMELTPVAVAAGRRLSERLFNHKSDEHLDYDNIPTVVFSHPPIGTVGITEQEAIEKYGQKEVKVYNSSFTAMYSAITQHRQPTKMKLVCVGENEKIVGIHGIGFGMDEILQGFAVALKMGATKKDFDNTVAIHPTSAEEFVTMR

SEQ ID NO: 22920 - protein, 525 aa, Methanosarcina barkeri str. Fusaro
MTQARRPLMLIIFDGWGYREAKEGNAVMTARTPNLDRLEKECPWCFLKASGEAVGLPKGMMGNSEVGHLTIGAGRIVNQDLTRINISIKNGDFFKNPVFLNAISNVKANASSLHLMGLASCGGIHSYMPHLHALLKLVQEKDLKKVYIHAFLDGRDEPPKAALGDIKKLDAFCKEHGNAKIATVSGRYYAMDRDKRWDRTKLAYDALTRGVAPYTAPNAETAVSNAYSRGETDEFVKPTIITEQVITEQVITEQAEKPVATVQDNDSVIFFNFRADRARQITWAFVKDDFDGFMREKRPEVYFVCMTQYDETLEVPIAFPPIKLENVLGEVLSKHGLIQLRIAETEKYAHVTYFLNGGEEKRYKDEDRCLIPSPKIATYDLKPEMSAYEITDEVIRRIQSGKYDVIVLNFANMDMVGHTGIFEAAVKAVEAVDKCIGRIVEVLKEKGGVALITADHGNAEEMIDLKTGEPHTAHTSNPVKCIYFGNSEIKALRNGKLCDVAPTILELLGIPKPQEMTGKSLLVKD

SEQ ID NO: 22921 - protein, 426 aa, Thermus aquaticus
MAYQRIQIPQEGEKITIQEGVLKVPDQPIIGFIEGDGTGPDIWRAAQPVLDAAVAKAYGGQRRIVWVELYAGEKANQVYGEPIWLPEETLEFIREYLVAIKGPLTTPVGGGIRSINVALRQELDLYACVRPVRWFQGVPSPVKHPELVNMVIFRENTEDIYAGIEWPAGSEEVKKVLDFLKREFPKAYAKIRFPETSGLGLKPISKEGTERLVEAAIEYAIKEDLPSVTLVHKGNIMKFTEGAFREWGYALAREKYGATPLDGGPWHVLKNPRTGREIVIKDMIADNFLQQILLRPDEYSVIATMNLNGDYISDALAAQVGGIGIAPGANINYKTGHAVFEATHGTAPKYAGQDKVNPSSVILSGEMMLRYLGWNEAADLIIRAMERTISKGLVTYDFHRLLVAEGKPATLLKTSEFGQALIQHMD

SEQ ID NO: 22922 - protein, 332 aa, Gonyaulax polyedra
MAGPQLDDFTLVKVLGKGSYGKVMLVRGAQDNRLYAMKMLRKENVIKRNQVEHTKTERSVLETVSHPFIVTLHYAFQTPKKLYMVMEYCPGGELFFHLSRAGRFSEGRTRFYVAETSSAVAYLHQLNVIYRDLKPENLLIDGEGHAKITDFGLRKEGIQDNHSAMTMCGTPEYLAPEILDKKGHGKAVDWYSVGALTYEMLTGLPPFYTKDLQKLFDRIRRGELTYPDYVSVLAKEFLRALLQRNPDARLAGGVPGGDEVKGHEFFGGLDWVALEKRAIPPPFKPTFGGQKEDDVVKYFEKDFVGQPVVNSEVGEGGRDLGHLEASTLTGKR

SEQ ID NO: 22923 - protein, 510 aa, Silicibacter sp. TM1040
MKDILAELEERRENARLGGGQKRIDAQHARGKLTARERIELLLDEGSFEEFDMFISHRCTDFGMENNKPAGDGVITGWGTINGRQVYVFSQDFTVLGGSVSATHAQKICKIQDMAIQNGAPIIGLNDSGGARIQEGVDALAGYAEIFQRNIMASGVIPQISVIMGPCAGGAVYSPAMTDFIFMVKDTSYMFVTGPDVVKTVTNEQVTAEELGGASTHTKKSSVADGAFENDVEALAEVRRLVDFLPANNREKPPVRPFFDDPARIEDSLDTLIPENANTPYDMKELITKVADEGDFYEIQEDFAKNIITGFVRLEGQTVGVVANQPMVLAGCLDIDSSRKAARFVRFCDAFEIPILTFVDVPGFLPGTAQEYGGVIKHGAKLLFAYGEATVPKVTVITRKAYGGAYDVMASKHLRGDFNYAWPTAEIAVMGAKGATEIIHRADLNDPEKIAAHTADYEDRFANPFVAAERGFIDEVIQPKSTRRRVARAFASLRGKKLANPWKKHDNIPL

SEQ ID NO: 22924 - protein, 447 aa, Streptomyces avermitilis MA-4680
MALKITVIGTGYLGATHAAAMAELGFEVLGLDVVPEKIEMLQRGEVPMYEPGLEELLRKHVAGIEGSTGRLRFTMDFAEVAEFGDVHFVCVNTPQKHGEYACDMSYVDSAFEALAPHLKAPALVVGKSTVPVGSADRLAARLAELAPAGEDAELAWNPEFLREGFAVQDTLHPDRIVVGVRSERAEKLLREVYTTPVAEGSPFVVTDFPTAELVKTSANSFLATKISFINAMAEVCEAAGGDVVQLAEALGHDDRIGKKFLRAGIGFGGGCLPKDIRAFMARAGELGADQALTFLREIDSINMRRRGQMVEMAREALGGGSFLGKRVAVLGATFKPDSDDVRDSPALNVAGQIHLQGGQVTVYDPKGMDNARRLFPTLGYADSAVGAVRGADVVLHLTEWREFRELDPAALGEAASARVLLDGRNALDPQLWRRAGWTYRAMGRPTA

SEQ ID NO: 22925 - protein, 247 aa, Streptomyces clavuligerus
MPSALQGKVALITGASSGIGEATARALAAEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVNVRNAAVYQATKFGVNAFSETLRQEVTERGVRVVVIEPGTTDTELRGHITHTATKEMYEQRISQIRKLQAQDIAEAVRYAVTAPHHATVHEIFIRPTDQV

SEQ ID NO: 22926 - protein, 466 aa, Arabidopsis thaliana
MDVPRPAFKCFDDDGRLKRSGTVWTASAHIITAVIGSGVLSLAWAIGQLGWIAGPTVMLLFSFVTYYSSTLLSDCYRTGDPVSGKRNYTYMDAVRSILGGFRFKICGLIQYLNLFGITVGYTIAASISMMAIKRSNCFHESGGKNPCHMSSNPYMIMFGVTEILLSQIKDFDQIWWLSIVAAIMSFTYSAIGLALGIIQVAANGVVKGSLTGISIGAVTQTQKIWRTFQALGDIAFAYSYSVVLIEIQDTVRSPPAESKTMKIATRISIAVTTTFYMLCGCMGYAAFGDKAPGNLLTGFGFYNPFWLLDVANAAIVIHLVGAYQVFAQPIFAFIEKQAAASFPDSDLVTKEYEIRIPGFRSPYKVNVFRAVYRSGFVVLTTVISMLMPFFNDVVGILGALGFWPLTVYFPVEMYIRQRKVERWSMKWVCLQMLSCGCLMITLVAGVGSIAGVMLDLKVYKPFKTTY

SEQ ID NO: 22927 - protein, 302 aa, Staphylococcus epidermidis ATCC 12228
MSIPIIIDTDPGIDDATAISIALSHPQFDVKMISTVNGNVGIEKTTANALKLKRFFNSSVPVHRGASQPLINDIFEATSIHGESGMDGYEFPQINQDDLTSIHAVEAMRNLLVNTQEPLTLIAIGPLTNIAILLTSYPEVQPFIKEIVLMGGSTGRGNVTPLAEFNIYCDPEAAQIVFNSGLPLTMIGLDLAREALFTHHFVKDFKDTNATSNMLYNLFQHYKSEDFEIGFKLYDVFTILYLLDPEAFNVKEAYTQIELNGNFTRGATVVDFNMEHPNCTVVLSPVERQYEDLFLNALSYCK

SEQ ID NO: 22928 - protein, 77 aa, Bacillus subtilis subsp. subtilis str. 168
MADTLERVTKIIVDRLGVDEADVKLEASFKEDLGADSLDVVELVMELEDEFDMEISDEDAEKIATVGDAVNYIQNQQ

SEQ ID NO: 22929 - protein, 96 aa, Zea mays
SAQLIDHKYMKPKSIHNPDILENFSKEYMYLACVAYVKKVKKGPFMEHSPMLDDISGVANWKKVNSGLLKMYKAEVLEKVPIMQHFLFGSLIKWED

SEQ ID NO: 22930 - protein, 1186 aa, Bacillus subtilis subsp. subtilis str. 168
MFLKRLDVIGFKSFAERISVDFVKGVTAVVGPNGSGKSNITDAIRWVLGEQSARSLRGGKMEDIIFAGSDSRKRLNLAEVTLTLDNDDHFLPIDFHEVSVTRRVYRSGESEFLINNQPCRLKDIIDLFMDSGLGKEAFSIISQGKVEEILSSKAEDRRSIFEEAAGVLKYKTRKKKAENKLFETQDNLNRVEDILHELEGQVEPLKIQASIAKDYLEKKKELEHVEIALTAYDIEKLHGKWSTLKEKVQMAKEEELAESSAISAKEAKIEDTRDKIQALDESVNELQQVLLVTSEELEKLEGRKEVLKERKKNAVQNQEQLEEAIVQFQQKETVLKEELSKQEAVFETLQAEVKQLRAQVKEKQQALSLHNENVEEKIEQLKSDYFELLNSQASIRNELQLLDDQMSQSAVTLQRLADNNEKHLQERHDISARKAACETEFARIEQEIHSQVGAYRDMQTKYEQKKRQYEKNESALYQAYQYVQQARSKKDMLETMQGDFSGFYQGVKEVLKAKERLGGIRGAVLELISTEQKYETAIEIALGASAQHVVTDDEQSARKAIQYLKQNSFGRATFLPLSVIRDRQLQSRDAETAARHSSFLGVASELVTFDPAYRSVIQNLLGTVLITEDLKGANELAKLLGHRYRIVTLEGDVVNPGGSMTGGAVKKKNNSLLGRSRELEDVTKRLAEMEEKTALLEQEVKTLKHSIQDMEKKLADLRETGEGLRLKQQDVKGQLYELQVAEKNINTHLELYDQEKSALSESDEERKVRKRKLEEELSAVSEKMKQLEEDIDRLTKQKQTQSSTKESLSNELTELKIAAAKKEQACKGEEDNLARLKKELTETELALKEAKEDLSFLTSEMSSSTSGEEKLEEAAKHKLNDKTKTIELIALRRDQRIKLQHGLDTYERELKEMKRLYKQKTTLLKDEEVKLGRMEVELDNLLQYLREEYSLSFEGAKEKYQLETDPEEARKRVKLIKLAIEELGTVNLGSIDEFERVNERYKFLSEQKEDLTEAKNTLFQVIEEMDEEMTKRFNDTFVQIRSHFDQVFRSLFGGGRAELRLTDPNDLLHSGVEIIAQPPGKKLQNLNLLSGGERALTAIALLFSILKVRPVPFCVLDEVEAALDEANVFRFAQYLKKYSSDTQFIVITHRKGTMEEADVLYGVTMQESGVSKVISVKLEETKEFVQ

SEQ ID NO: 22931 - protein, 181 aa, Thermoplasma acidophilum
MLRELGVDTKIVPNDIDSSELDGLDGLVLSGGAPNIDEELDKLGSVGKYIDDHNYPILGICVGAQFIALHFGASVVKAKHPEFGKTKVSVMHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 22932 - protein, 391 aa, Streptococcus salivarius
MAEKIVMKNGQLQVSDRPIIPFIEGDGVGHDIWKNAQAIFDKAVEVAYEGKRHIEWQELLAGKKAYDKTGEWLPKETLEAIRESLVAIKGPLETPVGGGIRSLNVALRQELDLYACVRPVRYFDGVASPLKEPEKTNITIFRENTEDIYAGIEWEAGTADVKRVIEFLQTEMNVNKIRFPESSSIGIKPISIEGSKRLIRSAIDYALKNNLKKVTLVHKGNIQKFTEGGFRKWGYEVAQEDYKEELLAGRLEINDIIADNFLQQILLNPEKFDVVALTNLNGDYASDALAAQVGGIGISPGANINYQTGHAIFEATHGTAPDIADQDKANPCSVLLSGCMLLDYIGWTEAAQLITSAIEKTFKADIFTADLAFGKQAYSTSAFSNQILSIM

SEQ ID NO: 22933 - protein, 267 aa, Clostridium sordellii
MNKLENKVALVTSATRGIGLASAIKLAQNGAIVYMGVRRLEATQEICDKYKEEGLILKPVFFDAYNIDIYKEMIDTIIKNEGKIDILVNNFGTGRPEKDLDLVNGDEDTFFELFNYNVGSVYRLSKLIIPHMIENKGGSIVNISSVGGSIPDISRIGYGVSKSGVNNITKQIAIQYAKYGIRCNAVLPGLIATDAAMNSMPDEFRKSFLSHVPLNRIGNPEDIANSVLFFVPSEDSSYITGSILEVSGGYNLGTPQYAEFVGSKVVE

SEQ ID NO: 22934 - protein, 448 aa, Zea mays
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERATIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAATKRPDTYASERALEDRILCPICMYKSKDLAFGCGHQTCYECGRNLERCPLCQQNITTRIRLY

SEQ ID NO: 22935 - protein, 367 aa, Prochlorococcus marinus str. MIT 9215
MVLLNKIKNKLRINYRKKRWPGLIEAYKQYLPVTKKTPIISLNEGNTPLIFSNSISKLIGNGTKVFLKYDGLNPTGSFKDRGMTMAISKAKEEGCESVICASTGNTSAAAAAYASRGGLKPYVLIPEGFVAQGKLAQALMYGAEIISINGNFDKALEIVRDLSSEHPVELVNSVNPYRIQGQKTAAFEIVDDLGISPDWLCIPMGNAGNITAYWMGFKEYSKIKSNLKLPIMMGFQSEGSAPLVKNIIVKDPETIATAIRIGNPVNREKAKIVRKESKGDFQSVTDEEIINAYKILAKEGVFCEPASAASVAGLIKNKNRIQKESTIVCVLTGNGLKDPDCAIKNNDAIFRKNIEPSLKNITKILGY

SEQ ID NO: 22936 - protein, 240 aa, Oryza sativa Indica Group
QAEGGGGDDDAEQEDAGSDDGYPQMTEKQKKLFELRLKMNEARKANQQAMVAEKKRMEPRAESRGVSKQKWLEDRKKKIGKLLDSNGLDMTKSYMLDTQESAEAKYKKWEKEPAPYGWDVFNQKTLYDAYKKRTKNIEVDMEAYNKAKEADPEFYRDASSLQYGKVSKVPEENIDRMVNELKERDEKRKAFSRRRKFHEDKDIDSINDRNEHFNKKVERAFGKYTLEIKNNLERGTALPD

SEQ ID NO: 22937 - protein, 498 aa, Marinobacter sp. ELB17
MTVDHQRYDVVVVGGGVNGTGIAMDAAGRGLKVLLCEMNDLASATSSSSSKLIHGGLRYLEHYEFRLVQKALAERESLLRNSPHIMWPMRFRLPHRSHLRPAWMIRAGLFLYDHLAKREILPGSKSIRFDETGPLKPDITRGFEYSDGWVDDARLVVLTAKKAQQSGATILTRTKCVNAERGRDEWQITLRNTDTNVDQIISAKCIVNASGPWVSSLFGESLSMPAPKMIRMVKGSHIVVPRLNQEEEAYILQNEDDRIVFVIPYEDNFSLIGTTDVEYEGNPKEAKISPEETIYLLKIVNSYFERQLEPSDVVWSYSGVRPLMDGEEENAQKASRDYTFEVSEEKDKASLISVFGGKITTYRKLAEAATDKICHFFKNNRGHWTKTAVLPGGDFDNQINLAASLDEAYPWLPEKLVSRYVRTYGTTSRDILNNCASVDDLGKLFVGTLYEKEVEHLINNEWAMTSEDILWRRTKQGLYASDSEVEALDSFLKDRATV

SEQ ID NO: 22938 - protein, 591 aa, Crocosphaera watsonii WH 8501
MTSSSISRRTKIVATIGPATQNKEILRQLILAGATTLRLNFSHNDHDYHQNSIRLIRQTAFELNQPVAILQDLQGPKIRLGQFANGPITVQPGDVFILTSREVECNQTISYVSYEHLADEVPEKARILMDDGKVEMLVEKVDKENKDLHCRVVVGGVLSDRKGVNFPGVYLSVKALTEKDKRDLMFGLDQGVDWVALSFVRNPQDILEIKGLIASAGKNVPVIAKIEKHEAIEDMEEILSLCNGVMVARGDLGVELPPEDVPILQKRLISTANRLGIPVITATQMLDSMASNPRPTRAEVSDVANAILDGTDAVMLSNETAVGKYPVEAVATMATIAERIEREPTIPKVLSEKKQSVTNSISSAVSHIAQELNAAAIMSLTKTGSTARNVSKFRPQIPIVAVTPHVDVARQLQLVWGVKPLLVLDLASPNQTFQSAVNVAQENNWLKDGDLVVMTAGTLQGVAGSTDLIKVEMVKAVLGKGVGIGQGAASGRARIAHNARELGNFEPGDILVVPGTNAEFVEMMRKASGIITEEASLTSHAAVIGLRLGVPVIIDFKEATANIREGAIITVDAEKGQVYSGLVTSNNNGNK

SEQ ID NO: 22939 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSLGNRSAAVRIPLTGPNPKAKRLEFRPGDALANPYLAFSAMMMAGVDRIKNQIDPGDGFDEDLFELPAERLASIPTVPASLNGSLEALNADKNYLMEGGVFTE

SEQ ID NO: 22940 - protein, 452 aa, Oenococcus oeni PSU-1
MKNRDVSVSSAQGMHLSKTLNIVETVSLAASDISPTSGVFLNMPVAIAMVGTGSFLVSLMAGIIAICVALTMAEIGSAFPKSGGIYSVIHRVMGKKVGFLALVAYLVEGVFIPAVTSMGSATYLAAVFPALKVNLLAPALMLIAMLISIANISSTGKFTTFLLALELLVVLTITIACLLNLKQPVSVLFSTQVIHGNSFSNVSWPTIFSTIAVMLFSFNGFDSALNFSEEMSGNQKSIGRSVFGAASIGIIAQLIPLAVILLAAPSLKGFLKSSNPILYVSNDVLGPTMHDFLSLGISLAMFACTISVLLQFSRVLYTSGRDNMWPKTINHFLQSIHPKFKTPWKATLFLGVVDIFLNFVSNLGDLISFTSVLVVLLYALIGICDIIARGKKVSFPYKNTFGIMAPIITIVASVYVLSRQTFINLLISLVILAVSFIYVSLFKKADTIDLNL

SEQ ID NO: 22941 - protein, 464 aa, Clostridium difficile 630
MDAKKVKVPVREQEPAVRATNFDEVCLGYNKEEAMAEANRCLACKKPKCVGGCPVGIDIPGFITKIKEDDIEGAAKVIAKSSSLPAVCGRVCPQESQCEGVCILGIKSDAVSIGKLERFVADWSKENDINLSDTEPKKNQKVAVIGSGPAGLACAGDLAKKGYDVTIFEAMHEPGGVLTYGIPEFRLPKQAVVQPEIDNIRKLGVKIETNVIVGKTITVDELIEDEGFEAIFIGSGAGLPMFMNIPGENANGVFSANEFLTRVNLMKAYRDDYDTPISSGKKVAVVGGGNVAMDAARTALRLGSESYIVYRRSEKELPARAEEVHHAKEEGIIFNTLTNPKEILVDENGYVKGMVCIRMELGEPDDSGRRRPIEIEGSEFVLDVDTVIMSLGTSPNPLISSTTKSLDINKKRCLITDENGQTSKEGVFAGGDAVTGAATVISAMGAGKTAAASIDEYLKAKVNA

SEQ ID NO: 22942 - protein, 132 aa, Glycine max
MESDAPTWGDKLMLRGLSFHGFHGAKPEERTLGQKFFIDIDAWMDLKAAGKSDHLSDSVSYTEIYDIAKDVLEGSPHNLLESVAQKIAITTLTNHKEISAVRVKVGKPHVAVRGPVDYLGVEILRRRSDLSG

SEQ ID NO: 22943 - protein, 631 aa, Bacillus megaterium
MKKYRVNVQGMTCSGCEQHVAVALENMGAKEIEVDFRRGEAVFELPDDVEVEVAKNAIADANYHPGEAEEFQSEQKTNLLKKYRLNVEGMTCTGCEEHVAVALENAGAKGIEVNFRRGEAVFELPDDVDIDIAKIAITDAKYQPGEAEEIEVQSDKRTDVSLNDEGNYDYDYIIIGSGGAAFSSAIEAVALNAKVAMIERGTVGGTCVNVGCVPSKTLLRAGEINHLAKNNPFVGLHTSASNVDLAPLIKQKNDLVTEMRNEKYVNLIDDYGFELIKGEAKFVNENTVEVNGNQITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHIEINGKKRIIEAEQLLIATGRKPNTESLNLHAADVEVGSRGEIIIDDYLKTTNSRIYAAGDVTLGPQFVYVAAYEGRLVARNAIGGLNQKVNLEVVPGVTFTSPSIATVGLTEQQAKEKGYEVKTSVLPLDAVPRALVNRETTGVFKLVADAKTLKVLGAHIVTENAGDVIYAATLAVKFGLTVEDLRGTMAPYLTMAEGLKLAALTFDKDVSKLSCCAG

SEQ ID NO: 22944 - protein, 365 aa, Caulobacter crescentus CB15
MSQGDGQPSRCHGRSHPLIATLLGPSVLFFQRFFRLMTALYDVAAIGNAIVDVIAQCDDAFLEREGLVKGSMALIDPARAASLYDVMSAAIEASGGSAANTVAGVASFGGKAAFLGKVADDQLGRVFRHDMNAIGCVFTTPPLAEGPATAQSLINVTPDAQRTMSTYLGACVELNPADVDPDIIEAAQISYLEGYLFDPPEARRAFAKAAALAHGSDRKIALTLSDSFVVDRHRGALLGFVETQCDIVFANAAEVCALFETDDFDAAVKALAERCEIAAVTRSEKGSVVAANGQLHEISAYPVEKVVDTTGAGDQYAAGFLFGLSQGRPLPICGQLGSLAAAEVIDHYGPRPQVSLRELAEKNGL

SEQ ID NO: 22945 - protein, 229 aa, Zea mays
IFGIYMVKDKDNVTLEDVLQPGTNMLAAGYCMYGSSCTFLRPGRPIHFDSSYNCIDCRYQLWQLVLSTGNGVNGFTLDPSLGEFILTHPNIKIPRKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 22946 - protein, 182 aa, Ralstonia metallidurans CH34
MKTVGDKLEAFHVVGVKPGFNNHEENGQSAFEDITEKSFEGKWKVIYFYPKDFTFVCPTEIVAFAKLNGDFADRDAIVLGGSTDNEFVKLAWRREHKDLNKLNQWQFADVTGSLVDQLGVRDQAAGVALRATFIVDPDNTIQHVSVNNLNVGRNPEEVLRILDGLQTDELCPCNRAVGGATL

SEQ ID NO: 22947 - protein, 321 aa, Ostreococcus tauri
MSLTSHTVGPSSARATPTRRRHAQRRVTAKSSPQEAWIERKLGSEVIETKSLGGSQWASFSSHTLKDGREVFVKTSGKGPEMFQGEAAGLRALRAAGGFVVPEVYGAGVLESATARSDSFIAMEFLNIGGRGDQGDFGDALARMHLAEPSHEEAKKGMFGFEVNNTIGETRQPNEWTDGWLEFWRDKRLMHMINLSRDAKLRELAEKVADKRLPEMLRAAGDVKPSLLHGDLWSGNIGTVASKPSVFDPAVYYGHHEAEFGMSWCASFSPAFWEAYHAKIPKADGFDERAKMYKLYHYLNHYVMFGGGYYGQCVSILKELA

SEQ ID NO: 22948 - protein, 485 aa, Magnetospirillum magnetotacticum MS-1
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 22949 - protein, 390 aa, Magnetospirillum magnetotacticum MS-1
MFPDNLLAVFDRTDVIFEHGEGAWLTAADGRRFLDFGAGVAVNALGHAHPRLVAALGEQAGKLWHCSNLYRVPGQERVAQRLVDASFADTAFFCNTGAEAMELVIKIARRYHHCAGHPERNRIIACTGSFHGRTIATLAAAGTAKYLEGFGPVAQGFDHVPYGDLEAVQGAIGSNTAAILVEPVQGEGGIRPGDPAYLRGLRALADEFGLLLLMDEVQTGIGRTGKLFAHEWSGIAPDVMGLAKGLGGGFPVGAVLATEKAAACMTPGTHGCTFGGNPLAMAVAEAVLDEIMAPGFLDRVQAVAAMLRGKLDDLARRYPQAIAEVRGQGLMLGLKTVPLNTEFNAKLFAAGLLAVGAGDNVVRLVPPLIIGEAEVVRAVEIIEGVCASFS

SEQ ID NO: 22950 - protein, 485 aa, Silicibacter sp. TM1040
MTHPAQPKASHFINGEYVEDTSGTPIPVIYAATGETIATVYAATPAIVEQALTAAEAAQKEWAKMSGTERGRVLRRAADIMRERNHELSVLETYDTGKPLQETLVADATSGADALEYFGGLAGSLTGEHIQLGEDWVYTVREPLGLCVGIGAWNYPTQIACWKGAPALACGNAMVFKPSETTPLCALKVAEILMEAGAPAGLYNVIQGMGEVGGKLVTDPRVDKVSLTGSVPTGKKVYAAAAEGMKHVTMELGGKSPMIVFEDADIESAISGAINGNFYSSGQVCSNGTRVFVHKDIKEKFLARLAERTATAKLGDPMDESVNFGPMVSERQMEIVLGYIEKGKSEGARLICGGNRADMDGFFVEPTVFADVKDDMVIAREEIFGPVMCVLDFESEDEVIARANDTEFGLSAGVFTKDFTRAHRVIGQLEAGSCFINSYNDAPVEAPFGGVKASGVGRENSKEAIKHFSQVKSVYVRMGDCEAAF

SEQ ID NO: 22951 - protein, 380 aa, Acremonium chrysogenum
MTTTYKILVLPGDHIGPEIMAEAIKVLTTIETHRPNLHFNLTTDLVGGTSIDTHGVPITQSVLDAAKASDAVLFGSIGGPEWAGVHPTPESGLLQLRQHLDAFANLRPCEFLVPSLVGASPIREHVVKGTRFIVVRENCGGAYFGEKKEEEDVASDLWVYTRPEIERLARVSAAVARIMGRSEDDNQAATVWSADKANVLASGRLWRRITSDIFAKEFPDITLQHQLADSMAMLMVRDPRRFNGVIHTDNTFGDILSDISGAITGTLGLMPSASLCGVPGEGHRSNGIYEPVHGSAPDISGKGLANPVAQILSVAMMLRYSMGLEKEATAVERAVVKVLDAKSEGGLEIRTGDLGGRATCSQVGDAVCEVLGPLLQGKKA

SEQ ID NO: 22952 - protein, 198 aa, Lactococcus lactis subsp. lactis Il1403
MILIIDNYDSFTYNLVQYVGVLTDVAVVKNDDDSLGNMAEKADALIFSPGPGWPADAGKMETLIQQFAGQKPILGICLGFQAIVEVFGGKLRLAHQVMHGKNSQVRQTSGNLIFNHLPSKFLVMRYHSIVMDEAVALPDFAITAVATDDGEIMAIENEKEQIYGLQFHPESIGTLDGMTMIENFVNQVNENKESSNEK

SEQ ID NO: 22953 - protein, 433 aa, Marinobacter sp. ELB17
MEKITHITAREILDSRGFPTVEVDVLLDNGVVGCGRVPSGASTGSREALEKRDLDSPRYNGKGVLQAVNAVNTRIAPALVGQMVFEQSQIDRLMCEMDGTPNKAEFGANAILAVSLGVADAAAKARKLPLFRYLAELYGCASPSVLPVPMMNIINGGAHADNNVDIQEFMIQPVGAPSYSEALRMGVETFHALKALLKEKGLSTAVGDEGGFAPNLQSSEEALELIIEAIEKAGYRPGTDIVLALDCAASEFYSDGCYDLKGAGKKYSSEEFADYLVSLAKAYPIASIEDGMDENDWAGWKLLTEKVGERVQLVGDDLFVTNTVLISEGIQKGIANSVLIKFNQIGTLTETLEAIAMAQGAGYTAVISHRSGETEDTFIADLAVATRAGQIKTGSLCRSDRVAKYNRLLWIEQELGAHAFYPGIGAIRCALDS

SEQ ID NO: 22954 - protein, 528 aa, Oryza sativa
MQPTWLATMPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 22955 - protein, 470 aa, Saccharophagus degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 22956 - protein, 268 aa, Marinobacter sp. ELB17
MRKPILIGNWKMNGSLQSNQALVSRLLPRLRPLRKVVDIAVCPPLPYLFQVRDLLGYTGITLGAQNASGFVSGAHTGESSATMLKEMGCVYVLVGHSERRSLYGETDADIAARFAAVRGLGMTPVLCVGESLQDRESGRTAEVVQAQIQAVIKKVGLAGLAEGVLAYEPVWAIGTGKTATPEQVAETHFGIRQFIAGCGEPKAKVISQALRILYGGSVKPANAVAIFSLDDVDGGLIGGASLHADDFAAIAEALGATYPEAVGESESH

SEQ ID NO: 22957 - protein, 358 aa, Acidithiobacillus ferrooxidans
MKKIAIFAGDGIGPEIVAAARQVLDAVDQAAHLGLRCTEGLVGGAALDASDDPLPAASLQLAMAADAVILGAVGGPRWDAYPPAKRPEQGLLRLRKGLDLYANLRPAQIFPQLLDASPLRPELVRDVDILVVRELTGDIYFGQPRGLEVIDGKRRGFNTMVYDEDEIRRIAHVAFRAAQGRRKQLCSVDKANVLETTRLWREVVTEVARDYPDVRLSHMYVDNAAMQLIRAPAQFDVLLTGNMFGDILSDEASQLTGSIGMLPSASLGEGRAMYEPIHGSAPDIAGQDKANPLATILSVAMMLRHSLNAEPWAQRVEAAVQRVLDQGLRTADIAAPGTPVIGTKAMGAAVVNALNLKD

SEQ ID NO: 22958 - protein, 228 aa, uncultured cyanobacterium
HEVAGAGQHELGMKFAQLIQAADNVMTYKYVVRNVAKKYGKTATFMPKPVFNDNGSGMHVHQSLWKEGQPLFFGEGTYANLSQTAQWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGEDRDLFELPAEELSKIATVPASLNGALEALNADRGFLTAGGVFSD

SEQ ID NO: 22959 - protein, 228 aa, uncultured cyanobacterium
HEVAGAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLALSAMLMAGLDGIKNQIDPGDGEDRDLFELVAEELSKIATVPASFNGALEALNADRAFLTAGGVFTD

SEQ ID NO: 22960 - protein, 520 aa, Sulfitobacter sp. EE-36
MTDISHDRLLIIDFGSQVTQLIARRLRELNVFCEIHPFNTVDDAFLKDFAPKAVILSGGPSSVFAEGAPMPPQSVFELGVPILGICYGQQVMMHCLGGKVERGHGTAEFGRAYVTPSEARLELLEGWFLTEKEQVWMSHGDHVSAIAPGFEVYGTSPHAPFAVTGDVSRNFYAVQFHPEVHHTPNGARLYENFVRLAGFKGDWTMSAYRDEAIAAIREQVGDQKVICGLSGGVDSSVAAVLIHEAIGDQLTCVFVDHGLLRKGEAEEVVTMFRDNYNMPLIHADEQELFLGELDGVSDPETKRKIIGKLFIDVFQKHAKEVGDATFLAQGTLYPDVIESVSFSGGPSVTIKSHHNVGGLPEKMGLKLVEPLRELFKDEVRELGRELGLPPSFIGRHPFPGPGLAIRCPGEITREKLDILREADAVYIDQIRKHGLYDEIWQAFVAILPVRTVGVMGDGRTYDFACALRAVTSVDGMTADYYPFTHEFLGETATRIINEIPGINRVTYDITSKPPGTIEWE

SEQ ID NO: 22961 - protein, 228 aa, uncultured cyanobacterium
HEVAGAGQHELGMVYEELIQAADNVMTYKYVVRNVAKKYGKSATFMPKPVFNDNGTGMHVHQSLWKGELPLFFGEGTYADLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGDGFDGDLFELPAEQLKNIATVPASLNGALEALNADHHYLMEGGVFSK

SEQ ID NO: 22962 - protein, 501 aa, Oryza sativa Japonica Group
MDAKKGSGEPEFFSEYGDASRYEVTEVVGKGSYGVVAAAVDTHTGGRVAIKKINDVFEHISDATRILREIKLLRLLRHPDIVEIKHIMLPPSRREFRDIYIIFELMESDLHQVIKANDDLTPEHHQFFLYQLLRGMKYIHAASVFHRDLKPKNILANADCKVKICDFGLARVSFDDTPSAIFWTDYVATRWYRAPELCGSFFSKYTPAIDIWSVGCIFAEMLMGKPLFPGKNVVHQLDLMTDLLGSPSGETISRIRNEKARRYLGNMRKKPRVPFSQKFPGADPMALHLLERLLAFDPKDRPTAAEALTDPYFTGLANSEREPIAQPISKLEFEFERRKLAKDDVRELIYREILEYHPQMMQKYLRGGDQSNFLYPSGVDRFKRQFAHLEEGVAQGDKTSPQLRQHVSLPRERVVRNGDEPDPTADYCIKLHVGEQPGHSSVTDGLNKPLLSARNFLKSESIGASQCVVIKEKREKDEESMSEYMNEAADGVPHKIAQLKT

SEQ ID NO: 22963 - protein, 174 aa, Oryza sativa Indica Group
SLEALLSKIPPKSLSDKELHKRQDTLSNLKSKTKQMATSFNMSNFANREDLLGQNKKAADDMSRVAGLDNQGIVGLQRQIMKEQDEGLEKLEETVLSTKHIALAVNEELTLHTRLIDDLEDHVDVTNSRLQRVQKRLAILNKRTKGGCSCMCLLLSVVAIVILAVIVWLLIKYM

SEQ ID NO: 22964 - protein, 228 aa, uncultured cyanobacterium
HEVAGAGQHELGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVSPSLNGALEALSADRAFLTEGGVFTD

SEQ ID NO: 22965 - protein, 93 aa, Populus trichocarpa
METQKSQPAKQQSPAALDPAITSCRRKKKDDATFLEDLKDHIDEFIHASMDEHKDCFTKTIKKMFGMSKIVAERSGDAKEVESSLPLQTTVAK

SEQ ID NO: 22966 - protein, 459 aa, Xanthomonas oryzae pv. oryzae KACC10331
MATENPIASLPAADADTLVRIAGCEAVDLLLPDTNGVLRGKRVTAEALSKVYRDGVCLPMSLIATDITGNTVEETGLGYAIGDADRICRPIEGSLRPVPWAPRPMAQLLLAMHTPEGGLFDVAPRAVLQRVLQGFGALGLNPVIAVELEFYLFDAVADAQGRPQTPRDPLTGERNDSTQVYSLQDLDDQRGFTDAVTAACRQQGIPADTAVAEYAPGQFEINLQHRADAVAACDEAILLKRTIKAIAQQQGKLASFMAKPFPGQAGSGLHLHVSLRDGTGHNVLASAADAPADPLRHAIAGLQRHADAALLMFAPHANSYRRFVSNAFVPLDASWGFNNRTVALRIPHSDAHNTRIEHRIAGADANPYLAAAAVLAAMLDGLRRPAEPTAPISGNAYAQSGFSPRTWQGAVDAFLSSDFIGTQFGTQFQHVFGQQKQRELLDYQALVPDLDYARYLRTV

SEQ ID NO: 22967 - protein, 430 aa, Triticum aestivum
SEPSYIGFSSSTGPVNSRHYVLGWSLGIDRPAPAIDAGRLPKLPQLGSKPRSRVLEMTLPIASAVVVLVFGAALVLLVRRRLRYTEVREDWEIEFGPHRFAYKDLFHATNGFKDKHLLGAGGFGMVYKGVLPASGVEIAVKKVSHGSKQGVKEFVAEIVSIGRIKHRNLVQLLGYCRRKDELILVYDYMPNGSLDKYLYGQGDGDGLTLDWAQRLHVIKGVACGLHYLHERWEKVVVHRDVKTSNVLLDKEMNGRLGDFGLAKLYEHGTNPQTTRVVGTTGYLAPELVRTGKATPLTDAFSFGTFMLEVTCGRRPIKQDEQGNQILLADWVLEHLHRESLVEAADPKLQHKYNSDEVCLILKIGLLCSHPSPSARPTMQQGLQYPDGELPPPEMTRSTLSLTLLALRERKGLDSMSSPFSIYGEDGRHQI

SEQ ID NO: 22968 - protein, 394 aa, Crocosphaera watsonii WH 8501
MSLSWMPRADRLNALPPYVFARLDELKAKAREQGLDLIDLGMGNPDGMAPQPVIDGAIAALQKPQTHGYPPFEGTASFREAITAWYRRCYRVDLDPSSEALPLIGSKEGLGHLALAYINPGDVVLVPSPSYPAHFRGPLIAGADLYPLILSAEKDWLIDLNSIPENVAKAAKILYFNYPNNPTTATAPRAFFEEIIKWATHYEIMLVHDLCYAELAFDGYQPTSLLEIPGGREIGVEFHTLSKTYNMAGWRVGFVVGNGEIIQGLRTLKTNLDYGIFSAVQAAAETALNLPDSYIKTVQERYQTRRDFLIKGLGELGWNIKPSQATMYLWVPCPTNTNSTDFALDVLEKTGIVFTPGNAFGEGGEGYVRISLIADCDLLGEALNRLKQAGIYYK

SEQ ID NO: 22969 - protein, 168 aa, Ralstonia metallidurans CH34
MNPFDIRIGQGYDVHALVPGRKLILGGVDIPHDRGLLGHSDADALLHAVTDALFGAAALGDIGRHFPDTDPNFAGADSRVLLREAVRRVREAGYEIGNVDATVIAQKPKLAPHISGMVANLAEDLGLPVTRCNVKAKTNEKLGFEGKEEGIVAQAAVLIYRRNGDAQD

SEQ ID NO: 22970 - protein, 409 aa, Populus trichocarpa
MASAGVAPTSGLREAGVHNAGVDKLPEEMNDMKIRDDKDMEATVVDGNGTETGHIIVTTIGGRNGQPKQTISYMAERVVGNGSFGVVFQAKCLETSETVAIKKVLQDKRYKNRELQTMRLLDHPNVVSLKHCFLSTTEKDELYLNLVLEYVPETVHRVIKHYRKLNQKMPLIYVKLYTYQIFRALSYIHRAIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKVLGTPTREEIKCMNPNYTEYKFPQIKAHPWHKIFHKRMPPEAVDLVSRLLQYSPNLRCTALDALTHPFFDELRDQNTRLPNGRFLPPLSNFKSHELKGVSVEMLVKLVPEHARKQCAFLGL

SEQ ID NO: 22971 - protein, 616 aa, Ralstonia metallidurans CH34
MLADDGGTVVVGSNLPGDPAAPEPASGYRKGMRPIHARSYMVSTSNAYASAAGCAVLSRGGTAADAAVAVQAVLGLTVPEATGLGSGGFLLYYDATTRTVQAYDGRETAPASAGANYLVHIDDARDRRSPKPDLRSSGRSIGTPGVPRLIERVQREHGKLPWPGLFDDAVTLATNGFPIGGRLAQAIATNANGLKRDAEARAYFLDPDGKPKAIGTVLRNPAYARTLQALASQGADAFYTGPIAEGIVVSIAATTGADGRPITPGKTTLADLAAYTVKRHEPVCMAYRAFWICGAPPPAGGITVASVMGILENFDLAELGPTAVDGEGGKPSVHGVHLVSEAERLAYADRDKYVADPDFVPLPGGSADALLGKRYLRGRAALIDRHRSMGTAMAGSLGGALLGVVPQAEHGTNHFSIVDAQGSAVSATTSVEASMGSFHMTHGFLLNNQLTDFSATPVDARGQPVANRVEPGKRPRSSMAPTLVFRKGADGSIGDFLMATGSPGGGAIPQYVIKTLVGVLDWGLNAQQSAGLVDFGASNSPVTTLGGEHPHINTTNDGASDPLVQGLKALGHRISLRAQPSGVNTILRTRTGDDDLLEGGTDPRREGVVLGDTIRP

SEQ ID NO: 22972 - protein, 546 aa, Bacillus cereus
MKKYRVDVQGMTCTGCEEHVAVALENMGATGIEVDFRRGEAVFELPNALGVETAKKAISDAKYQPGKAEEVQSQEMVQLGNEGDYDYIIIGSGGAAFSSAIEAVKYGAKVAMIERGTIGGTCVNIGCVPSKTLLRAGEINHLAKNNPFVGLHTSAGEVDLAPLIKQKNELVTELRNSKYVDLIDDYGFELIEGEAKFVDEKTVEVNGAPISAKRFLIATGASPAKPNIPGLNEVDYLTSTSLLELKKVPKRLVVIGSGYIGMELGQLFHNLGSEVTLIQRSERLLKEYDPEISESVEKSLVEQGINLVKGATYERIEQNGDIKKVHVEVNGKKRIIEADQLLVATGRTPNTATLNLRAAGVEIGSRGEIIIDDYSRTTNTRIYAAGDVTLGPQFVYVAAYQGGVAAPNAIGGLNKKLNLEVVPGVTFTAPAIATVGLTEQQAKENGYEVKTSVLPLDAVPRALVNRETTGVFKLVADSKTMKVLGAHVVAENAGDVIYAATLAVKFGLTVDDIRETLAPYLTMAEGLKLAALTFDKDISKLSCCAG

SEQ ID NO: 22973 - protein, 217 aa, Caulobacter crescentus CB15
MSQALAEIRARIAAAEARAERPAGSVTLVAVSKTQPWDHIAPVLDVGQKVFGENRVQEAMERWGPHRQGLELRLIGPLQTNKAREAVGFFDVIETLDREKLARVLAEEVQRAGKAPRLYVQVNVGQETQKAGVAPGDADSFIGACRTTYGLTIEGLMCIPPFDQDPAPHFAQLASIAERNGLDKLSMGMSDDFEIAIAQGATSVRVGSALFGSRVYS

SEQ ID NO: 22974 - protein, 447 aa, Clostridium difficile 630
MRRKKMGSNELKKTLGVSAALSTVVGSVIGAGVFFKPQAVYTLTGGAPGLGILAWLIAGIITITAGLTAAEVSVAIPKTGGMMVYIKEIYGEKLGFLTGWMQIVLFYPGMMAALGVIFGEQASALIGSPSLLLPIAIGIIIIVAGLNMLGSKTGGVIQTVSTICKLIPLILIMVVGFIKGGGNNPILTPMVGEGLSLGSVLGQVLIAILFAFDGWMNVGTLAGEMKNPGKDLPKAIIGGLSVVMAVYFIINLAYLWVLPANELANYASPASAVAEVIFGSMGGKIISVGILISVFGALNGFLLTGSRVAYTLATDKTLPKYGIFSKLNSAQVPANAIALVSVIASIYALSGQFNLLTDLAVFATWIFYVLTFIGVMKLRKTHPNIPREYKVPLYPIVPIIAIASGIFVVVNQLCFAGMKTTMISIGGLVITAIGLPVYAYMTRGVKR

SEQ ID NO: 22975 - protein, 362 aa, Triticum aestivum
  misc_feature (49)..(49): Xaa can be any naturally occurring amino acid
  misc_feature (73)..(73): Xaa can be any naturally occurring amino acid
MGSTAADMAASADEEACMYALQLVSSSILPMTLKNAIELGLLETLVAAXGGKLLTPAEVAAKLPSTANPAAAXDMVDRMLRLLASYNVVSCTMEEGKDGRLSRRYRAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 22976 - protein, 360 aa, Streptomyces avermitilis MA-4680
MTEAILLVGGRGTRLRPLTVHTPKPMVPAAGVPFLTHQLARARAAGVDHIVLATSYLAEVFEPYFGDGSALGLHLEYVTEEEPLGTGGAIRNVASRLHSGPDEPVLIFNGDILTGLDIRALVHTHETTAADVSLHLTKVTDPRAYGLVPTDETGRVTAFLEKPQTPEEIVTDQINAGAYVFRRSVIDTIPAGRPVSVERETFPGLLSAGAHLQGMVDSTYWLDLGTPAAFVRGSADLVLGRAPSPAVPGRCGDRLVLPTASVASDAKLTGGTVVGEGAFVGEGARIFGSTLLSGAVVEPGAVITDSLLGARSRVGERSILTGAVIGDGAVIGADNELRDGVRVWCDARIPAGAVRFSSDQ

SEQ ID NO: 22977 - protein, 423 aa, Oryza sativa Japonica Group
MMASLHRPLSAMAVAAFAAVSSLELPDRLSHHKLPDTTVDAEAVVSIPASRPDVSAAPSASAMSRLHFLPRNLQTSHPAKAPPASLPVIHTVYHYAKFAKYYSEEEAVTTAMPSSSSPDVLYLWHLPDPKVCGDSHGKSQTVVVLLGWLGSRQKHLKRYADWYTSRGYHAVTFTLPMSDIVSYNVGGKAEKNVEMLSEHLADWVSEEDGKKIVFHTFSNTGWLCYGVILENLQRQDPSAMDKIKGCVVDSAPVAVPDSQVWASGFSAAIMKKHSVAAKGVKPNDARPDVLVVESNKDHPKPAVSEAILLSALEKLFDVVLNYPAINRKLSGVMELLSSKQPKCPQLYIYSSADRVIPAKSVESFVESQRRAGHEVRACDFVSSPHVDHYRSNPELYTSQLTEFMEDCVLARCQAKEEEEEVTN

SEQ ID NO: 22978 - protein, 456 aa, Brucella melitensis 16M
MVPHGSCPSGAREVTFEGWRRERGEASMSDVHRTIRVNRSGSKFRRALSFFGPGYLVAVGYMDPGNWATSLAGGSRFGYALLSVVLLSNLMAVLLQALCTRLAVATGRDLAQACRDAYPRFLAWPLWLLAELAICATDLAEVIGTAIGLNLLFGIPLEIGVILTAVDVLLVLYLQNKGFRRVEALIITLLGVIALCFLTQIIMAQPQWGEVIKGFAPTTEIVSNPDMLYIALGIIGATVMPHNLYLHSGIVQTRDYGHTTAEKREAIRYATLDSTIALTFALVINASILILAAASFHATGHTGVEDLDKAHALLNPLLGSAIAPALFAIALLCCGLNSTITATMAGQIVMEGFIDIRLKPWIRRAITRFVAIVPAAIVTILYGSQGTTELLILSQVVLSLQLPFAVIPLVIFTAQKKKMGSLAAAPWVTFLAAITAAIIVVLNLKLIYDFFTGAPI

SEQ ID NO: 22979 - protein, 327 aa, Gibberella zeae PH-1
MSFNPNNDIPDLSGKVIIVTGASSGLGKESALQLAKHNPATIFVTARTEKRGNAAIKEIQDAVPNFKGQIKFLELDLSSFASIQKGATAFLNQSDRLDILMNNAGLMATPAGLTTDGYEVQFGSNYMGPALFTKLLLPTIVRTAQQQGDARVINLSSELFKQAPKEGVLLSRVKTPLEDISSLARYGQSKLADYYHTRSLSKYYPSVKFVAIHPGVVNTGLFDDLRKRRPWLGGLIGVMGSIFLTDVHAGAKAQLWASTAKSESVRSGGFYNQKLKEYKDAVLDDEKAVEELWDWTEKEFAIIITSIQQKRKVIVEVGYAKLPLQLS

SEQ ID NO: 22980 - protein, 315 aa, Magnetospirillum magnetotacticum MS-1
MSAVTSNLPQRDAFWTRVYEIARQDRDVIIISADMGAPALDKIRLDLPNQFINAGIAEQNAIVVGSGLAMAGKKVFAYAIAPFITLRCLEQVRVNNCMMKIPLTLVGVGAGFGYQDSGPTHHMLEDIAVMRAFPTIEIDSVSDSVMAADVAERSIKERRINYVRLDRQTLPDLYKAGHDFRPGLEVLRPGKDIMLVGTGIMTHAALETAEVLAKKGIDAGVVDLYRLPVNAQALLAAVKGAKKVATLEEHFLPGGMGSAVAEVLADAGATVPLKRLGLPVEKGYCYTYGGRDALHNWYGIGAQQIIDSLVGFAKG

SEQ ID NO: 22981 - protein, 385 aa, Bacillus subtilis subsp. subtilis str. 168
MNIHEYQGKEVLRKYGVSVPEGKVAFTAEEAVESAKSLSSSVYVVKAQIHAGGRGKAGGVKIAKSLDEVKAYAEELLGKTLVTHQTGPDGQVIKRLLIEEGCDIKKEYYIGLVLDRATSRIVLMASEEGGTEIEEVAEKTPEKIKKAVIDPAVGLQGYQAREIAFAINIPKELVGKAAKFMLGLYKAFVEKDCSIAEINPLVVTGDGNVMALDAKLNFDSNALYRQKDIMEYRDLDEEDPKEIEASKYDLSYISLDGNIGCMVNGAGLAMSTMDIIKHYGGEPANFLDVGGGATAEKVTEAFKIILSDQNVKGIFVNIFGGIMKCDVIAEGVVEATRQVGLTLPLVVRLEGTNVDLGKKILSESGLNITSAESMADGAQKIVSLV

SEQ ID NO: 22982 - protein, 337 aa, Fusobacterium nucleatum subsp. nucleatum ATCC 25586
MIIMSFLGQVRKKALQANRRIVLPESSDERIIRATSQILKEGLAQVVLVGNQEAIMHSAKAYEVSLSGAKIVDPYNFERLNDYINKLVELRAKKGMTPEEAKKILLNDPTFFGAMLVRMGDADGMVSGSASPTANVLRAAIQVIGTQPGVKTVSSVFIMELSQFKDLFGSILVFGDCSVIPFPTSEQLADIATSAAETAIKIAGINPRVALMTFSTKGSAKHECVDRVIEAGHILRERKVQFRFDAELQADAALVKSIGEIKAPLSDVSGNANVLIFPTLSAGNIGYKLVQRLAGANAYGPIIQGLNAPVNDLSRGCSVEDIVVLTAITSAQACIDC

SEQ ID NO: 22983 - protein, 599 aa, Lactococcus lactis subsp. lactis Il1403
MTVLDKVNDPTDIKALTPLELEELATNVRDAILNRVSQYPGGHLGPNLGVVEMTIALHKVFNSPVDKLIWDVSHQSYPHKVLTGRKEFFTDKDKFSGTTGYTDPEENEHDFIRVGHTSTSIATAMGYALARDVQGKKENIVAIIGDGALSGGLAFEGLDGAGTLNGNLIIIVNDNEMAITENHGGIYQHLADLRASKGTSANNLFKSFGLDYRYLEEGNDIQSLIVLFESVKDINRPIVLHIHIEKGHGYKPAVENKEGMHQVFAPFDIATGQPVNSSTNIVRSYNNVFLDFMEEKLAKGDNLIAINAAIPMFFGLSQFAKNHPKNYVDGGIAEQYTVTLGGAIAAAGTRAIIFQNATFLQRAYDQLNHDLALNKEPAIVIISNSQIGGTNDTHQGSFVYSQTSNIPNVIDLAATSEEDLFAMLNWAYNQHEHPVFIHLPEHTLENRPTKITDFSKPQYEVVKSGEKVAILGLGAMLEKAENVAEELEKSGFNPTVVNPFFANLLDVAALDKLSETHGLFVTIEDGTKDGGFGQKVATYLASKGIKTLVYGADTEFIDAVPKEELYNRYHIRPELMATDIIEATKESKGPNFFKKIFSK

SEQ ID NO: 22984 - protein, 228 aa, uncultured cyanobacterium
HEVAGAGQHELGMKFAELIQAVDNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEDNRSAAVRIPLTGPSPKAKRLEFRSGDALANPYLAFSAMMMAGFDGIKNQIDPGDGVDVDLFELPADELAQIATVPASLNGALEALNADKHYLMEGGVFSE

SEQ ID NO: 22985 - protein, 307 aa, Emericella nidulans
MAPFKVTFLGPAASFSHQAAVETFGRSSELIPCLSFADAIAAVQRRDADYAIVPFENSTNGSVVQTLDLLVDRNGSYNDVKVCGEYYLTVHHCLLARKGFISAARRNYSSITKIYTHPQAWGQCEIFLAKYFKGVERQDVSSTSKASETVLKTTSEVNAAIASRFAGEYYGLDILEENIEDTANNTTRFLVLRNVYSTTTIQFQPELARELSKSPAVLETKKALFSFMVRQDTLGTLADALLIFKDRGLNLTSINTRPSHIQAWKYVFLVESETDQNQEVPDIMDSLRKVTENCKHLGTWANKLVST

SEQ ID NO: 22986 - protein, 114 aa, Sordaria macrospora
GGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTTAQGGVLPNIHQNLLPK

SEQ ID NO: 22987 - protein, 228 aa, uncultured cyanobacterium
HHEVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKCLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTK

SEQ ID NO: 22988 - protein, 346 aa, Leuconostoc mesenteroides
MKKLMQGTKKMTKIAVLGGGSWGTALANVAAENNNDVRLWTRTATQADEINSQHTNQKYLPDAKLSSELMATSNMALAVMDAEIVLTVVPTKVVREVARQLADVLNKQDHQVILAHATKGLEQVTYKRVSEMLAEEVPAKYRSTLAMISGPSHAEDVIKHDLTSVSIASENEEAAKLLQQVFANSSFRPYTNHDLLGSELAAALKNIIAIGSGALIGLGYGANAQAALLTRGLSEMRSLGQAMGAQPETFLGLAVIGDLIFTGMSPNSRNYRAGKQLGEGKSLQEIQDDMGMVIEGVSTTKAVYEFSQHHHVEMPITAGIYRILYENEPLRDVISDLMSRPLRSED

SEQ ID NO: 22989 - protein, 513 aa, Lactococcus lactis subsp. lactis Il1403
MSDTTLEKIIVLDYGSQYNQLIARRIREIGVFSELMSHKVTAKEIREINPIGIILSGGPNSVYDEGSFDIDPEIFELGLPVLGICYGMQLLSYKLGGMVEAAGEREYGVAPLQLTGKSALFAGTPEVQDVLMSHGDRVTAIPEGFHVVGTSPNSPFAAVENTERNLYGIQFHPEVRHSVHGTEMLRNFALNICGAKGNWSMENFIDMQIKNIREKVGDKKVLLGLSGGVDSSVVGVLLQRAIGDQLTSIFVDHGFLRKGEADQVMETLGGKFGLNIIKVDAQKRFMDKLVGLSDPETKRKIIGNEFVYVFDDEANKLEGVDFLAQGTLYTDVIESGTDTAQTIKSHHNVGGLPEDMQFQLIEPLNTLFKDEVRALGTQLGMPDEIVWRQPFPGPGLAIRVLGDLTEEKLETVRESDAILREEIAAAGLERDVWQYFTVNTDVKSVGVMGDQRTYDYTLAIRAITSIDGMTADFAQLPWDLLQKISKRIVNEVDHVNRIVYDITSKPPATVEWQ

SEQ ID NO: 22990 - protein, 380 aa, Sulfitobacter sp. EE-36
MASTPKIAALIVAAGRGTRAGGAVPKQWQPLCGKRVIDHTLAAFQRHPQIDRIIIVLSASDMAQAEGFTAQGCLVAEGGADRAASVRNGLALLGDADLVLIHDAARPCVTPQIIDGVIDALVTDAAAAPGLPVTDALWVAEDGAVAGTQDRTALYAAQTPQGFDAATIRAAHAAFEGIAADDVEVARAAGVAVAITPGSVDNLKITVPGDLTRAARILESSMDIRTGNGFDVHAFGPGDHVTLCGVDIPHDQGLVGHSDADVGMHTVTDAIYGALAMGDIGQHFPPSDPQWKGAQSHIFLRHAADLARSEGFTLTHVDCTLICEYPKVGPHAAEMRRVMADILSLEESRVSVKATTSERLGFTGRGEGIACMATATLVKL

SEQ ID NO: 22991 - protein, 99 aa, Brassica napus
  misc_feature (94)..(94): Xaa can be any naturally occurring amino acid
MATESPFRADVLKGKAALVTGGGSGICFEIAAQLARHGAHVAIMGRRREVLDKAVAALRSEGLRAVGFQGDVRNQEDAARVLASTVEHFGKLDXLVNGA

SEQ ID NO: 22992 - protein, 450 aa, Xanthomonas oryzae pv. oryzae KACC10331
MPDHLPRDAADALQAPAQLDAFWMPFTANRQFKARPRLLASAQGMYYRDVDGRQILDGTAGLWCCNAGHSRERIVAAIREQAGTLDFAPTFQMGSPLPFVLAQRLAAIAPPGLCHVFFTNSGSEAVDSAMKIVLAYHRLRGDGQRTRFIGREKAYHGVGFGGMSIGGLPNNRKWFGPLLAGTDHLRHTLDIERNAYTRGLPAHGAELADDLERLITLHDASTIAAVFVEPVSGSAGVILPPEGYLQRLRAICNRHGIVLVFDEVITGFGRVGDTFAAQRFSVTPDIITAAKGLTSGTVPMGAVLVADAIHDAFMHGPQSVIELFHGYTYSGHPLACAAAIATLDTYAEEDLFTRAITRGAQWEDAVHSLRGLPHVIDIRNIGLIGAIELAPRDGAPGARGYEIFERCFHEGGLLVRVTGDVIALSPPLIVTPEQIGQMVETLGNILRSTA

SEQ ID NO: 22993 - protein, 186 aa, Oryza sativa Indica Group
VEPPEEAKVYVGNLPYDIDSERLAQLFEQAGIVEVSEVIYNRETDRSRGFGFVTMSTVEEAEKAVEMFHRYDVDGRLLTVNKAAPRGARVERPPRQFGPSFRIYVGNLPWQVDDSRLVQLFSEHGKVVDARVVYDRETGRSRGFGFVTMATQEELDDAIAALDGQSLDGRALRVNVAEERPPRRGF

SEQ ID NO: 22994 - protein, 125 aa, Brassica napus
PTRPKKIKSFSSQAVSLCETLLLCIVKLNVTRKKKKTKVLFMEKKQGFFSALRGLSPSRSRTRSRSVSPARSSSPMTGGRKNFTGGAAAANYYVTQPELLIERSGSLRPVMEGPDLDEDGRELDD

SEQ ID NO: 22995 - protein, 488 aa, Vibrio angustum S14
MGKPTGFLEFGRELPKKLDPSVRIQDNKEFVLNDEFGDKINEQSSRCMDCGVPFCHNSCPIGNIIPEFNDAVYRDSWEEAWNILSSTNNFPEFTGRVCPAPCESGCVLGINQDPITICNIEKTIVETAYREGYAKPKTPRSRTGKTIAIIGSGPAGLSAAEQLNSAGHTVTVFERDEKVGGLLRFGIPDFKLGMDIIDRKINLMAEAGVKFEVNAHIGVDINAKQLRQDFDVVLLTGGSTVPRNLPIPGRELNGVHFAMEFLAQNNRRANDMDLKTKEIHAKGKHVVVIGGGDTGSDCVGTSNRHGAASITQVEIMPVPPEKRPANQPWPSYPMIMKTSTSHEEGCDRYWNILTKEFISDDNGNVKGLRIADIVWQEAKPGERPGFDEVEGSERVIACDLAFLAMGFLHPEPTGVLAQLDIALDERGNVATEDFATNQAGVFAAGDMRTGQSLVVRCINEGRESARAVDAYLMGNTNLEAKADSLMLS

SEQ ID NO: 22996 - protein, 470 aa, Vibrio angustum S14
MSQNVYQFIDVERIDPPKKPLNVRKIEFVEIYEPFTKQQAGAQADRCLDCGNPYCEWKCPVHNYIPQWLKLANEGRIIEAVELSHQTNTLPEVCGRVCPQDRLCEGSCTLNEDFGAVTIGNVEKYITDKAFEMGWKPDMSGVEWTDKKVAIIGAGPAGLSCADILVRNGVKPVVFDRYPEIGGLLTFGIPSFKLEKDVMVNRRKIFTEMGVEFQLNTEIGKDVTMESLLADYDAVFLGVGTYKNMRAGLENEEATGVYDALPFLISNTYKVMELESPSTFLDMKDQRVVVLGGGDTAMDCVRTSIRQGAKDVVCAYRRDEANMPGSKREVKNAREEGVNFMFNLQPLGIEVDNSGKVTGVKVVKTALGEPDSAGRRRPEPVSGSEHVLGADAVIMAFGFQPHAMPWLTPYDVELDQWGRIKTSFDAHFAYQTTNPKIFAGGDAVRGSDLVVTAIDEGRKAADGILDYLNV

SEQ ID NO: 22997 - protein, 455 aa, Ustilago maydis 521
MSNLPSEPEFEQARNELATTLAPFLEQYPEYNKAFEIVQIPERIIQFRVVWEDDNHVSQVNRGYRVQFNSALGPYKGGLRLHETVNLSVLKFLGFEQIFKNALTGLNIGGGKGGSDFNPKGKSDGEVRRFCKAFATELQRHIGPNTDVPAGDIGFSTREAGFVFGTYKQLRNEWTGVITGKALDWGGSNIRPEATGYGLIYYVEHMINHVEQGTNGFNGKKVVISGSGNVAQYAALKVLELGGTVLSLSDSKGSLIAKDTKGFTAEMISKIAEIKYNRGELESFGTASGALEWHAGARPWKLFSSYDVALPCATQNELNADEAKFSLSAGCRYVAEGSNMGLDQAAIDVYEQSRITDPSKACWYGPGKAANSGGVAVSGLEMAQNSARLTWSPEEVDQKLKDIMKNAYENCFKTGQAFPAKNDKVADKLPSLVGGANIAGFKKVADAMKQHGDWF

SEQ ID NO: 22998 - protein, 321 aa, Physcomitrella patens subsp. patens
MARLGSFVAVLVLVCAASFVNVADSAGLVNNFYRKSCPNAEKIIRDSIYRMYEKKGNIATSFIRFGFHDFFNGADASFFLLSAPGKTSEKDSHSMVGMRNEKYVNNIKAEVEKVCPGVVSCADILAVGSAAAVQVLGGPYIHVKTGRKDTRNSMKSSADTIPRPQDGVTKVLTFYKNIGINPREAVALMGAHTIGRAHCTSFIERIFPKVDPKMDPVFAEKLKRRCPAKPTSVHFTYFRNDEPSPMAFDNNYFKNLVTKQGLMGIDSALYWDGRTQKYVIEFSQNEAAWREVFTVAFKKLSEYKVLTGRQGEIRKRCMYVN

SEQ ID NO: 22999 - protein, 203 aa, Photobacterium sp. SKA34
MVLVGRQAPDFTAAAVLGNGEIVDNFNFAEFTKGKKAVVFFYPLDFTFVCPSELIAFDKRFEDFQAKGVEVIGVSIDSQFSHNAWRNTAVEDGGIGQVKYPLIADVKHEICKAYDVEHPEAGVAFRGSFLIDEDGLVRHQVVNDLPLGRNIDEMLRMVDALNFHQKHGEVCPAQWEEGKAGMDASPKGVADYLSEHTADLGKK

SEQ ID NO: 23000 - protein, 605 aa, Vibrio campbellii AND4
MSQSVLSQINVFPVKSVGGVSLSSAWVEKQGLSFDRRFMIATSDGSMVTARKFPQMVTIKSALLPDGVVFTSLGEEPLTIRYQDFKMQEAPATVWKDSFTAYTTTDEADDWFSKVLGLRVELLFTGEQSNRVRDKLGHNVSFADGYPVLVISEASLEELNRRSAEQHSMDQFRTNLVVSDTTPFEEDTWKRIRIGEVEFESVKPCERCILTTVNTQRGTFRESKEPLKTLQEFRANERGGVFFGQNLVALNQGIIRSGDHVEVLEYKEPEFYPDNSPKRMTLTCVEREEIARDFVTLWLEPREGQLPTYLPGQHLPIVVEVDGQTIGRRYTLSSSPSRPGRYAISVKRVSGGRVSNALLDNLQIGDVLEAETPDGQFHLKAHAVQPLLLMSAGSGVTPMLSMVRYLADHNQLDDVVFYHQCSSEIDIPCKDELNELKRQNPGLDVKICLTQPSIDWFGLKGRVSLSHIKQIKDVEHRQVFVCGPDGFMQKAKNLLLKKGLPEGNYHQEAFGVAMAAAKPEKSVEIEFNGVKWMGNNQQTLLEQVENAGKHITNSCRAGLCGACEVQLESGLVDHPDLPALSAEERAMGKVLACCAIPQTDVTLKD

SEQ ID NO: 23001 - protein, 411 aa, Streptococcus iniae
MKKIAVAGTGYVGLSMAVLLAQHHQVIAVDIVPEKVDLINAKKSPIQDKEIEEFLASKELHLKATLDAESAYQDADFVIVAAPTNYDSKRDFFDTKAVEAVIEAVLAVNTQAIIIIKSTIPVGYTDSIRQKFNTTNIIFSPEFLRESRALYDNLYPSRIIVGTDLSNQRLTQKANEFARLLQEGAIKEPIETLIMGFTEAEAVKLFSNTYLALRVSYFNELDTYAETKGLDTKAIIDGVGLDPRIGDHYNNPSFGYGGYCLPKDTKQLLANYRDVPQNMMTAIVESNRTRKDYIAEKVLELAGAYEGSSEFDPNMEKEVVIGVYRLTMKSNSDNFRQSSIQGIMKRIKAKGAKVIIFEPSLDDGSTFFGSQVVNDLETFKKTSQSIIANRYDSALDDVQEKVYTRDLFGRD

SEQ ID NO: 23002 - protein, 321 aa, Caulobacter crescentus CB15
MLAVQAVRTGGPEVLEVVDLPLPSPGPGQILVRHQAVGLNYIDTYHRSGLYPVKTPLVIGLEAAGVVESVGEAVTRFKVGDRVAYNGTMGAYAQAAVVPAERAVLVPDGVSLEVAAAALLKGMTAEFLVRRCFHVKQGDWVLVHAAAGGVGQILVQWCKALGATVVATVGSTAKATIARDLGADHVIDYSHEDVAARVAELTGGRGVAVVYDGVGKDTWEASLASLARRGMLVTFGNASGPAPAFPPLALAPKSAFVTRPKLFDYIVTTEELDESAQALFAVIASGAIKIDIGQTFPLAEARAAHEALEGRRTTGATLLLP

SEQ ID NO: 23003 - protein, 481 aa, Saccharophagus degradans 2-40
MKIHNMKNFINGEYIASQADGAIDVLSPSTGKKVGDIPAGCVEDAQLALDTANAAQKLWAKKTNRERAKILRVFAANIRAAADDLAKLLVSEQGKLLSVAQMEVEATATFIEYACDNALTIEGDILPSDNPNEKIYIHKVPRGVVVAITAWNFPLALAGRKIGPALVTGNAIVVKPTQETPLATLALGELANAAGIPAGVLNIVNGRGSVVGQHLCESPITRLITMTGSTPAGQRIYRTSADHLTPVMLELGGKAPFIVMEDANLESAVEAAFTTRYANCGQVCTCAERLYVHESIYPAFMDKLLEKVKAIKVGDPMAADTDMGPKVNQSEIENIDALVKKGIEQGATLLHGGKRAHVPGFEGGNWYEPTLLGDVQQSNILVHEETFGPILPVVKINSIEQAIEYTNDSEYGLSTYLFTQNLKYIHQYIAEVEAGEVYVNRGIGEQHQGFHNGWKLSGAGGEDGRYGLEQYLEKKTVYFAE

SEQ ID NO: 23004 - protein, 343 aa, Ostreococcus tauri
  misc_feature (215)..(222): Xaa can be any naturally occurring amino acid
MYGMGASILKRDRDADGVGRKGQKAVVSASEEGSREAAAVDERSAGEMASAHDYMLPVRAYYVGSMIDVRALAKQLPAYPKEFNREGVIIRMSPKMEQGDMSALDGDAPIPPDMLSRYLVVFKFGSVVFYNMGLREREECLKLARTFTSTPLPVPMTDDYRVVVRPGLADWASLENDHIVLKRMDINNISVISSVLAQTVALEHYEQKVDGMVEXXXXXXXXTGDLNISKKRLFSLVAENNNTLTELITKLGLLGRSDTAWQYAQYNLVWEGLRQDFELEERFQDLDYKLNLIQTQVKFYLEILQNRKSDALEWIIIVLISLEICVSLYDMSDKIPSIPWPPL

SEQ ID NO: 23005 - protein, 258 aa, Saccharophagus degradans 2-40
MTSPVLNSFNLEGKVALVTGCKRGIGKAMAVALAQAGVDVIGVSASLESEGSDVAKAVEATGRKFSAYKCDFNSREAIYTFIEQVKAAHPVIDILVNNAGTILRAPAAEHGDSLWDEVINVNLNSQFILSRELGREMVKRGSGKVIFTASLLTFQGGITVPGYAASKGAIGQLTKALANEWAGSGVNVNAIAPGYIATDNTQALRDDPERATSILSRIPQNRWGKPEDFAGPVVFLASEAASYVNGSVMVVDGGWMGR

SEQ ID NO: 23006 - protein, 257 aa, Glycine max
MAYPHYRSQFGDTTFTKVFVGGLAWETPTEEMRKYFEQFGDILEAVIITDKNTGKSKGYGFVTFRDPESARRACTDPNPVIDGRRANCNIASLGRPRPSPPRGRGTFQGGGAPGTTAASYGGVPAAGPPPALAPPPPPLVYPPYGYPTYTPDYGYHQATMYNPQIQQPQYYHQQLYGPSSSTMGSPYYYGYSVQAPRGTFSSTQPHRLPAGPSYLYYPTPMEGSFPAYRPPPQLQQLPIRQPPSSPSGVHMGNPSPM

SEQ ID NO: 23007 - protein, 338 aa, Saccharophagus degradans 2-40
MKAAQYAGNKSFNVVDGAKVPPAEGEVCLQVGYTGICGTDMHIYHGVMDQRVSIPQIIGHEMSGTVVEVGAGVTDYTVGDRVVVRPLDYCGDCPACNAGHSHVCHNLKFMGIDSPGAFQSYWTVKARTLHALPDNVSLKQGALIEPLSVACHDVARTRLQAGEKALVIGGGPIGQLVALVAKSVGAEVMISEVSEARLKFAAERGIKTVNPVTDDIEAVVKEWTGGKGADAVFEVSGVAAAVETMTKVAAVRGRICMVAIHSQKPQVDLFQFFWKELELLGARVYESADFEHAIELVASGKIDVDSFISSVTSLNDIGTAFASMDNNPAGMKALVECN

SEQ ID NO: 23008 - protein, 134 aa, Oryza sativa Japonica Group
MAGRGKAIGSSAAKKATSRSSKAGLQFPVGRIARFLKAGKYAERVGAGAPVYLAAVLEYLAAEVLELAGNAARDNKKTRIVPRHIQLAVRNDEELSRLLGAVTIANGGVMPNIHNLLLPKKAGSSAKAAAADDE

SEQ ID NO: 23009 - protein, 440 aa, Bacillus subtilis subsp. subtilis str. 168
MQLNEDTESDRLYRMTDSYKRYGKVKRVIGLMIESKGPASSIGDLCLIYAKGQSGKVIKAEVVGFQEENILLMPYLEAASIAPGSIVEATGESLRVKVGTGLIGQVIDAFGEPLDESFCRKVSPVSTEQSPPNPMKRPPIREKMGVGVRSIDSLLTVGKGQRIGIFAGSGVGKSTLMGMIAKQTEADLNVIALVGERGREVREFIEKDLGKEGLKRSIVVVATSDQPALMRLKAAYTATAIAEYFRDKGQNVMFMMDSVTRVAMAQREIGLAAGEPPTTKGYTPSVFAILPRLLERTGANEHGTITAFYTVLVDGDDMNEPIADTVRGILDGHIVLDRALANKGQFPAVNVLKSISRVMSNISTKQHLDAANKFRELLSTYQNSEDLINIGAYKRGSSREIDEAIQFYPQLIQFLKQGTDEPALLEESIAALTSLTGNEE

SEQ ID NO: 23010 - protein, 439 aa, Cryptococcus neoformans var. neoformans JEC21
MSSNFYTSSHNRYWLLTRPSLLESRQTDLKYCTSRQLYCLFIFFSQLIQKLGKRLLLRQIPIATACVFFKRFYFKNSLCETNPYLVLAACIYVAAKVEETPVHIKSVVSEAKLVFHEHNIKMFPAETNKLGEMEFYLLEDLDFHLVVFHPYRALLHLTGRESADMGKFEKSRVQEDMEIRKKEGDAKKMREEEAKKASSKGQQPTVGQALEKEGERLEEAEETRIRRLMSRGTGEGMMEVDEGVLQISWFILNDSYRTDAPLLYPPYIIALSAIYIAFCLTSMSNSSARTRASSTQRPELLQSASINEGLNLLPPPKNAAEFLAGFQVSLPMLFGCVQEIIGLYPVWEAFEPTVMRNSQAQAKTGNAAAPVPAATGTKTGQNNDLVQDKKDKFGLEEAESLVRKMIEERMIDLGHPDNAGVEKASGTGPSNVAGKKRAR

SEQ ID NO: 23011 - protein, 110 aa, Populus trichocarpa
MEANRGQNGIQLLLAAEQEAQHIVNTARNAKMARLRQAKEEADKEIAEFRAHMEAEFQRKLTESSGDSGANVKRLEHETKAKIGHLKTEASRISHDVVQMLLKHVTAVKN

SEQ ID NO: 23012 - protein, 495 aa, Pseudomonas syringae pv. tomato str. DC3000
MLEKIKTTWFSNIRADVLAGLVVALALIPEAIAFSIITGVDPKVGLYASFCICVVIAFVGGRPAMISAATGAMALLMVNLVKDHGLQYLLAATLLCGVLQIIAGYLRLGELMRFVSRSVVTGFVNALAILIFMAQLPELTHVTWPVYAMTAAGLAIIYLFPRIPVAGRLLPSPLVCILVLTAIAIYMGLDVRTVGDMGAMPDSLPTFMWPDVAPNFDTLLIILPYSAALAVVGLLESMMTATIVDDLTDTSSERNRECKGQGIANIASGLIGGMAGCAMIGQSMINVKSGGRTRLSTLSAGILLLIMMLFLGDWLVRIPMAALVAVMIMVSISTFSWGSIRNLRQYPLSTNIVMVVTVAVVVATHNLAYGVLVGSLLAAMFFASKIARYLDVTSRRDPEHSHRTYYVTGQVFFASADRFTASFDLREKVETLAIDLREAHFWDITAVAALDKVVLKLRRAGISVDVVGMNRATATLVDRFGVHDKPDGIDSLMGH

SEQ ID NO: 23013 - protein, 425 aa, Oryza sativa Japonica Group
MERDTSSSDVSASHVGRARQRRRPTEATADGNRTNGPALLVNDQNKYKSMLIRTYSTVWMIGGFVLIVYMGHLYIWAMVVVIQIFMAKELFNLLRKSSEEKQLPGFRLLNWHFFFTAMLFTYGRFLSRQLVNTVTSDHLLYKVVSGLIKYQMFICYFLYIAGFVWFILTLKKKTYKYQFKQYAWTHMILLTVFAQSSFTVANIFEGMFWFLLPASLIVINDIAAYLFGFFLGRTPLIKLSPKKTWEGFIGASVTTIISAFVLANVMGRFQWLTCPRKDLSTGWLRCDPGPMFKPEHYSLGEWVPKGFPWKEVVLLPVQWHALALGLFASIIAPFGGFFASGFKRAFKIKDFGDSIPGHGGITDRMDCQMVMAVFAYIYHQSFISPQNYSVELILEQILRNLTFEEQKFLYQQLGEIYRERQLMQS

SEQ ID NO: 23014 - protein, 217 aa, Brassica napus
MKLRLCSGLTKPGLLLVHFMPPSFHSLPYRHGGLGLNVRCAIASRRLSSNSPKRERLRRDNKDIGKKRDSPSSQSLYARPSLLEMNKEKAANRAKVYDFLRGVGIVPDELDGLELPVTSDVMKERVDFLHKLGLTIEDINNYPLVLGCSVKKNMVPVLDYLGKLGVRKSTFTEFLRRYPQVLHASVVIDLAPVVKYLQGLDIKPVDVPRVLERFPEV

SEQ ID NO: 23015 - protein, 171 aa, Oryza sativa Japonica Group
MEHKETGCQQPEGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 23016 - protein, 311 aa, Corynebacterium glutamicum ATCC 13032
MGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 23017 - protein, 188 aa, Corynebacterium glutamicum ATCC 13032
MLSTIKMIREDLANAREHDPAARGDLENAVVYSGLHAIWAHRVANSWWKSGFRGPARVLAQFTRFLTGIEIHPGATIGRRFFIDHGMGIVIGETAEIGEGVMLYHGVTLGGQVLTQTKRHPTLCDNVTVGAGAKILGPITIGEGSAIGANAVVTKDVPAEHIAVGIPAVARPRGKTEKIKLVDPDYYI

SEQ ID NO: 23018 - protein, 87 aa, Triticum aestivum
MAQHGFLSSLRSHLRSPPPPSHTQPRRGYHVELGAREKALLEEDVALKRFKSYKNSVKRVSKIGNVLTLVVFAACSYEVVALATSTQ

SEQ ID NO: 23019 - protein, 402 aa, Corynebacterium glutamicum ATCC 13032
MELAVDLFEYQARDLFETHGVPVLKGIVASTPEAARKAAEEIGGLTVVKAQVKVGGRGKAGGVRVAPTSAQAFDAADAILGMDIKGHTVNQVMVAQGADIAEEYYFSILLDRANRSYLAMCSVEGGMEIEILAKEKPEALAKVEVDPLTGIDEDKAREIVTAAGFETEVAEKVIPVLIKIWQVYYEEEATLVEVNPLVLTDDGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSQVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 23020 - protein, 348 aa, Zea mays
MGRWGAGDIEKRCRGHWVTLVWVCVIRLGQATAEGTGGVTEQGIPGESKPAKDNVAVGSLEMFRNRKLVAMIDVDRKYGHTIINKLTCRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 23021 - protein, 266 aa, Photobacterium sp. SKA34
MHPMLNIAIRAVRKAGDHVIKSLEKPQSIEVANKGNDVVTNIDHEAETIIIETILKAYPDHCIIAAESGNKEGRDKECQWIIDPVDGTMNFVRGYPHFAVSIALRMRGRTEVAAVYDPVRNELFTATRGAGAQLNSQRVRSSQPRDLTGTVLATGLPFAAKQHAESYLKIQNALFADCDDMRQSGCTALDLCYLAAGRVDGVFKLGQRPWELAAGELIARESGAICADFTGNTNYLTSGNIVAGNARVVKPMLAKIREFGSDALAK

SEQ ID NO: 23022 - protein, 336 aa, Physcomitrella patens subsp. patens
MRVLSPLLFGHAAAMTLKTAVVLNIPDILARAEPERGALSVHEISKELPSDSVDEQVLHRVMRTLVHLKVFSAERVSESGTTVARYGLTPASRRLVQENNSRSLAPLLMYLNYISSHVPWQHLHESVLYGKDAWGTAYGMTSWEYSDVDPEYGALWNAFNKVQGAPTIEALKRYDGFKDVNVLVDVGGYQGATVAAIVAAHPHIRGINFDLPHVIAEAPEFPGVEHVSGHLLEGGVPSGDAMLMKNIVHLFKDEEAVKVLQNCKKALTANGKLLIYDPVIPSEFDEGGSPYDGVPPLMDLGLLVYGKVDRTEEQWRALLASGGFPNASFVCLQPQH

SEQ ID NO: 23023 - protein, 802 aa, Arabidopsis thaliana
  misc_feature (791)..(791): Xaa can be any naturally occurring amino acid
MVVHLISLLTQTLALIILSLPSIINTSQLDYDTLVFKQCDPLDANILQKATTKSPNYSNQNLFLRAQALSSFLRKLESESSRSKFLKTLVGNEKHAVSGWFQCREDYPSEICHKCVGDLREISSRSCGNATSARIHLRGCHLIYKFERIDTPGAQVNNHHKYKLFETPEHGLIHKICDGATAETFPGFEEMRTEALTAAETGVVDGHGFYEDSYKLLHVVAQCDGHVEACDCGECISSAAAAAAEECRWSIAGQIYLEGCHVGYTYHPHELPNDSYHEEGSKVNTGKSLAIVVGGVAALVFVAIFFMFLKSLRKKGDGSVESDLDMQQAMLTNKDEKVLKALERTRQLDIPDEKTMPVLMKLLEEAGGNWSYIKLDNYTALVDAIYSVEDENKQSEGSSNGNRGKNLKVIDSPATLKKTYETRSASSGSSIQVVQKQPQLSNGDRKRKYKSRIADITKGSESVKIPLVDDVGSEAVPKFTYIPHNIVYQSAYLHVSLARISDEDCCANCKGNCLSADFPCTCARETSGEYAYTKEGLLKEKFLDTCLKMKKEPDSFPKVYCKDCPLERDHDKGTYGKCDGHLIRKFIKECWRKCGCDMQCGNRVVQRGIRCQLQVYFTQEGKGWGLRTLQDLPKGTFICEYIGEILTNTELYDRNVRSSSERHTYPVTLDADWGSEKDLKDEEALCLDATICGNVARFINHRCEDANMIDIPIEIETPDRHYYHIAFFTLRDVKAMDELTWDYMIDFNDKSHPVKAFRCCCGSESCRDRKIKGSQGKSIERRKIVSAKKQXQGSKEVSKKRK

SEQ ID NO: 23024 - protein, 215 aa, Zea mays
MDDNEREKENENEKEKHYGTDVEDEEEDEEGNKRVVVLGPQVPLKEQLELDKDDESLRRWKEQLLGQVDTEQLGETAEPEVKVVDLTILSPGRPDLILPIPFQADEKGYAFALKDGSPYSFRFSFIVSNNIVSGLKYTNTVWKTGVKVETQKMMLGTFSPQLEPYVYEGEEETTPAGIFARGSYSAKLKFVDDDGKCFLEMSYYFEIRKEWPGTQ

SEQ ID NO: 23025 - protein, 428 aa, Escherichia coli K12
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQETRNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 23026 - protein, 572 aa, Debaryomyces hansenii CBS767
MSAKDLEMKPVVSELRGDFSGSVSDSETPANNNDMGKWDRFKDSFKRQEVSHGDEGKKLQKGISKRHLTLMALVTGVGTGLLVGSGKVLHVSGPLFLIVGYAIVGSFLYPTLQAAGELAVNYSSLSGGYNNYPRKFLDESIAFAVTWNYCIQWLSVIAVELVTAAMTIQYWDQNTKYNPDIWVSIFFVVILLINFVGSKGYGEGEFVFGSIKLCMICGFILMAIIVNCGGGPVGFIGGRYWHNPGYYTNFKGLCNVFVTGAFSLGQSEFVALSAAEQPNPRKAIPAACKLIFWRILILFLGSLTMVGLMVPYTSDKLMGSAGGANHASPFVLAAELHSVKVAPDIINAVILLSVTSVASSALYSSSRTLQSLAEQGFAPSYFNYIDKAGRPLRALVVCSIVGLFSFIAAYKKEEEVFTWLLSISGLSQIFTWNIIVVSHVRFRQVLKHNGISLDSLGYVASTGVWGSVYAIVWHWLILIAQFYIALFPVGSSTPDAQNFFENYLGACVLIFFYVGHKLWTRNWKLYIKTSDVDINADRVIFDEEVLNLEKQEYQDQLKRGPFYARVIDFLFK

SEQ ID NO: 23027 - protein, 394 aa, Marinobacter sp. ELB17
MDLQLSSRVQSIKPSPTLAVTNKAAELRAAGQDIIGLGAGEPDFDTPDHIKAAAIEAIHNGQTKYTAVDGTPALKKAIIAKFKRDNGLDYEANQILVSSGGKQSFFNLALAVLNAGDEAIIPAPYWVSYPDMVLVAEGKPVILESTAETRFKITPQQLEDAITDRTRLFVINSPSNPSGMAYTLEELQALGQVLKKYPQVMIATDDMYEPILWTGKPFCNILNATPELYDRTFVLNGVSKAYAMTGWRIGYAAGPAKVIGAMKKIQSQSTSNPASISQAAAQAALDGSQDCVQTMVTAFHERHDYLVEALNTLPGVECLKGDGTFYVFPSFQGAIDADSSVSNDVEFAEKLLKEAGVALVPGSAFGMPGHMRLSFATSQKILTNAIERLKKALG

SEQ ID NO: 23028 - protein, 313 aa, Ashbya gossypii ATCC 10895
MVNTPHREWRRDGQDEGSPQTPSPPRSGPRRLGGSPSTVSPGVRSRLLAPTTPKSRASEMFLSPSPTLRSPAAQAPPRDSDKPIREISFNLKTRLNYAFVKLQNGWQDKTLPELEEALEGSPRKRHERSPVGPAEEYSNAYATAAAGADGAAENSAQSAFLRALSSPKKKPRSESVGQGSPPRLPMFPSHNEPSEVEAIETLMALSSAQKRLPHPARDAGAFLGAQPAALGQFPTFAAAPAPAATVHRSSLSSDSSDSSASSLKRALVKPFGLAPAEVPHQAQQAQHSEVQTDVETDVEEALTSDTEDAPVTD

SEQ ID NO: 23029 - protein, 417 aa, Halobacterium salinarum
MPEANPFESLQEQLDDAGEFLDVNADVLERLKHPERVLETTLSVEMDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 23030 - protein, 433 aa, Lactococcus lactis subsp. lactis Il1403
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 23031 - protein, 855 aa, Xanthomonas oryzae pv. oryzae KACC10331
MGTFPLHFPARPHPEPALSSPSLAPVTPDLVRLRASARDKDDAIAQAAQLLVAAGCVAPGYDASMRRRECLANTFLGHGLAIPHGVVEDRHLVLRDGIAVLQLPEGVEWNPGQTTRLVVGIAAQSDTHITLLRRLTRLIQDPAQLEALFSTDDPGVIVAALTGDRAPDTSAAPATDLAETFEWTVAYPSGLHARPATRWAETARGFSARAQVRAGDQAADAKSLVGLLQLGLRAGDSITVSAEGSDAAALLKCLRVVMDSLTAQEKADAERAAQRRAAPVAGWTPPQAQPAIVGIGASPGVAIGIVHRLRAAQTEVADQPVGLGDGGAQLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPTAAGAGLTDLPAQPCILLASDLSPSDTANLDTARVLGLATAQGGPTSHTAILSRTLGLPALVAAGGQLLDIEDGVTAIIDGSSGRLYLNPSELDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELIALRAICARIRAELDAPEVPIGIMIEVPAAAAQADVLARHADFFSIGTNDLTQYVLAIDRQNSELAAEADSLHPAVLRMIRSTIEGARTHERWVGVCGGLAGDAFGASLLAGLGVQELSMTPNDIPAVKARLRGAALRQLQELAEQALACETAEQVRALEAKREDAA

SEQ ID NO: 23032 - protein, 470 aa, Sulfitobacter sp. EE-36
MTLSAPFDNSYAALPDGFFTRTTPTPVADPKLLAFNAPLAKTLGITHGSTEDLAFIFSGNELPAGADPLAQLYAGHQFGNYNPQLGDGRAILLGEVLDAKGQRRDIQLKGSGRTPYSRGGDGRAWLGPVLREYVVSEAMHALGIPTTRALAAVQSGEDVFRETALPGAVLTRVAASHLRVGTFQVFAHRGEVENLRRLTDYAIQRHYPQADGPLGLLRAVCSAQADLVAAWMSVGFIHGVMNTDNCAISGETIDYGPCAFMDAFHPNRVFSSIDRQGRYAYANQPQIVVWNMAQLATSLLQQLDDPESGVAEATEIVHAMPALIEQAWLRRFAAKIGITTPKAEDTALIDALLSLMQTDGADFTNAFRALSGDDAAGQFTDRAAFANWRDAWQQRIAAEPDPKSVMEAANPAVIPRNHRIEAMINAAVAGDMDPFHRLMTALAHPYRETDADLHRAPTTQEIVPATFCGT

SEQ ID NO: 23033 - protein, 459 aa, Arabidopsis thaliana
MPKAAWEPEYHRVFVDLCVEQKMLGNQPGTQHILKPFLQRTGARFTRNQLKNHWDTMIKQWKIWCRLVQCSDMQWDPQTNTFGANDQDWANYLHVNPEAGQYRLNPPSFLEKLELIFEDSNLDDEGTSGSKRKRIAKHRDEDNDNTGDEEDTQSASNFSSPQSKGYWSPSSHELFVDLLFQEALKGNRPDSHYPKETWKMILETINQNTGKSFTRPQLKNHWDCTRKSWKIWCQVIGAPVMKWDATSRTFGATDEDWKNYLKENHRAAPFRRKQLPHADKLATIFKGLIEPGKAYFRSYRRRVLDHHSESPQLHDPTPLSTLYTNEPVSGSEGGADEDDNDDDDEQPTPQHRRFNSVGFAESRLQDVEIVTPGCHRLKTELMKESPVSASVRQYEYTIGECIECLDSMEEVEQGSDLYLFALDLFVKKEYREIFLLLKNSSLRMSWLLRLRSGGLTIAA

SEQ ID NO: 23034 - protein, 227 aa, Zea mays
MPQPRTITKAAHESTTAPRLFFFTCVACPAPMETLLAGNPANGVAKPTCNGVGALPVANSHAIIATPPAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTDRILHHTIGLPDFSQELRCFQTITCYQVRCALLLCACFSSSLFC

SEQ ID NO: 23035 - protein, 128 aa, Photobacterium sp. SKA34
MAYSEKVIDHYENPRNVGSFDKDDQNVGSGMVGAPACGDVMKLQIKVTEEGIIEDAKFKTYGCGSAIASSSLITEWVKGKTLDEAASIKNSAIAEELELPPVKVHCSILAEDAIKAAVSDYKKKHEQK

SEQ ID NO: 23036 - protein, 452 aa, Glycine max
MPRTSTLECSGCPPLRALTFDALGLIKVVEARDKQRGAPQVVERWGDPESSKCVMAVSMIDRESHPLLAVARKNNQIEVLSPVNGDIQATITDANDLDVQSEVNNIVGLHLFAKQNSELASRHLNSWEDCTLLTCTTKGNASIRSIELVDSSTVSSCIDSPKIWNVCSGGNILCCKVDGNEKFALFGGKGVEMNIWDLNNFTKIWNSKPPPKDNLGIFTPTWFTSATFLMKDDHRKFVAGTNSHQVRLYDMSAQRRPVLSFDFRETPIKALAEDIDGYSIYVGNGSGDMASVDIRTGKMLGCFSGKCSGSIRSIVRHPELPVIASCGLDSYLRLWDTKTRQLLSAVFLKQHIMHVLFDSNFDVKGVDSLPCKEQTPTEILVSEEVEESPLKRKKSSRNKEHIPDGGERKKRSKQSKERKKSEGNDGGEKIASRDEGSRSASKKRNKRSIPVL

SEQ ID NO: 23037 - protein, 528 aa, Oryza sativa Japonica Group
MDHQLVARGLFKPLLLFVAGLIVLYALRRRRRHRRSSGLRLPPSPFGLPILGHLHLLAPLPHQALHRLAARHGPLLFLRLGSVPCVAACSPDAAREVLKTHEAAFLDRPKPAAVHRLTYGGQDFSFSAYGPYWRFMKRACVHELLAGRTLDRLRHVRREEVARLVGSLRASADGGERVDVDAALMGLTGDIVSRMVMGRRWTGDDNDAEEMRSVVAETAELTGTFNLQDYIGVFKYWDVQGLGKRIDAVHRKFDAMMERILTAREAKRKLRRQAAADGEDDEKDLLDMLFDMHEDEAAEMRLTRDNIKAFMLDIFAAGTDTTTITLEWALSELINNPPVLRKLQAELDAVVGGARLADESDIPSLPYLQAVAKETLRLHPTGPLVVRRSLERATVAGYDVPAGATVFVNVWAIGRDAAWWPEPTAFRPERFVSGGGGGGTAADVRGQHFHLLPFGSGRRICPGASLAMLVVQAALAAMVQCFEWSPVGGAPVDMEEGPGLTLPRKRPLVCTVSPRIHPLPAAASASLT

SEQ ID NO: 23038 - protein, 618 aa, Debaryomyces hansenii CBS767
MKLCELLFISFIVSLVNAKTHTWYFKTSWVDANPDGVKERKVIGFNDTWPLPTLRVNKGDRVNLYLTNGFDTANTSLHFHGLFQNGSSQMDGPEMVTQCPIPAGETMLYNFTVADQVGTFWYHSHTKGQLGDGMRAPFIIEDDDYPFDFDEEVVLSLSDWYHEKSDDLIEDFMSRYNPTGAEPIPANLLFNETRNNSWVVEPNKTYFVRIVNIGGFVTQYLWMEDHEFEVVEIDGIYVEKNKTDMLYITVAQRYGVLIKTKNSTDKNYAMMTRFDDTMLDIIPDELELNSTNYMVYNEDKDMPKEYKVDSIDDFLDDFYLKPLSKEKLYDDADQTITIDVTMDNLGDGVNYAFFNNLTYIKPKLPPLMTVLSSGEHATNELVYGSNTHTYVLQDNDVIDIVLNNGDTGRHPFHLHGHVFQLIARGSAVDDDDDPVTYGDEEDDVEFPEYPMMRDTVYVEPQSYMVLRFKADNPGVWFFHCHIDWHLIQGLAIVLVEAPLAIQADPRQKLQDDVKKHCEMLDMPYEGNAAGNSKDYLDLTGQNVQVAYLPSGFTARGIVALVFSCIAGFLGVVMIAVYGMADIPDVEERVARDLDVDIDEYEVNTSSTEQASIVEERTH

SEQ ID NO: 23039 - protein, 388 aa, Frankia sp. EAN1pec
MDLFEYQAKKLFAEHGVPVPTGKIATTPQQAREIATELGGKVVVKAQVKAGGRGKAGGVKVADGPDDAFEKASAILGMDIKGHTVHSVLVEQASNIAEEYYASFLLDRANRTFLAMASREGGMEIEEVAATNPEALARIHIDPLTGVDAAKAREIAVAAKLPEAAIEGASVLLVKLWEVFVKADATLVEVNPLILTGDGKVIALDGKVTLDENADFRHPENAELVDVAAVDPLEQKAKEKGLNYVKLEGQVGIIGNGAGLVMSTLDVVTYAGEEFGGQRPANFLDIGGGASAEVMANGLSIILSDPSVKSVFVNIFGGITACDAVANGIVQALAIVGDVSTPLVVRLDGNNAEEGRRILKEANLPVVKPVDTMDGAAKLAAELAAAAA

SEQ ID NO: 23040 - protein, 143 aa, Photobacterium sp. SKA34
MTIERTFSIVKPDAVKRNLIGAIYQRFENAGLNIVAAKMLHLDSAKAQGFYAEHEGKPFFDDLVAFMTSGPVMVQVLEGENAITRYRELMGKTNPEEAACGTIRSDFALSMRHNSVHGSDSPESAAREIAYFFAEDEIYPQGE

SEQ ID NO: 23041 - protein, 569 aa, Oryza sativa Japonica Group
MDFFSEYGDSSRYKIQEIVGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFSKYSPAIDTWSIGCIFAEILTGKPLFPGKNVVHQLDLMTDLLGTPSMDAISRIRNDKARRYLSSMRRKQPVPFSEKFPNVDPLALKLLQRLLAFDPKDRPTAEEALADPYFKGLAKVEREPSCQPISKMEFEFERRKVTKDDIKELIFREILEYHPQLLKDYMNGSENTSFLYPSAVDNFRRQFAILEENGGKSGALDRKHVSLPRATTVHSTSIPPNEGLDATSQVTQRIPTARPGRTVGPVLPFENPGAADPHSARRVVRNPMVPPAAANKSGYSYNLKSDYSDRQHQEELEKDRVQYRPAQHLMDAKVAPDTAPDIRSSQYYFTRSAPRTDLTDRAALQGSMLYGIAPFNGIAAVAGGYSKVGAVQYGVSRMY

SEQ ID NO: 23042 - protein, 498 aa, Physcomitrella patens subsp. patens
MPRTFPQPGEQALHDDNGEGPVEYDYDLFVIGAGSGGVRASRTAAGFGAKVAICELPYHPISSESAGGIGGTCVLRGCVPKKILVYGSAFGGEFQDAREFGWNINGDITFDWKRLIANKTKEIIRLNGVYKRLLAGSKVDMYEGGGKIVDPHTVDVEQTGGEVKRFTAKKILVATGGRAVPLNIPGKELAITSDEGLSLEEFPKRVVIAGGGYIAVEFAGIYSGMGAKVDLFYRKPLPLTGFDEEMREVVARNLENRGIKCHPETNLTKLEKVAGGIKVTVDNGEEHEVDAVMFATGRKPSTKNIGLEDVGVELDKTGAIKVNEYSQTNVPSIWAIGDVTNRINLTPVALMEGTCFAKTEFGGKPMKPDYENVASAVFCQPPLSVVGLTEDKAVKQAKNDILVFTSSFNPMKNTISGRVEKTFMKLIVDAVTDKVLGAGMVGPDAAEIMQGVAIALKCGATKAQFDATVGIHPTAAEELVTMRTATRRVTPKGEVLKV

SEQ ID NO: 23043 - protein, 555 aa, Oryza sativa Japonica Group
MERLRVAISHHRAALPLPTHHNHFRRRHLQLQPFPSSLSLSLPISPQLSPAPPRRHLLPPLLASASAAQAAGPAPARAAGGGGGGAKPVPLLVSLAVGLAVRFLAPRPAEVTPQAWQLLSIFLTTIAGLVLGPLPVGAWAFLGLTATVATRTLPFTAAFGAFTNEVIWLIVISFFFARGFVKTGLGDRVATYFVKWLGRSTLGLSYGLAISEACIAPAMPSTTARAGGVFLPIVKSLSLSAGSKPNDPSARKLGSYLVQSQLQASGNSSALFLTAAAQNLLCLKLAEEIGVKIANPWISWFKVASLPAIISLLATPYLLYKIFPPEIKDTPEAPAIAAQKLKNMGPVTRNEWIMVATMILAVSLWIFGDTIGVSSVVAAMIGLSILLLLGVLNWEDCLNEKSAWDTLAWFAILVGMAGQLTNLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTTAAINAVIWGVVGTFWWKFLGLY

SEQ ID NO: 23044 - protein, 500 aa, Ashbya gossypii ATCC 10895
MDDEPVTIHCHGLFFENQAYNDGAAHINQCPIPPGGGKYTYRIKVSEKQWGTYWYHSHFAAQQADGLFGPLVIHSSEEDMLLEEYDEDMVVMVNDYYHDMAATYMADYLAPGNENVEPTPDNGFIQGSGPFKYDSATYIVPHGSARNVSYVGDVAVPTLHLAPERKYRVRLINAGFFAPFNFAVDQHRLEVVEADGTVVDPVELESITMSVGQRYSFFLKREDHSSRDYLVRARFNPFCFEENTDNFDTDVHAILSYENDPGVPAPTGHGWPYDGGNTHCADTNQTMFRTRGAKVPRRSDGLNRPDIFLTLDVSFLIKERQLDRGYFNKHTYKPLGNSCTMHELAFEPDANPIRKLHTESDLETVNQGQYLINLDKRGSIVDIVINNYDDGAHPFHMHGHKFWVLRDSLNGYFHDNYYEDSASLNFENPVLRDTINVSGYGYAVIRFVVDNPGIWPFHCHIGWHMAAGLLLQINALQAEYTEWTDYPATWSSHCRLPGNA

SEQ ID NO: 23045 - protein, 127 aa, Bordetella pertussis Tohama I
MALSKAEILDAIAGMSVLELSELIKEMEEKFGVSAAAAAVAVAAPAAGGAGAAAAEEQTEFTVVLLEAGANKVSVIKAVRELTGLGLKEAKDLVDGAPKPVKEALPKADAEAAKKKLEEAGAKVEVK

SEQ ID NO: 23046 - protein, 538 aa, Oryza sativa Japonica Group
MSRLSSIYSQHRTSGLRSDRSIMPNSTSNSLRTISSVHLPYNHRARNFHISHAVGDSSEHVIINGQASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSGNTSTLADGGIKKEQDQIDSASEQE

SEQ ID NO: 23047 - protein, 892 aa, Candida albicans SC5314
MASSETLHTSNTSDSHITQKKTGFFNKLIKKSKDSKGSSKTLTQSELKSISSASRRSSIKNGKRDSIYSKQFVDDDNSSLYNDDMDDSTSIIDDETDDSMFETVDNSDSPASFEKIVTGNNSTFDNHTLSEKVMFPASTEGLDMDIPIDQEPPYVGLTYESFLSPKYVKTTRRNKQSPRVVNNLFLAQELNVNETAVNSGDAEAETEDEHDGLSHDEDFGGDTRREIFVMEFSKDGKYLAAAGRDSVIRIWKVISSPLARMEFNQLEKENGQPLRSNKRDSVFDTAPVFHRQPVREFRGHSSSVLSLAWSKNNFLITGSMDKTVKLWHVDRDRCLQTFEHEDFVTSVKFHPSDDRFFLSGSLDNGVRLWSVLENSVSYSKNLGDEVLITALEFSPDGLHCFVGGFNGSLFILETKGLFEVFRVEIKERSIVHPFVNKNGNKITGIKVFDNNLYQGSGVPGQLDKWTVLVTTNDSKVRIITTTQKRLITRFRGLTNNSSSIVAHSSDDQKYIISGSEDHYCYIWENNNSIINNKLKQSLKEFMIDGKQHISDFHHKHEKYSKFVSLNKFLNKFLEEDKDRKYDFVANENNSYTCFHAHHSRCNVAIFAPESTKKHLLLSDDLIYDLKRRGESCRISPSSCFTCNSKNHKLEDTVQSGDIIVTTDQFGLIRVFRQDCAYAYRRMFIDFYRKGQIKNCNDIQSITQSEKTLPIRRALTRRDRSTSRIRAPSLSPVRQSENSKSIRNILASKINSSVPSTPSSETSFSSTIGSSSIDTRHYPGVAVLPKNPMLSISAAARNPSFMQPGVSVPIDHDNVVEADRTGSDTTLGAESGTQTPQPTLNQDDMQSSRTSTVPQIVFSKESESPDATNNNHHSQLEGVKINSQSQSRGRTKS

SEQ ID NO: 23048 - protein, 243 aa, Solanum tuberosum
MAIQRLPLLLVFLLISSLTLLAQSRSDTNHVYSPCADAKVQRSDGFSFGIAFASRTSFFVNSSVQLSPCDKRLSLSSANSQIAVFRPKVDEISLLTINTSSFFPDSYGGYMVAFAGRKYAARSLPAFVANGTFTVTSFTLVHEFKKGRLENLYWKRDGCSSCSGNSNFVCLNGQDCAIRTNNCKNRGGNVDCSLGIQLTFSGTDKHASVFNSWFEVKNLRQYSLYGLYSNLRGSLTDQYNKFF

SEQ ID NO: 23049 - protein, 642 aa, Oryza sativa Japonica Group
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 23050 - protein, 313 aa, Sulfitobacter sp. EE-36
MTPRKIIIDTDPGQDDAVAILVALASPEELDVLGITCVAGNVPLDLTSRNARIVCELAGKRDVKVFAGCDRPLGRELVTAEHVHGKTGLDGPDLPEPTMPMAEGHAVDFIIDTLRDNAPGTVTLCPLGPLTNIATALQKAPDIADRIAKIVLMGGGYFEGGNITPTAEFNIYVDPQAADIVFKSGAPIVVMPLDVTHKALVTKARNDAFRALGTPVGIAVAEMTDFFERFDKEKYGSDGAPLHDPCVTAYLINPDLFKGRHINVEIETESELTMGMTVADWWGVTDRAPNATFMGDLDSDGFFALLTERLARL

SEQ ID NO: 23051 - protein, 206 aa, Oryza sativa Japonica Group
MAEVEAAPIAAAETPEVAAAEGAAAAKAPHKLHRQWAFWYDIQSKPKPGAAWGTSLRKAYTFDTVEEFWGLYDQIFRPSKVTVNADFHLFKVGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 23052 - protein, 447 aa, Streptococcus pyogenes MGAS315
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNIGESIMVPRYGAAIADEGLLPAAIAKQNQNGAPLVAILVSGAIAIVLLLTGSFENLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 23053 - protein, 399 aa, Acidovorax sp. JS42
MLTFQDIQHAAERLRGQVLETPCVESRTLSQIVGAQVFLKFENLQFTASFKERGACNKLSQLTPQERERGVVAMSAGNHAQGVAYHAQRLGLRAVIVMPRFTPGVKVERTRGFGAEVVLHGDTLEEARQHAYQLAEQQGLTFVHPYDDEAVAAGQGTLVLEMLAAQPDLDALVVSVGGGGLLAGMATAARAIKPNLEIIGVQTARFPAMVNAIKGTHHAQGASTIAEGIAVGQPGKMTQEVIGRLVDDLLLVDEGDIEQAVLMLLEIEKTLVEGAGAAGLAALVRHPERFRGKKVGLVLSGGNIDPLLLAAIIERGMVRSGRLARIMVSARDVPGVLARITALVAEAGANIEEVHHQRAFTVLAAQNVEIELVLQTRGKAHIQQVLDLLRAAQMEAELR

SEQ ID NO: 23054 - protein, 194 aa, Medicago sativa
MASASASLFKSSIVLDKSEWVKGQTLRQSSVSSVRCNPTAPSSLTIRAGSYADELVKTAKTIASPGRGILAMDESNATCGKRLASIGLENTEVNRQAWRTLLVTVPSLGEYISGAILFEETLYQSTTDGRKIVDVLIEQNIVPGIKVWTRVWCPLLVPMDESWCPGLDGLASRSAAYYQQGARFAKWRTVVSIP

SEQ ID NO: 23055 - protein, 210 aa, Brassica napus
DGVLEKLKEVGTDRQLTLEEFEMCVGTSPIVLELMRRQNVEDVGKDSVDLSTSVSGGSRVTKHRRRGSWLKSIKNVASSVAGYKERRSTDDRDSLSERGGHRFSSATDDSRDMSFHDPERVKVRQYGKSCKELTALFKSQEIQAHKGSIWSIKFSLDGRYLATAGEDCVIQIWKVVESERKGELLSMDKQQDDVSINLFLLANGSPEPAS

SEQ ID NO: 23056 - protein, 100 aa, Populus trichocarpa
MGLLLKNYSTITSHYRSQSQTQGAFSLSRRGFHVEPGPREQALLAEDPSLKRFKSHKKSVWRLKRFGDVLTLVVVAGCCYEIYVKTVMREEARKQAKESA

SEQ ID NO: 23057 - protein, 469 aa, Bacillus thuringiensis serovar konkukian str. 97-27
MEKLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 23058 - protein, 276 aa, Ehrlichia ruminantium str. Gardel
MSYNISYLMENYSRLFTKELYNILPKADHDDILLASMKYSLFTPGKYIRPFLVNASAQIFNVNIDRTLPVSVAIELIHVYSLIHDDLPGMDNEDTRRGQLSSHKKFTEAIAILTGDALLTLAFEVLSTINESPYIRCRIIQVLTQAIGYQGMIKGQVLDTETIAKDINDIKTMHTLKTACLFSAACEVGGILGGASDTELNSLKNYGLNLGFAFQIKDDIADICKDISKNNILNILSKEDTENYIRSIVDKSIEYLAIFSNKANILNNLAEFIRNL

SEQ ID NO: 23059 - protein, 302 aa, Clostridium difficile 630
MLYNNALELIGNTPVVRLNNLGCTNGCSNIYVKLEKVNPAGSIKDRAVYEMLEGLEQRGELKKGDVLVEATSGNTGIALSMIGKLKGYEVVIVMPETMSVERRDLMKAYGANLVLTDGKAGMAGSIEKANELLKENPNYKSLKQFENKDNPNAHYKTTAVEIMNDVKDLDIFVCGVGTGGTLIGTARYLKEQNPNIRVIALEPKKSPAISENKTGPHKIQGIGANFVPENYDSSVVDEVILVDDEDAFDTVKLLAAKEGILVGISSGANIFGAIEMAKKYPDKKIVTVAPDGVDKYMSMGIF

SEQ ID NO: 23060 - protein, 199 aa, Clostridium difficile 630
MNTLFKKINKDIEYIMKNDPAARSKIEVFLLYPSVHAMIMHRMAHALYKKKKLFTARLISQISRFMTGIEIHPGAKMGEGILIDHGMGVVIGETAEVGNRVTIYQGATLGATGKDTGKRHPTVGDDVLIGAGTKILGPLNIGSNSKIGANSVVVKDVPNGATVVGIPAKIVKIRNLEPVKKNKKEVSYEYDELDNVYYI

SEQ ID NO: 23061 - protein, 494 aa, Arabidopsis thaliana
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANFFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 23062 - protein, 534 aa, Frankia sp. EAN1pec
MNESPRASYGSTGAHPGYDPVLVIDFGAQYAQLIARRVRECHVYSEIVPWDMPVAEILARRPAALILSGGPKSVYSPGAPRVDPALFAAGVPVLGICYGHQVMAQALDGTVARTGTAEYGATRLRVDDPGVLFDGLPTSQQVWMSHGDSVTAAPPGFRVTASTPSTPVAAFEDPTRRLYGVQFHPEVVHSERGMDVLRHFLLVGAGCRPSWTMINIVEEAVTAVRAQVGNGRLICGLSGGVDSAVAAALVQRAVGDTLTCVFVDHGLLRAGEAEQVERDFVASTGVDLVHVKAADRFASALAGVTDPEQKRKIIGREFIRVFEESARELDARAEAEGTHIGFLVQGTLYPDVIESGSPTAAKIKSHHNVGGLPDDLQFDLVEPLRTLFKDEVRRLGEELGLPEDIVWRQPFPGPGLAVRIIGEVTPERLEIVRAADAVVRDEIRRAGLDREIWQVFAVLLADVRSVGVQGDERTYGFPVVLRAVTSEDAMTADWARLPYDLLERISNRVVNEVGQVNRVVYDITSKPPGTIEWE

SEQ ID NO: 23063 - protein, 286 aa, Candida albicans SC5314
MDGPVEVTKQLFVRPLRNDVTREEVQDHFSRAAPVVEVRLMEGYAFVTFENEDDAKQALELLNDAEFNGEKLQIEFAKERREDTRGKYRLLITNLAEGTAWQDIKDFVREKTDSQPSYVKVFTNFDNGETTCSMQFQSREDLDRAIPLLDKAVFRDITIGAEEDTSPYIPPPPRGRGGFRGRGRGGFDRGFRGGRGGYDRYDRGGFRGGRGGFDRGFDRGGFRGGRGGYDRGGFRGGRGGFDRGGFRGGRGGFRGGRGGYDRGGYDRDNFNDRGGSYDRERSPTRF

SEQ ID NO: 23064 - protein, 218 aa, Vibrio campbellii AND4
MNQSSLLAEFGDPITRVENALIALKEGRGVLLLDDEDRENEGDIIYSVEHLTNEQMALMIRECSGIVCLCLTDVQADKLELPPMVVNNNSANQTAFTVSIEAKHGVTTGVSAADRVTTIKTAANPNAKPDDLARPGHVFPLRARPGGVMARRGHTEGTIDLMQMAGLQPAGVLCEVTNPDGTMAKSPEIIAFSRLHNMPVLTIEDMVAYRNQFDLKLA

SEQ ID NO: 23065 - protein, 393 aa, Physcomitrella patens subsp. patens
IAAQTFTFRELAAATKNFRPECLLGEGGFGRVYKGRLENTGQARVLSGWLQVVAVKQLDRNGLQGNREFLVEVLMLSLLHHPNLVSLIGYCADGDQRLLVYEFMPLGCLEDHLHDLPQDKECLDWNTRMKIAAGAARGLEYLHDTAKPPVIYRDFKSSNILLDEGFHPKLSDFGLAKLGPVGDKTHVSTRVMGTYGYCAPEYAMTGQLTLKSDVYSFGVVLLELITGRKAIDNSRSAGEHNLVAWARPLFKDRRKFPSMADPMLQGRYPMRGLYQALAVAAMCLQEQAATRPLIGDVVTALSYLASQIYDPGMHPLGSSRFAPATPSREKREKEKKMPPGPNTIEERMVKEQRAGKGGPRSPSSQAPTRERERAVAEARVWGENWRERKRGAG

SEQ ID NO: 23066 - protein, 412 aa, Silicibacter sp. TM1040
MPLLVMKFGGTSVANLDRIRRAAKRVGVEVAKGYDVIVIVSAMSGKTNELVGWVGETSPLYDAREYDAVVSSGENVTAGLMALTLQEMDVPARSWQGWQVPLKTNSAHSQARIEEIGTENINQKFGEGMKVAVVAGFQGISPEGRITTLGRGGSDTTAVAFAAAFGAERCDIYTDVDGVYTTDPRICEKARKLDKIAFEEMLELASLGAKVLQTRSVELAMRYKVKLRVLSSFEEQSDEAGTLVCDEEEIMESNVVNGVAYSRDEAKLTCLSVADRPGIAATIFGCLSDAGVNVDMIVQNISEDGRTDMTFSCPTDQVQRAEMALNAYKEKGELNFAELVADTGVAKISVVGIGMRSQSGVAAKMFKVLSDEGINIKVITTSEIKISVLVDRKYMELAVQALHDAFELDKAS

SEQ ID NO: 23067 - protein, 600 aa, Fusobacterium nucleatum subsp. nucleatum ATCC 25586
MNEELTQRCEEIRKNLIEVVSKNGGHLGSNLGVVELTVCLDEIFDFKEDIVLFDVGHQAYIYKILTDRAERFDSIRTRKGLSPFLDPNESSYDHFISGHAGTALPAAVGFAIANPDKKVIVVVGDASISNGHSLEALNYIGYKKLENILIIVNDNEMSIGENVGFISKFLKKVISSGKYQNFREDVKSFINRIKADRVKRTLERLERSIKGYVTPFYALESLGFRFFNVFEGNNIEKLLPMLKKIKDLKGPTILLVKTEKGKGYCFAEEDKEKFHGIAPFNIETGNTYKSLVSYSEVFGNKILELGKEDENIYTLSAAMIKGTGLHKFSEEFPERCIDTGIAEGFTVTLAAGLAKSGKKPYVCIYSTFIQRAISQLIHDVSIQNLPVRFIIDRSGIVGEDGKTHNGIYDLSFFLSIQNFTVLCPTTAKELGQALEISKNFNLGPLVIRIPRDSIFDIENEEPLEIGRWKVIKKGSKNLFIATGTMLKIILEIYDKLQNRGIYCTIISAASVKPLDENYLLNYIKEYDNIFVLEENYVKNSFGTAILEFFNDNGIQKPLHRIALKSAIIPHGKREELLKEERLKGESLIERIEELIYGRKK

SEQ ID NO: 23068 - protein, 661 aa, Oryza sativa
  misc_feature (308)..(308): Xaa can be any naturally occurring amino acid
  misc_feature (324)..(324): Xaa can be any naturally occurring amino acid
  misc_feature (328)..(328): Xaa can be any naturally occurring amino acid
MASAAVIPSSAPGAAAAGAAAVESAGWVVDERDGFISWLRGEFAAANAIIDLLLLHLRSVGEPGEFEHVAAAVQQRRHHWAPVIHMQQFFPVGDVAYALQQAGWRRRAPPHHQQQGPGASPSPPPPPPRGRPSFSASHSHHRHGGHHHRSDSVRGGGTGATAGSDKDGREVHNKEEKGMKEAENVVEAKSSQLESLVSHEGEKTPRPQAVAEGSSKVVPTPVEYTVNDIIDGKTVNAVEGLKVYEGLVNENEKNKILSLLNETKASFRRGGLEAGQTVIIGKRPMKGHGREIIQLGIPIVDPRAEESXTRQNLETKVEAVPGLXHDLXDRGCQKEIIPTKPDYCVIDYYNEGDYSHPHQSPPWYGRPFCTFCLTDCDMVFGRVISGERGDHRGPLKLSLSTGSLLVLHGKSADVAKRAIPAACKQRILLSFGKSLSRKQVPSESVSRFTTPLTPPPMPWGPPRPANMARHSSSPKHFGYAPNSGVLPAPAIGAHHIPPSDGMQPLFVAPAPVAAAAMPFPSPVPLPNSTTAWMAEAAPRSAPQRLPVPGTGVFLPPGSGHALPHQMMTASQSPAEPISSTDSSAYVHNKSTSTMGEMANGDVSPKSSPAKQSDAVEQKPECNGSSNGGSSLVDKKSAVSKEQQNGGMKKVGSNKVQPNAAK

SEQ ID NO: 23069 - protein, 676 aa, Hordeum vulgare subsp. vulgare
MFPLGARQPPPSAMDNHQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPKESSVKPTDGRCEYLPQNNSSDTVMENLEEPIVRAADLIGSMAKNMDAQQAAARAIDAPNCSLQAPEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHAANYGSNSFSNNNTNNGSTAATTAAAATVHAETGGGVDKRSNMMNMKRERRVAAVNKFREKRKERNFGKKVRYQSRKRLAEQRPRVRGQFVRQPPAPAAVER

SEQ ID NO: 23070 - protein, 441 aa, Physcomitrella patens subsp. patens
MGCFPCFDSKPKERKPLKRDDNNSSRDGQSAAANPVAQISKLPSGTCNSKKYDAKGSFDKKEPQREGSTHIAAQTFTFRELAAATKNFRPECLLGEGGFGRVYKGRLENTGQARVLSGWLQVVAVKQLDRNGLQGNREFLVEVLMLSLLHHPNLVSLIGYCADGDQRLLVYEFMPLGCLEDHLHDLPQDKECLDWNTRMKIAAGAARGLEYLHDKANPPVIYRDFKSSNILLDEGFHPKLSDFGLAKLGPVGDKTHVSTRVMGTYGYCAPEYAMTGQLTLKSDVYSFGVVLLELITGRKAIDNSRAAGEHNLVAWARPLFKDRRKFPSMADPMLQGRYPMRGLYQALAVAAMCLQEQAATRPLIGDVVTALSYLASQIYDPGRDSEEWERHEGGGRDSPGYAGRTGRDGLKPQAPTRERERAVAEARVWGENWRERKRGTA

SEQ ID NO: 23071 - protein, 391 aa, Physcomitrella patens subsp. patens
MANVQQDLQRGLPVRRLEGHTDSVLCCAAHPSFPNVVTSSSEDGSVCVFDIRTTTCCHRLQYFDGQAVVSVLPTSGSEHVLYAAAGSTVYCLDVRQGPTGSPLQTYSFNTEEINQVALNPKATYLAAADDSGAVKIIDLRSHKLFKTLQGAHSNICSSVQFHSRRPWEVVTGGLDSKIVKWDFNRGRPLQVVDLAATAVTSNEGVGGFCNPPFIHALASMEGDVPGEAGKLLAAARGDGAVDVFDFGFESSDSKQSSQPAVSKKKAPNKDLKVTGDITSPPHLDALVPGRKRHLHFGLGGHASIVNHVTFARFGARGQLLVSGGNDSFIKVWNWTVEDNRHSGDAGTSSQGPLVLNLKHKKKVNWLSTTSSQTENLVVADTSKILSVYFVL

SEQ ID NO: 23072 - protein, 325 aa, Xanthomonas campestris pv. campestris str. ATCC 33913
MSETTMTAIAIRNGKGDADALHAVEQARPQPAPGQVLIRVHAAGINRPDLLQRGGHYPPPPGAPETLGLEVAGEVVVAAGRWKVGDRVCALLGGGGYAQYAAVDARHVLPVPEGMTLVQAAALPETIFTAYANLFEHGRLAAGEWLLLHGATSGIGVTAIQLAKAAGAHVLATARSAGKAAQARELGADVAIDSTTESFVAAAKAHAGVDVALDMVGASVFADTLEALNPGGRIVYIASQAGATLEVPIPLLMRKQAIITGSTLRPRNADEKARLAAEVERVVWPWIAQGKVRVLIDQCFPLAEAAAAHRYLEQGSHLGKVVLEM

SEQ ID NO: 23073 - protein, 255 aa, Solanum tuberosum
VQGCDGSILISGAGTERTAPPNTLLRGYEVIDDAKQQIEAVCPGVVSCADILALAARDSVLVTKGLTWSVPTGRRDGRVSRASDASNLPGFTESVDAQKQKFAAKGLNTQDLVTLVGGHTIGTSACQFFSYRLYNFNSTGGPDPSIDATFLPQLQALCPQNGDGSKRVALDTGSVNNFDTSYFSNLRNGRGILESDQKLWTDASTKVFVQRYLGLRGFLGLRFALEFGKSMVKMSNIEVLTGTNGEIRKVCSAFN

SEQ ID NO: 23074 - protein, 581 aa, Ashbya gossypii ATCC 10895
MSSYTCQNNVPSSIPLAEYLFHRLRQLGVTTGFGLPSDYNMFLLDGLENVADMHLCCNTNELNASYAADGYARMQRLSCLVSTFGVGELSVVNGIAGSFAEHVAVLLIVGMPPASAQRRKLLLHHTLGNGDYDVFRRLASDICTYSTVVRSAHTAAEVLDHCIARCYRDQKPVYCGVPINLAEAMLPSAPLDVPLPLLDEPCAPLDELVALLLDKIYAAKHPVLVVDACVARHGCMQQLQRLAQATDFPVCCTPMGKGIVDEQGARFAGVYVGSLSAPQVREVVDFADFVLVVGALTAEFCTFAFHFAYKPKNIGLVHARHARVGARGFPDAPLRALLGLLVQRWTPRASANAREPVPEPSALRVAPNPATPLRHEWLWARLSRWFAPGDILVSETGTSAFGVLQTRLPPGVCVVSQPLWGSVGYSVGACLGVLVATRAAAPPRRVVLFVGDGALQLTVQELSTMVRLRLAPLIFVLNNRGYSADRLLNRARHRANARYYDVQPWHNLALAPAFGASAYDPRAVTTVGELDALLSDPAFAQPSVLKMVEVALPSMDGPPALLDTLVPEHPEHADHKRPKLV

SEQ ID NO: 23075 - protein, 256 aa, Physcomitrella patens subsp. patens
MPTDNEFRDTHEPPPAPILARDEFNEWSFYRAIIAEFIATLLFLYVSLTTLMGTTRIFGGSVGLIETAWAFGGMIFILVYCTAGISGGHINPAVTFGLFLAQQVTLPRASAYIVAQCLGAIVGAAIARGVQEGGEYRSFASNAVNGVQPGYNIGQALAAEIMGTFVLLYTVLSATDPTRKARDSHVPVLAPLPIGFAIFVVHLATIPITGTGINPARSLGAAWIFWVGPIVGSTCAAIYYTYVLKAASLRFRSLYE

SEQ ID NO: 23076 - protein, 476 aa, Nocardioides sp. JS614
MPRKADLAVIGSGGAAYAAAIHATTLGKSVVMVERGTIGGTCVNTGCVPSKALIAAAEARHVAADAGRFPGIAATAGPVDMPALIGGKQALVETLRAERYVDLAESYGWPVLPGDARFDATPDAPVLQVTAADGTVETIEAEHYLVATGSRPWVPPIDGLDAVDYLTSTTAMELTEVPESLLVLGGGYVALEQAQLFARLGSQVTMLVRSRLASREEPEASSTLQQVFADEGIRVVRRAAVTSVTLDETTGQVVATAAVSGGEQEFRAERVLVALGRRPVTEGLNLDAVEVKTGDLGEIVVDDRLASSNPRIWAAGDVTGHREFVYVAASHGAVVVDNAFSGAERSVDYARLPRVTFTSPAVGSVGMTDADAVAAGYRCDCRVLPLQYVPRALVNRDTRGFIKVVADADTGRILGLTAVAKDAGELAAAGVYLLEGGMTVQQVAHAWAPYLTMAEGIKIACQSYTTDVSKLSCCAT

SEQ ID NO: 23077 - protein, 363 aa, Cryptococcus neoformans var. neoformans JEC21
MDMDSAHLDSSLLTLAFRLIKAAQTAAPSVLADLLAEGAPAWFQDDDLGWSCLHYAAERKEPECLEVLLQGGAVWNAVDKWGRTAGEICLSLGDEEGWSIIRNEGIRSEDKTSAGDNLVFLKSKLTWDVGKDGKERVLDADGNGVMMGWEEPLSYCIVVEHVKRLTEEHPKAELGAEGMSILNVGFGLGIVDRLFQECDPKPSHHTIIEAHPQVLEYIHKKGVHLLPNVRILQGRWQDWLLDGEKVGDVLSGTPDGMGFDAIFVDTFAEGYEDLKAFFEVIPDILNADNGRFSFWNGLGATNPTIYAVSSSLAELHLEDVGLQVEWHDVLIPESMREEVWKGVRRRYWDLPGYRLPIAKMSLI

SEQ ID NO: 23078 - protein, 289 aa, Salmonella enterica subsp. enterica serovar Paratyphi A str.
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYKAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 23079 - protein, 373 aa, Cryptococcus neoformans var. neoformans JEC21
MADKTFKITVLPGDGIGPEVVAEAVRVLETIVNHSDLKLDLKSYDFGGAAIDNHGVPLPDETLKACKEADAVLMGSVGGPKWGVGPVRPEQGILKLRKELGLYANIRPANFASESLLKRSPLKEDTARGTDIIVLRELIGGIYFGERQETNDEGVAWDQCIYSKPEIERITRVAAQIALAAEPPLPITSVDKANVLATSRLWRKTVSELMAKEYPQLKLEHQLVDSAAMIMIANPRKLNGVLLTENMFGDILSDESSVIPGSLGLLPSASLAGAPDAKSTTMGLYEPIHGSAPDIAGQGIANPIGTILSAAMMLRYSLGKGREAALIEQAVQKVLDSAESGGFDYRTKDLGGQRSTKEVGDKVVEVLKGLLGA

SEQ ID NO: 23080 - protein, 626 aa, Sulfitobacter sp. EE-36
MVHTASMLSISEINYSVEGRPLFEEASAVIPEGHKVGLVGQNGAGKTTLFKIIRGELSLDAGDISLPSRAKIGGIAQEVPSSDVSLIDTVLAADVERAALMHEAETTDDPARIAEVQTRLADIDAWSAEGRAAAILKGLGFDDHDQQQPCSAYSGGWRMRVALAGVLFAQPDLLLLDEPTNYLDLEGALWLENYLSKYPHTVIIISHDRGLLNRAVGGILHLEDRKLTYYQGNYDQFAKMRAEKRAQLTAQAKKQQAHKAHMQAFVDRFKAKASKAKQAQSRMKAIEKMVTITPPEEAARKVFTFPQPDELSPPIISIEGGSTGYTEGQPVLSRLNLRIDQDDRIALLGKNGQGKSTLSKLLSNRLVLFEGKAINSSKLRIGFFAQHQVDELIVHETPLQHMISARPGVMQSKLRAQLAGFGLGPDQADTEVGRLSGGQKARLSLLLATLDAPHLLILDEPTNHLDIESREALVEALTRYSGAVILVSHDMHLLSMVADRLWLVSNGTVKPYEDDLEAYRKMLLTVEKPVSKNPKPVKEAPKPKRANREDILALRAEVRTAEARVTKINDMRDKLAKKLADPALYEKDKVGELEVWNKKYAEVMAALERAEAIWMGALEKLETASA

SEQ ID NO: 23081 - protein, 432 aa, Brassica napus
MEQQLTLVLLATPKGANFDEQTLDYASSSSSSSATSSTSSFTRTFLKFSVYFSLVALAYYFIISSFTVPPPIFIALDSPPVSPSGNVSSPKCDLFSGDWIPDPAGPLYTNHSCPHIQDFQNCMLNGRPDVNYLFWRWKPRDCDLPRFSSSQFLDRVRNKWWAFIGDSIARNHVQSLICILSQVEEVVEIYHDKEFRSKIWRFPSHNFTLSVIWSPFLVKSETLGTSSDIHLYLDQLDHKWTHQYSNFDYVVISGGKWFLKATIFHESNTVTGSHYCHGRYNLTELGYDYSYRKTLKLVRNFVRDSTHKPLVLFRTTTPDHFETAEWNAGGYCNRTMPFKEAEAKLKTVDAVMRDVELDVFQNLGEGSTNFRLLDTTGMSFLRPDGHPGPYRHPHPFAGGKVKSSVQNDCLHWCLPGPIDSWNDVMVETILNR

SEQ ID NO: 23082 - protein, 64 aa, Glycine max
  misc_feature (50)..(50): Xaa can be any naturally occurring amino acid
MDIDLSPQFPNKVYCANCGSYYAWSPSELPMLHQSYICAAKLALNINAFXALPRYSDSSKSLMF

SEQ ID NO: 23083 - protein, 805 aa, Geobacter sulfurreducens PCA
MSWIRWFSEITIDDVPLVGGKNASLGEMFGELRPLGVRIPNGFAITAEAYWHLIRSAGILEEMKQALAELVKEDVDDLALRGRRLRELVYGAPLPGELAEEIREAYRGLCAEYGDNCDVAVRSSATAEDLPTASFAGQQETYLNVRGEAQLLDACRRCFASLFTDRAISYRIDQGFDHFKVGLSVGVMKMVRSDLASSGVIFTLDTETGFRDTVLITGAWGLGENVVQGAVNPDEFTVFKPALRQGFRPIVRRRLGEKKIRMIYGTGTSKHLTKNVEVPREERRRFCLSDDEVLELARQALMIESHYEKRAGREMPMDIEWAKDGESGRLFIVQARPETVESRKRLDFLETYILEQKGEVLATGTSVGGKIAAGPARVITDIHKLGDFSPGEVLVADTTTPDWEPVMKTAAAIVTNKGGRTCHAAIVSRELGIPSVVGTGDGTERIASNREITVSCAEGEVGRIYSGELPFRVERVDLAGMRRPHTRIMMNLGNPEEAFSLCRIPNDGVGLARMEFIITNHIKIHPMALVHPLRVEDEASRREIARLTAGYADPPAYFVEKLAEGIGTIAAAFHPKPVIVRMSDFKTNEYASLLGGRAFEPDEENPMIGFRGASRYYDERYREGFALECRALKRVRDEMGLVNVIPMIPFCRRIVEAEKVLAEMAANGLVRGENGLEVYVMCEIPNNVIMIDEFSRLFDGFSIGSNDLTQLTLGVDRDSALVAHVFDERDPGVMELIGRVVEGARRNGRHSGICGQAPSDYPEFAAFLVEQGIDSISLNPDSILKITMRVLEMEEQLAQQGNKRS

SEQ ID NO: 23084 - protein, 241 aa, Synechococcus elongatus PCC 6301
MRQAGRIVATVLKEVSERVEPGMTTADIDAYAEQRIREMGATPSFKGYHGFPASICASVNDEVVHGIPNSRKVIREGDLLKVDTGAFFQGFHGDSCITIAVGRVSAEAEKLQRVAEEALFKGIEQVKAGAYLLDLAGAIQDHVEANGFSIVEDYTGHGVGRNLHEEPSVFNYRTRSLPNVKLRAGMTLAIEPILNAGSKQTRTLRDKWTVVTIDRSWSAQWEHTVLVTEDGYEILTDRTKV

SEQ ID NO: 23085 - protein, 349 aa, Physcomitrella patens subsp. patens
LAGCDITQGRWVFDNVTHPLYRTKNCPFADPGFRCEENGRPDKEFMSYRWHPNDCDLPRFCATDILERLRGQRMVFVGDSLGRNNWESMLCMLAEGVTNKSRIYEVNGEPITKHSGKLVYKFEDYNCTVEYYRDPFLVPQGRPPRNSPANVSCSLKVDRVSYSTEQWRHAEIIIFNAGHWWSEHKIFHQGCKFQVGDKLMDYDLRTGLKKALHTWAAWLEENLDTKKSQVFWLSYPTVHFRGGTWNRGGHCHQEKRPLTEEEARNEWQTPWMNEIVKESFMANIKKKLDAVTYLDITTATNYRPDGHGALYTWDTKKFGLKPRNRQDCSHFCLPGVPDTWSQFVLASLL

SEQ ID NO: 23086 - protein, 858 aa, Brassica napus
MKGVRKTYDSSYTLSFLLVFFVMFLFHPALSIHINTLSSTESLTISNNRTLVSPGNVFELGFFRTTSSSRWYLGIWYKNLPYKTYVWVANRDNPLSDSIGTLKISNMNLVLLDHSNKSVWSTNLTRGNERSPVVAELLENGNFVIRYSNNNNASGFLWQSFDFPTDTLLPEMKLGYDRKKGLNRFLTAWRNSDDPSSGEISYQLDTQRGMPEFYLLKNGVRGYRSGPWNGVRFNGIPEDQKLSYMVYNFTDNSEEAAYTFRMTDKSIYSRLIISNDEYLARLTFTPTSWEWNLFWTSPEEPECDVYKTCGSYAYCDVNTSPVCNCIQGFKPFNMQQWELRVWAGGCIRRTRLSCNGDGFTRMKNMKLPETTMAIVDRSIGRKECKKRCLSDCNCTAFANADIRNGGSGCVIWTGELEDIRNYFDDGQDLYVRLAAADLVKKRNANGKTIALIVGVCVLLLMIMFCLWKRKQKRAKTTATSIVNRQRNQDLLMNGMILSSKRQLPIENKTEELELPLIELEAVVKATENFSNCNKLGQGGFGIVYKGRLLDGQEIAVKRLSKTSVQGTGEFMNEVRLIARLQHINLVRILGCCIEADEKMLVYEYLENLSLDSYLFGNKRSSTLNWKDRFNITNGVARGLLYLHQDSRFRIIHRDMKVSNILLDKNMTPKISDFGMARIFARDETEANTRKVVGTYGYMSPEYAMDGVFSEKSDVFSFGVIVLEIVSGKRNRGFYNLNHENNLLSYVWSHWTEGRALEIVDPVIVDSLSSLPATFQPKEVLKCIQIGLLCVQERAEHRPTMSSVVWMLGSEATEIPQPTPPGYSLGRSPYENNPSSSRHCDDDESWTVNQYTCSDIDAR

SEQ ID NO: 23087 - protein, 383 aa, Corynebacterium glutamicum ATCC 13032
MKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 23088 - protein, 316 aa, Fusobacterium nucleatum subsp. nucleatum ATCC 25586
MRIKFDRRIFMLANSVIDLIGNTPLVKINNIDTFGNEIYVKLEGSNPGRSTKDRIALKMIEEAEKEGLIDKDTVIIEATSGNTGIGLAMICAVKNYKLKIVMPDTMSIERIQLMRAYGTEVILTDGSLGMKACLEKLEELKKNEKKYFVPNQFTNVNNPKAHYETTAEEILKDLNNKVDVFICGTGTGGSFSGTAKKLKEKLPNIKTFPVEPASSPLLSKGYIGPHKIQGMGMSIGGIPAVYDGSLADDILVCEDDDAFEMMRELSFKEGILGGISTGATFKAALDYSKENADKGLKIVVLSTDSGEKYLSNICDL

SEQ ID NO: 23089 - protein, 511 aa, Glycine max
MAQPSTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGLGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQHVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSKKLDYCISANQDFPNKCNIFCSDCMLS

SEQ ID NO: 23090 - protein, 214 aa, Methanosarcina barkeri str. Fusaro
MIEDNVNELLKVLPPDVTLVAAVKYASKIQIDEAIKVGVTDIGFNHYQQMKDLAPYYPPEIKTHFIGTLQLNKAKKVVNLNPYLIESVDSYELAEKINNAAKENKRIQKILIQVKTDEKKHTGLEPGDLLKLLDQISTLEYLSFEGLMTIPPKNEDPEDSRKYFKELKDLKDKAEKHLKKHLQYLSMGMTDDYQIAIEEGASIVRIGRKIFKVV

SEQ ID NO: 23091 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHAPTGIDPTLEQWQTLAQLSVEKGWLPLFDFAFQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 23092 - protein, 402 aa, Acidovorax sp. JS42
MHNPASPTDTLLPALARPAIQSLGGSLIREVANTDMGRADVLPFWFGESDQPTPQFIRDAAAQSLGSGETFYSQNLGRPYLREAIAQYLSDLHGREVSPQRIGAVASGDAGLMLTCQMLLSPGDRVVAVTPLWPNLLEMPRILGAQVERVPLAVRGGRWTLALDRLLDALTPGTRMLILNSPNNPTGWTIDEESLVAILAHCRRHGIWILSDDVYERLVYDPQLASAPSFLRHYAPGDRIISVNSCSKAWCMTGWRAGWMVVPEALEADLGKVIEYNFSCIFEPVQRAATVALQQGEAHVAQLRAGLVESRRLLVQALRAVPGVEVPDAGGAMYVFFRLAGFDDSLALAKHLVSEVGLGLAPGAAFGPEGEGWLRWCHAVSDGARLREGVERLARFVQRATA

SEQ ID NO: 23093 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHAPTGIDPTLEQWQTLAQLSVEKGWLPLFDFAYQGFARGLEEDAEGLRAFAAMHKELIVASSYSKNFGLYNERVGACTLVAADSETVDRAFSQMKAAILANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 23094 - protein, 457 aa, Mycoplasma genitalium G37
MDYDLIILGAGPAGYIAAEYAGKHKLKTLVIEKQYFGGVCLNVGCIPTKTLLKRAKIIDYLVHAKDYGITINGQAKLDWKQLLKQKQEVVDKLVAGVKTIIKGAKVESIEGEATVIDKNKVQVNNTTYTTNNIIVATGSRPRYLTLPGFEKAQQAGFIIDSTQALALEGVPKKFVVVGGGVIGVEFAFLFASLGSEVTIIQGVDRILEVCDSDVSELISKTLKNKGVQIITNAHVVRAENNQLFYTVNGVEQSVIGDKILVSIGRIANTECLDQLDLKRDHNNKIVLNEKLQTSTTNIYLIGDVNTQMMLAHYAYQQGRYAVDQILNQNQVKPAEKNKCPACIYTNPEVAFVGYSEMELQKEKIDYVKSSLPFIYSGKAIADHETNGFVKMMFNPKTGAILGGCIIASTASDIIAELALVMENNLTVFDIANSISPHPTMNEMVTDVCKKAIFDYFS

SEQ ID NO: 23095 - protein, 384 aa, Mycoplasma genitalium G37
MANEFKFTDVGEGLHEGKVTEILKQVGDQIKIDEALFVVETDKVTTELPSPFAGTISAINVKVGDVVSIGQVMAVIGEKTSTPLVEPKPQPTEEVAKVKEAGASVVGEIKVSDNLFPIFGVKPHATPAVKDTKVASSTNITVETTQKPESKTEQKTIAISTMRKAIAEAMTKSHAIIPTTVLTFYVNATKLKQYRESVNGYALSKYSMKISYFAFFVKAIVNALKKFPVFNASYDPDQNEIVLNDDINVGIAVDTEEGLIVPNIKQAQTKSVVEIAQAIVDLANKARTKKIKLTDLNKGTISVTNFGSLGAAVGTPIIKYPEMCIVATGNLEERIVKVENGIAVHTILPLTIAADHRWVDGADVGRFGKEIAKQIEELIDLTVA

SEQ ID NO: 23096 - protein, 324 aa, Rhodopseudomonas palustris CGA009
MAKAVRVHQVGGPEVLVYEDVELPPPGEGEVRIRQHAVGLNFIDVYFRTGLYKAPSLPFVAGNEGAGEVVSVGPHVTNFHPGDRVAYYANLGGYATERNIEAAKLVKLPDHITYEQGAVLMLKGLTVWYLLHKTFKVEPGHRVLIHAAAGGIGLLACQWARALGAHVIGTVGSKAKADLALANGCDHVILYNEEDWVARVKQISRNELCDVVYDGVGKATFPGSLKCIKPRGLFVSFGNASGPVPPFPLTELNNHGSLFATRPKLNDYIGTRKELIEGADTLFSAVIEGKLHVPINHAYALKDAAKAHIDLEGRVTTGASILKP

SEQ ID NO: 23097 - protein, 364 aa, Chlamydomonas reinhardtii
MQALRNRVEAPCSTSSRSCSHVPVRRPATSRRALHIVAAQSTQPYWYSAKTITPPKKGKHFLHLDDFSRDELLDMLEKAKLCKAKFYTRDESFKPFAGQTMAMIFTKPSARTRVSFETGFFRLGGHALYLDPNTIQLGKREPTKDIARVLSGYNDVIMARLFAHADLLELAEYSSVPIINGLTDYNHPCQIMADALTLLERKGRVEGTKVVYVGDGNNIVHSWLRLATRLSFEFVVVCPPGYEPCQSTVEGARAAGLSSITVTSDINAVKGADVIYTDVWASMGQKETIDERKIAFAPYQVNEKLMALAGAQALFMHCLPAERGLETTDGVMESPQSVVFQEAENRMHAQNGILLHCLAATKNL

SEQ ID NO: 23098 - protein, 138 aa, Shorea macroptera
EKNIPVLLGLLSIWNVSFLGYPARAILPYSQALEKFAPHIQQVSMESNGKGVSIDGMPLPYEAGEIDFGEPGTNGQHSFYQLIHQGRVIPCDFIGSAKSQQPIHLKGEVVSNHDELMSNFFAQPDALAFGKTPEELHR

SEQ ID NO: 23099 - protein, 515 aa, Bacillus thuringiensis serovar konkukian str. 97-27
MIILKKQHDTIIVLDFGSQYNQLIARRIREFGVYSELHPHTITAEEIKAMNPKGIIFSGGPNSVYGEGALHCDEKIFDLGLPIFGICYGMQLMTQQFGGTVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEITKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 23100 - protein, 185 aa, Glycine max
  misc_feature (40)..(40): Xaa can be any naturally occurring amino acid
SNNQAVCTVRNIVSTVNLDCKLDLKTIALQARNAEYNPKXRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 23101 - protein, 469 aa, Pseudomonas aeruginosa UCBPP-PA14
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 23102 - protein, 637 aa, Arabidopsis thaliana
MFGPTGGLGMNPSMDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQGSFTGPRIYWAASSLRTEASGYGVVYFARLILADMNKEIKGLRCVVSGCGKIAMHVVEKLIACGAHPVTVSDSKGYLVDDDGFDYMKLAFLRDIKSQQRSLRDYSKTYARAKYFDELKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 23103 - protein, 539 aa, Burkholderia mallei ATCC 23344
MHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGRTRLLDGIQDFATPEGHGMLKVWMSHGDKVGEMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPAEMVYRHPFPGPGLGVRILGEVKRDYAELLRRADAIFIEELRGTLATEQDAAAGLCEPSQVGKSWYDLTSQAFAVFLPVKSVGVMGDGRTYDYVAALRAVQTTDFMTAHWAHLPYALLGRASNRIINEVRGINRVVYDVSGKPPATIEWE

SEQ ID NO: 23104 - protein, 366 aa, Chlamydia trachomatis D/UW-3/CX
MKMGQTECGIVGLPNVGKSGLFNALTGAQVASCNYPFCTIDPNVGIVPVIDPRLETLARISQSQKIIYADMKFVDIAGLVKGAASGAGLGNRFLSHIRETHAIAHVVRCFDNDDITHVSGKIDPEEDIAVINLELVLADFSSATSVREKLGKQAKGKKDIGQLLPLLDRVVDHLESGNPVRTLSLSLEEKVLLKPYPFLTGKPMLYIANIDEDSLTDLDNPYVQKVREIAKREEANVVPICVKLEEEILSLPLEERQDFLHSLGLQESGLNRLVASAYHTLGLISYFTTGPQETRAWTISKGATAAEAAGEIHSDIQRGFIRAEVVTMEDIVAYDGRAGAREAGKLRAEGRDYIVQDGDIMLFLHN

SEQ ID NO: 23105 - protein, 283 aa, Listeria innocua Clip11262
MKTVKLNNGIEVPILGFGTYQITDAGEAEQAVKEAIAAGYRHIDTAQSYMNEEAVGRGIAASGVDRKELFITTKIWVENVSYKGVMSSFDRSLKRLGLDYIDLLLIHQPYNDVYGAWMAMEELQAQGKIKAIGVSNFGVDRVVDLAAFNDITPQVNQIEINPFQQQSKNIEALRKEGVAVEAWAPFAEGKNDIFTNPILTKIAEKYGKSVAQVILRWLIEQDIIVLAKSVKPERMAQNLAVFDFELSEEDKSAIATLNQGESQFFSHADPEMVKWMASRKINI

SEQ ID NO: 23106 - protein, 557 aa, Prochlorococcus marinus str. MIT 9211
MNIVFDPIADGLAAIRNGECVVVVDDESRENEGDLICAAQFATPQQVNFMATEARGLICLAMDGERLDQLDLPLMVDRNTDSNQTAFTISIDAGPEYGVSTGISAEDRARTIQVAINPKTKPTNLRRPGHIFPLKANKGGVLKRAGHTEAAVDLSLLSGLSPAGVICEIQNSDGSMARLPELQQYARSWGLKIISIADLIRFRLENERFVYRKAITKLPSIFGEFKAIGYKNELDGTEHIALIKGSEAEFKEPVLVRMHSECLTGDAFGSLRCDCRPQLEAALSRISKEGEGIVVYLRQEGRGIGLINKLKAYSLQDGGLDTVEANEKLGFPADLRNYGVGAQILSDLGVHRLKLLTNNPRKIAGLGGYGLKVESREPLVICPTDHNAAYLAVKRTKLGHYISEEDINPEKYLGKSIIAFWDGDYDIEDISMLEKGAESAATSRKINLTSQNSSRVNALLDRPLFIWRVIFEENKYVSEENIQIKSIYSFVKEISEWANTKRVGILFSKTLEQAIHPSHNFKNIKLKLKDLNQIDINNAIEENKGNQTISLAISWIA

SEQ ID NO: 23107 - protein, 590 aa, Physcomitrella patens subsp. patens
FAGCCTVNMIARPGSKALDCECVYPIKIVFEMENASSAFTNLTSQFQHELASQLGLIDIQVQIQAFQFGNNFSLNMVVNIGPLVGLAFSPEKIESTNKTLSSRSVKFSSILFSNYTVVSVTAFLPSFPPTGSFVPMISPTSSPPSLDGNPAANAKLPSSGFRWRPWKTGVVAGAGTLFLILVCITWRIFRRKTNVKDPESSNKGINYFRIFLVLSSHSSFPRPSNTRVFSYEELQEATKNFSLECFIGAGGFGKVYKGVLKDGTEVAIKKLTSGGNQGDKEFMVEVEMLSRLHHRHLVKLLGFYCSLEPLQQLLCYELIPNGSLESWLHGPLSLSRDPLDWNIRMKIALGAARGLAYLHEDSQPCVIHRDFKASNILLENNFSPKVADFGLARSAPDGQQDYVSTRVMGTFGYVAPEYAMTGHLLVKSDVYSFGVVMLELLSGRKPVDYSRPPGEENIVAWARPLIEKRNKLHELADPRMGGNYPPEDFARVAIIAGTCVAPEWSDRPTMGEVVQQLKAITGSHVYTFSRDADRSMSTTARHAHRSTVTTFGSDGSSSMFSSGPFSGLIGIENDPLTRTSIISEDLQEGR

SEQ ID NO: 23108 - protein, 451 aa, Silicibacter sp. TM1040
MSFDYDLFVIGGGSGGVRAARVAAAGGASVALAEEDRYGGTCVIRGCVPKKLMVFASEYSGMVEDGRAYGWDLENKGFDWDHFKQKLNTELDRLEGIYRNLLKNSGVESFDARAKLADAHTVELSDGTRKTAKHILIATGGRPWVPEFPGSELAITSNEMFHLEKLPESILIVGGGYIASEFAGIMNGLGVKTTQYYRGAQILRGFDDEARGLVAQEMIQSGIDLKLGTNVLEMRREGDKIWVKATNGDEGLFDQVMFATGRKPNADNLGLEELGIARGRGGEIEVDQYSQTAVPSVYAIGDVTDRVNLTPVAIREGMAFVETVFNGNPTSPDHDLIPTAIFTQPEMGTVGLSEEEAAKQETIEVYATSFKPMQQSFAGRAQRVLMKLIVSQATRKVLGCHIVAPGAGEMIQLAGIAVKMGATKEDFDRTVAVHPTMSEELVTLKTPVRTI

SEQ ID NO: 23109 - protein, 676 aa, Hordeum vulgare subsp. vulgare
MFPLGARQPPPSAMDNQQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPNESSVKPTDGRCEYLPQNNSSDTVMENLEEPIVRAADLIGSMAKNMDAQQAAARAIDAPNCSLQASEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHTANYGSNSFSNNNTNNGSTAATTAAAAAVHAETGGGVDKRSNMMNMKRERRVAAVNKFREKRKERNFGKKVRYQSRKRLAEQRPRVRWQFVRQPPAPATVER

SEQ ID NO: 23110 - protein, 532 aa, Prochlorococcus marinus str. MIT 9211
MNLPDYSPNNSSLQWERFSELLWHNEELGLWVDISRMNVNEHELKELKPIFQKAFEAMNSLEKGSMANIDEERMVGHYWLRNPDLAPSRDISKLIANQISQIEQFTTSILSGDIRSDAGELFTDVLWIGIGGSGLGPLLLIESLQELNKGLKFHFLDNVDPIGIDKKLELLQSKLSTTLFVVVSKSGGTPEPQIAMDQARHVVETNGKNWPTRSVAITMCNSLLDNKAKQENWLKTFDLPDWVGGRTSITGAVGLLPLGLIDSDLKSFLLGASKMDELTRNNELLDNPAALMAMAWYSSGSAKGLKDMVVLPYRDSLEVFSRYLQQLVMESLGKKNDREGNIVFQGLSVYGNKGSTDQHAYVQQLRDGINNFFVTFIEVLTNNESPCLNNKLPGDYLSGFMQGTRLALSDSNRQSLTITLKTFDPLSLGALIALFERTVGLYAELININAYHQPGVEAGKKAAADILNLQLQIEDILSDYSNYSIEQISTRLSSSNSESIYFILRNLVFNNKYSAKGSWKNPSSLIFKREKL

SEQ ID NO: 23111 - protein, 119 aa, Glycine max
MVAHSSSWGRALVAISPYTFSAIGIAVAIGVSVLGAAWGIYITGSSLIGAAIRAPRITSKNLIRLCVGIIGSSCALSDAQNSSLFVKILVIEIFGSALGLFGVIVGIIMSAQATWPTKV

SEQ ID NO: 23112 - protein, 318 aa, Xanthomonas campestris pv. campestris str. ATCC 33913
MSSVVVVGSFNVDHVWRCDALPAPGATIAGRYSTGPGGKGFNQAVAAARAGAKTHFLCALGDDAGGALARSLAAQDGFALIAEPSNEPTGTGGIYVDAHGRNTIVIGAGANSVLSAGFVDNQRALVTSARVLLAQLESPAETVESALALARECGVLTVLNAAPANAPTSISLLKLSDVLTPNETEFAALLGRHVGERINADDVAALDGNTLHSLCRKLLPGGTVVVTLGAVGAFISHAEEQLRGDTQAHYRVGAESAQTVDTTGAGDAFNGALVASLAHSPNASFITHVRFATRYAARSTEVEGAATSMPRMVPEPAV

SEQ ID NO: 23113 - protein, 447 aa, Physcomitrella patens subsp. patens
MGNCVGRPDDYVLHHGRSKWIVKYGQQVVRGLLDCEKSNLMAFNIKYAATDTALSCHRNLYRSCFDPCFPLPSDYKLIDPKIVEELGVERKPPKAALATPGVPKPPNGGKRMRREAEKSGTKQVISAKEIASWKSKTVASTAADLDVYVVTWNMNSKVPSNFSDLFDLSGDGHDFFVVGLQEAPMFDAKTSISEILGAKYCLVESSVLMSLQLFIFAKRSIKPFISGVKVDKVWEKGLGGIVGKLKGAAAVRLQFGDKSLLFITSHLAAHESNLKTRNAQCARIHQSMFARSTSVYSCFQPGTNTEDLSCRVRGLPSNVVEESDVVIWLGDLNYRVELPRSVVQASIKHNKLQELWPKDQLSVALSKNQAFKGFREGPLLFAPTFKYDVGTDMYDTSPKERVPSWTDRILYKTSTVKAELRSYDAIGSLKTSDHRPVKAHLTFKNLL

SEQ ID NO: 23114 - protein, 180 aa, Mycoplasma genitalium G37
MDQNFKLLDQAIKRFENFPNQGTLFYDITPVFSNPQLFNFVLTQMAQFIKAINAEAIVCPEARGFIFGGALASKTQLPLVLVRKANKLPGQLISASYDLEYRKHAVLEMSTTSLIQANNAKRCVIVDDVLATAGTVAAIDQLLKQLNGETVGYCFLIELKKLNGKAKLQPNVVSKILLHY

SEQ ID NO: 23115 - protein, 225 aa, Vitis vinifera
MAVLVAEADDTNDVFDPCSDAKVKRFDGFTFGLAFSTKDSFFFNQTQLSPCDRRLSLSSTNSQLAVFRPKVDEISLLTVNSTNFNPISNGGYMVAFAGRKYAARSTPVLVADGQHTITSFTLVLEFKKGTLQSFYWKKFGCSKCSKSSAFVCLNEQDCAVKSSHCKNQGGSIDCNISIQLIFSGTDKKLVALNSWYELKNLRQYSLYGLYSNIRDAIIDQYDNFF

SEQ ID NO: 23116 - protein, 268 aa, Acidovorax sp. JS42
MAESSSFAGRHVFVAGGTSGINLGIAQAFARAGAHVVVMSRSPDKVQQAAEGLRALGAQALGISADVRDPAAVDAALRQAHAQFGDIDVLISGAAGNFIAPAADLSPNGFKTVIDIDLNGSFHVLRLAYPMLKKPGASVINISAPQGVNPTMYQVHACAAKAGIDMMTRVLAMEWGEVGVRVNAIAPGPIGDTEGMRRLAPTPEALANAVATVPLQRMGTLDDIANMALFLSSPQAGYVTGAVIPVDGGSSLRGGRDMRASYVPRSAA

SEQ ID NO: 23117 - protein, 589 aa, Nostoc punctiforme PCC 73102
MQLRDSLRRTKIVATIGPATSSPEMLKAIIEAGATTLRLNFSHGTHADHQRSIRLIRQTAFELNQPVAILQDLQGPKIRLGKFDNGSIVLAKGDRFTLTNRPVVGTQEISCVTYDYLAEEVPVGAKILLDDGRVEMVVEEINRDKGDLHCRITVPGKLSNNKGVNFPGVYLSIKAMTDKDREDLMFGLDQGVDWVALSFVRNPQDMIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSFPVEAVATMARIAERMEQEEAQHLNLRSVRDSRRSIPNAISQAVGQIAEQLGAAAIMTLTQTGATARNVSKFRPNTPILAVTPHVNVARQLQMVWGVKPLLVLGLPSTGQTFQAAINVAQELKLLSEGDLVVMTAGTLQGISGSTDLIKVEVVTAVLGHGIGLGQGLVSGRARVANTGMDVSNFNPGDILVAPRTSADFVEAIRKSAGIITEEESLTSHAAVIGLRLGVPVIVGVKQATQVIRDGAIITLDLQRGLIYSGAVRTP

SEQ ID NO: 23118 - protein, 389 aa, Chlamydomonas reinhardtii
MMSERRTGAAPAEAPTLASRSSVAMPSGVVSSLLPAHAHADEDLDEERAERTALLSRSSGGAKPVVAHADTGKPAPQRKPGPIAGIPFGALVSGVCYCSASASMVLLNKHALASFSFTAPNALLCFQCVLAVILVKLCEAAGFVKLQPLKPKLIGVWFPVNLIFVAMLGTGFYALKEMGIGMFSVWKQLANLTTALGDLFIFKKTYPWPVWACLSLMIASAVVGASTDSRFTWVGYSWQIANCLFTSAYALHLRSVMDRVTDYTTDGGKMDEFSMVYYNNLLSIPPILVLMWFFGEYEGLMAQTALRNPSFQMVAMVGGVLGFAISFSSLWFLSQTTATIYSLIGSLNKIPIAIVGMLAFAEPTNPKNLSSIVIGLGAGVMFTQYKSKK

SEQ ID NO: 23119 - protein, 644 aa, Escherichia coli
MKGMQMNKFIAAEAAECIGCHACEIACAVAHNQENWPLSHSDFRPRIHVVGKGQAANPVACHHCNNAPCVTACPVNALTFQSDSVQLDEQKCIGCKRCAIACPFGVVEMVDTIAQKCDLCNQRSSGTQACIEVCPTQALRLMDDKGLQQIKVARQRKTAAGKASSDAQPSRSAALLPVNSRKGADKISASERKTHFGEIYCGLDPQQATYESDRCVYCAEKANCNWHCPLHNAIPDYIRLVQEGKIIEAAELCHQTSSLPEICGRVCPQDRLCEGACTLKDHSGAVSIGNLERYITDTALAMGWRPDVSKVVPRSEKVAVIGAGPAGLGCADILARAGVQVDVFDRHPEIGGMLTFGIPPFKLDKTVLSQRREIFTAMGIDFHLNCEIGRDITFSDLTSEYDAVFIGVGTYGMMRADLPHEDAPGVIQALPFLTAHTRQLMGLPESEEYPLTDVEGKRVVVLGGGDTTMDCLRTSIRLNAASVTCAYRRDEVSMPGSRKEVVNAREEGVEFQFNVQPQYIACDEDGRLTAVGLIRTAMGEPGPDGRRRPRPVAGSEFELPADVLIMAFGFQAHAMPWLQGSGIKLDKWGLIQTGDVGYLPTQTHLKKVFAGGDAVHGADLVVTAMAAGRQAARDMLTLFDTKAS

SEQ ID NO: 23120 - protein, 365 aa, Chlamydomonas reinhardtii
MPSGVVSSLLPAHAHADEDLDEERAERTALLSRSSGGAKPVVAHADTGKPAPQRKPGPIAGIPFGALVSGVCYCSASASMVLLNKHALASFSFTAPNALLCFQCVLAVILVKLCEAAGFVKLQPLKPKLIGVWFPVNLIFVAMLGTGFYALKEMGIGMFSVWKQLANLTTALGDLFIFKKTYPWPVWACLSLMIASAVVGASTDSRFTWVGYSWQIANCLFTSAYALHLRSVMDRVTDYTTDGGKMDEFSMVYYNNLLSIPPILVLMWFFGEYEGLMAQTALRNPSFQMVAMVGGVLGFAISFSSLWFLSQTTATIYSLIGSLNKIPIAIVGMLAFAEPTNPKNLSSIVIGLGAGVMFTQYKSKK

SEQ ID NO: 23121 - protein, 324 aa, Oryza sativa Japonica Group
MVEAEATKGPHRDRLDDAAISRRRWRRAAVAGGGSGRADTADTPHASSVVPLLCYVLPSLSDPKLARVASSFLSTSDSARRAALALIVATASSPLEQWMKRFEEAERLVADVVERIAERESVSPSLPQELQRRTAEIRRKVAILETRLDMMQEDLSQLPNKQRISLKELNKLAAKHSTLSSKVKEVGAPFTRKRFSNRSDLLGPDDNHAKIDVSSIANMDNREIIELQRNVIKEQDDELDKLEETIVSTKHIALAINEELDLHTRLIDDLDEKTEETSNQLQRAQKKLKSVTTRMRKSASCSCLLLSVIAVVILVALLWALIMY

SEQ ID NO: 23122 - protein, 203 aa, Helianthus annuus
PYGFSVIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23123 - protein, 199 aa, Triticum aestivum
  misc_feature (159)..(159): Xaa can be any naturally occurring amino acid
MSFLFGKRKTPAELLRENKRMLDKSIREIERERQGLQTQEKKLIAEIKKVAKQGQMGAVKVMAKDLIRTRHQITKFYALKSQLQGVSLRIQTLKSTQAMGEAMKGVTKAMSQMNRQMNLPALQKIMRDFEMQNEKMEMASEVMGDAIDDALEGDERRGXTEELVTTALEKNQIDINSDLAKAPDNGNYLVICQRNIPPL

SEQ ID NO: 23124 - protein, 203 aa, Helianthus annuus
PYGFSVIEKFLTGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23125 - protein, 209 aa, Methanosarcina acetivorans C2A
MVDEPEREAGTDIHNKEIEREVSVAEVMNKTVITMDINTDIPAIAREMTQNNVGSVIITQNEKAMGIITERDLVKGIVAENRKPREVNASEILSTPLLTVEPGTSIVKASEIMLKANIKRLPVLEDSTIIGIISHTDILMITPGLSTILKDLIDMNREALLSTPAIEEVEGDFITGICESCLYHSIDLKLVNGRYLCENCRHEEGEDYE

SEQ ID NO: 23126 - protein, 180 aa, Brassica napus
SNPEIQSRLYDEIKSTVGDRAVEEKDVEKMVFLQAFVKEILRKHPPTYFTLTHTVTEPTTVAGYDVPAGINVEFYLPGINEDPKIWSNPKKFDPDRFVSGKEDADITGVTGVKMMPFGVGRRICPGLSMATVHVHLMLAKMVQEFEWSAYPAGSEIDFAGKLEFTVVMMKPLRAMVKPRV

SEQ ID NO: 23127 - protein, 381 aa, Coptis japonica
MCTSLSELKCPVFSTKRKLLLEFALRTSVDMAAQEGVNYLSGLGLSRLICLPMALRAAIELNVFEIISQAGPDAQLSPSDIVAKIPTKNPSAAISLDRILRMLGASSILSVSTTKSGRVYGLNEESRCLVASEDKVSVVPMLLFTSDKAVVESFYNIKDVVLEEGVIPFDRTHGMDFFQYAGKEERVNKSFNQAMGAGSTIAFDEVFKVYKGFDNLKELVDVGGGIGTSLSNIVAKHPHIRGINFELPHVIGDAPDYPGVEHVPGDMFEGVPNAQNILLKWVLHDWDDDRSIKILKNCWKALPENGTVIVIEFVLPQVLGNNAESFNALTPDLLMMALNPGGKERTTIEFDGLAKAAGFAETKFFPISQGLHVMEFHKINC

SEQ ID NO: 23128 - protein, 380 aa, Leifsonia xyli subsp. xyli str. CTCB07
MPELQEEIRRALGGVLDPEIRKPMTELDMIGGVEVAPDGHATVEVKLTIAGCPAADAIERDVRAATANVPGVTGVTVDISVMTPAERKTLTAKLRGGRAERVPPFGPGSLTRVYAVTSGKGGVGKSTITANLAVALAQRGLRVGIVDADIHGFSLPGILGLTDENGAAQRPTRVNDMILPPIAYGVKVVSIGMFVDSPSAAVAWRGPMLHRTIQQFLGDVFFGDLDILLLDLPPGTGDVALSVGQLLPQAEVLVVTTPQPAAADVAERSGVVARQTGQRVVGVIENMAGLVQADGSVLELFGSGGGEEVARRLSAGQDQTVPLLASVPLSVPLRAGGDAGAPLVVTDPQDAAAAAISAVADRLATRGRGLAGRKLGLSVR

SEQ ID NO: 23129 - protein, 262 aa, Physcomitrella patens subsp. patens
MTLLWSLGEREWVPSGEDIAENLTLLVNRKVIRGMKGGYVVIRFDTTFENKKFESYYCVLKSNSPMDELHVIEHSIPFFLPVQELEKQHLGKSSKLFFDHMGNVLQAYISRREQVRLHLKKRKGDLIGELYHSLSYTLIEIMLKEPGWQVGMSLAYHNSDSELPTQSNITVWPLVAHLVSQTAKNSGRGVQKNAAAFRLPINEALFRAMPLPQVCDELIIDLRDTLGLSPLEQAIEAPSASTQSPMEIEIEAPMEFSQEAPH

SEQ ID NO: 23130 - protein, 279 aa, Frankia sp. EAN1pec
MARREHVQIKTASEIAKMRVAGLLVAKTLAALRAAVAPGVTTEDLDALAEKTIRADGGIPSFKGYAHPPYPASICSSVNNEVVHAIPSRRRVLREGDIISIDCGAIVDGWHGDAAITVPVGEVPSEVLDMLRVCDEALWRGLAAAQLGGRLTDISNVVERHIVPHGYGIVDHYGGHGIGSEMHQPPHVLNYGRAGRGMKLVEGVALAIEPMITLGSPDTVVLEDEWTVATKDGSLAAHTEHSVAVTPRGPWVLTEPDGGVARFAELGVACGQPADAPTG

SEQ ID NO: 23131 - protein, 472 aa, Bradyrhizobium japonicum USDA 110
MTMDKRIIPLIMCGGAGTRLWPASREVRPKQFLPLFGSRSTFQDTLLRVSDASLFDRPIVITNASYRFMVLEQLAEIGIEADVILEPMRRDSGPAIAAGAVFAQNRASEAIVLALAADHVVQDKAAFVAACREGLTAASAGRIVTFGVKPERPATEYGYISLGEVISGEVHAVARFVEKPDAVKAADYVNSGYLWNSGNFMFPATVLLDEYRKVDAASVEAVSNAVTNAGRDLGFVTLEPEAFGSAKAISIDYAVMEKTSRAAVVPVSCGWSDVGSWHAVWELSEKDAQGNAAHGAAVFEDSRNCNVTTDSALVALEGVDDLVVVATADAVLVSRQKDANGLKRLVTKLKAVAPKVTEEHLKVHRPWGSYQSVDNGERHQVKRIVVKPGGRLSLQKHHHRAEHWIVVRGAARVTVNETVKTVHENESIYIPMGAVHRMENPGKIMLELIEVQTGSYLGEDDIIRIEDDYQRS

SEQ ID NO: 23132 - protein, 337 aa, Zea mays
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 23133 - protein, 329 aa, Bradyrhizobium japonicum USDA 110
MMDQAILVTGAAGFIGFHVARQLLAEGRPVIGLDNLNSYYDPALKQARLELLRSDSRFSFVKADLADRETIAALFGQHAFAKVVHLAAQAGVRYSIEHPQAYADSNLLGFLNVLEGCRNNGCRHLVYASSSSVYGANTKLPFAVQDRTDHPVSFYAATKKANEVMAQSYSHLYRLPVTALRFFTIYGPWGRPDMAMFLFVNAIMAGTPIRLFNHGRMRRDFTYIDDVTRVVSKLIDRVPADDPAAANAPSKVYNVGNHRPEELMHVVGLLEQELGRTAIKELLPMQPGDVLETFADVEDLMRDTGFAPSTPIEHGVRNFVTWYRDYFKV

SEQ ID NO: 23134 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGDGTIDYLEFITATMHLNKIDKEDHLYAAFQHFDGDNSGFITMEELEQALIKHGMGDPDTLKEIIREVDTDHDGRINYDEFVAMMRKGTPGHQEGHRRSISNMAPVGAPRQHHHK

SEQ ID NO: 23135 - protein, 330 aa, Oryza sativa Indica Group
MAQPQRPLQVPDITKSTHSGGNTVLAYASSAMQGYRSTMEDAHATIENLDAPTNTSFFGVYDGHGGSAVARMDEMLRNQAASKELTEYGSGNEYWRTAGRSWLRCAPCVQGPVYCGPLAEGCTACVVLIRNTQIVVGNAGDARCVISRNGQAIALSNDHKPNFPEETQRIVAAGGSVSFSRGSHRVNNGIAVSRAIGIAYMFVGGDLSYKNNKKLRPEQQLLTCSPEIRADQLTDDTEFLVIACDGVWDVLANQAVVDFVRLHLNNGVELSVICESLLQEAITRDPPSTDNMSVILVRFLHPEGNRGARAATSSTSTGTVPSRHSKSISL

SEQ ID NO: 23136 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGNGTIDYLEFITATMHLNKIEKEDHLYAAFQHFDEDSSGFITMEELEQALIKHGMGDPDTLKEIIREVDTDHDGRINYDEFVAMMRKGTPGHQEGHRRSISNMAPVGAPRQHHHK

SEQ ID NO: 23137 - protein, 138 aa, Shorea argentifolia
EKNIPVLLGLLSIWNVSFLGYPARAILPYSQALEKFAPHIQQVSMESNGKGVSIDGVHLPYEAGEIDFGEPGTNGQHSFYQLIHQGRVIPCDFIGSAKSQQPIHLKGEVVSNHDELMSNFFAQPDALAFGKTPEELHK

SEQ ID NO: 23138 - protein, 382 aa, Triticum aestivum
  misc_feature (305)..(305): Xaa can be any naturally occurring amino acid
  misc_feature (310)..(310): Xaa can be any naturally occurring amino acid
  misc_feature (317)..(317): Xaa can be any naturally occurring amino acid
HYRTSLYKKAGWYRSGIPGISSTHASGVAGLACAHAAAGAGWKAVVLEKAAGPAAGGGTGAGLGLDAQSMETLARWIPGWGLDAATLPLAVDLNMATDSETKAARTLTRDEGFNFRAAHWGELHRRLHEAPPAAVTVHWGHQFLSFEVSDTDGDGGKRGGVVATARVLRTGETVEVAGDLLVAADGCTSSIRRRFLPDLKLRYSGYCAWRGVFDFTGKESSDIITGIRRAYPELGSCLYFDLAEKTHAVLYELPGNRLNWLWYINGPEPELTGSSVTMKVSDATLAGMQEDAERVWSPELARLIXETAEXFVNVIYXGPLAGLSWRGARGMVGNRAPDSRRAGDTTVRHYPGFRECREGGEPPPPPEQISPRFRSWGLVSPP

SEQ ID NO: 23139 - protein, 580 aa, Bradyrhizobium japonicum USDA 110
MPHQAAQPLHLRRHAARQPLLRALLRPANMPCRCLGPIRGDQWPKNTPLNAPVAPSSSNSTPIRPSSPIVIATTTSAPRAARWQLSLPCRRMTSRCSAASRRPFTTSRTPAKASTATSAPNAARGCSPRTSTASPKRSSFSWEASTGPTWSHRSSRCSPNVACRGIPRSTCRSSNRCRIDAAKAREPRLIDIDQIRIDTPAAERIAYLHNAGAALMPTPVVAAMKEHIDLESEIGGYAAADREARRLDSVYSSVGRLLNAAPDEIALLENATVAWQMAFYALAFRKGDRILTAEAEYAANYVAFLQVARRTGAVIEVVPSNASGELDIHALERMIDERVKLIAITWVPTNGGLVNPAAAVGKIARAHGIPYLLDACQAVGQMAVDVEAIGCDMLSATGRKFLRGPRGTGFLYVRRALLQRLEPPMIDHFAAPWVSRNQYRLRDDARRFETWENNYAARLGLGAAVDYALEIGMGPIEQRCRLLADRLRGGLASVRGITIRDLGRTPGAIVSFTMDGYEADAIVSGAAAAGITIGASHPSSTRIDAEIRALPPLVRASPHYYNTEAEIDRLIGHLAGLTPR

SEQ ID NO: 23140 - protein, 533 aa, Campylobacter jejuni RM1221
MILLIDNYDSFVFNVKSMLEQLSNDEILVRRNDAISLSEIKNLNPTHIILSPGPKHPSQSGICLEIFKARLNIPVLGICLGHQALALAFDSLVVKMQEPMHAKNSLIKQCRENELFSNLPSNFSVMRYHSLEVKQLSDELEILALDEKGVIMALGHKNLPYYGVQFHPESYFSEYGLQLFSNFLKQDIKKPQKQENPLSFYLQKMSENHFLQSDDFEQICKIIMSKDYEILQVAALLILITEKSLNEKSLSAFVRQILRYSQTFSDESEMIDICGTGGDGFKSINVSTTSAFILAALGVKVAKHGNRAISSSSGSTDVLEALNITTPNTLESVLKQLNNQGLSFLHAPFFHPLVGELKEVRSRLGVRTVFNVLGPLLHPNLKLKYQLMGNYHAPVHRLLIEVLKNLGRKKALVVRGNDGMDELSICDESKIYELCEGEILEYSICPEQFGFKRAFHSEIIGSSAYDNAKDLKDILSGRMQGAKFDLVVLNAMFALYTANKASSPLVAKDMILEAIYSGKVIEYFKEYQAYAKA

SEQ ID NO: 23141 - protein, 138 aa, Shorea curtisii
EKNIPVLLGLLSIWNVSFLGYPARAILPYSQALEKFAPHIQQVSMESNGKGVSIDGVPLPYEAGEIDFGEPGTNGQHSFYQLIHQGCVIPCDFIGSAKSQQPIHLKGEVVSNHDELMSNFFAQPDALAFGKTPEELHK

SEQ ID NO: 23142 - protein, 203 aa, Helianthus annuus
PYGFSVIEKFLAGARSIDQHFHSASFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23143 - protein, 461 aa, Pseudomonas aeruginosa UCBPP-PA14
MVHGGLRYIAKGQWRLTRDSVRERQRLLGEAPGLVEPLSFVMAHYRGGFPGPRLFGGLLSVYDALAGRRNHRFYDAATLRYLAPGLKEQRLLGGTRFFDAVTDDARLVLRVLAEARHDGGEAFNGMRVRELLREGGQVVGLRAEDRESGELLDFRCRALAVATGAWADELRQPGGSEHIRPLRGSHLLLPAWRLPVAHAFSFMHATDRRPVFVFPWEGATVVGTTDLDHRDGLGEDARISRAELDYLLAACAQQFPAAAIEACDVLSTWAGVRPVVSSGDDSGKPSDEKREHVLWREPGCVTLAGGKLTTFRPLAVEVLQACAPLLGRTVTDDGAAVFGACEGPLIDGLGSGQRRRLAGRYGRDLVRLKRLVDTLGTDCVGASETLWAELAFAAEAEMVLHLDDLLLRRTRLGLLLPGGGAAYLPRIRALCQARLGWDDPRWEREQQAYLDLWRRHYSLPV

SEQ ID NO: 23144 - protein, 202 aa, Frankia sp. EAN1pec
MPGQQRRGGGSGGSDRRERRDRSGGGPAQEKTAYVERVVAINRVAKVVKGGRRFSFTALVVVGDADGTVGVGYGKAKEVPAAIAKGVEEAKKHFFKVPRIGSTIPHPVQGEEAAGVVLLKPASPGTGVIAGGPVRAVLECAGVHDVLSKSLGSSNPINIVHATVAALRGLMRPEEIAARRGLPLEDVAPPAMLRARAAGVGA

SEQ ID NO: 23145 - protein, 498 aa, Ashbya gossypii ATCC 10895
MKREDSTEEEIRPRSVGPPLKQRNARSSSNMHLVADEEESTPSYMPPWTTPYIIGVGGTSGSGKTSVASKIVASINTPWTVLISLDNFYKPLSAEERARAFRNEYDFDEPQALDLDLAYQCLLALKEGKKMTMPVYSFVHHNRVPDKSITIYGASVVVLEGIYALHDKRITDLMDLKVYVDADLDICLARRLSRDIISRGRNLESCISQWEKFVKPNADKFVKPTMKNADAIFPSMSDNSIATKMLINHIKSKLQRKSQDHIDKLVQLGHETIPLETLDTIHQLERTNQACSLKTMILDSSLDRDDFVFYFNRIATILVSRALDDIAIVRDELPLVTASGYQLEKPVHVNFDKITAVNIVRSGDCFMASLRKTVPNISIGKLLIQSDSQTGEPQLHCEFLPVNIGGSFDQVLLMDAQIISGAAIIMAIQVLVDHGVELSKIKVIVYLATEIGIRRIINAFNNKVVIYAGEIISDESMTDGQCNWARLRFIDSRYFGCD

SEQ ID NO: 23146 - protein, 132 aa, Zea mays
MSNPGSSPAFLVPAKRITSPDDIARFHASVHGLHFLGFVAALSASVHGRKLSDPLPSPPSPAIAAVLDLVSALAALVASTPPLPHSSRYGNPAFRLWHEKLTDSASELISRITATASSPADLAGARCRASTV

SEQ ID NO: 23147 - protein, 2195 aa, Ashbya gossypii ATCC 10895
MSYLAFVYCLHSTSLVLVPTLSYCRLDTPGTHTHTHGYIQASDVTTDQRKVMLHSEPYDALQEAYEGGQPLGEQTELRGQDGHISWANAIPGKQGLYDPDYEKDACGVGFVANIKGEPSHKIVSDAKYLLCNMTHRGAVSTDGNGDGAGILVGIPHEFMQREFRMEAGVEVPAKHQYAVGNIFFKKDAAEVLEASKQTFGQLAESLDLRVLGWREVPHDSSILGSVALSREPTILQPLVVLKETYGQEISGEEFQAKYETTFRMQLYILRKQASTAIGIQNWFYVCSLNNRTIVYKGQLTPAQVYNYYHDLTNAHFKSHLALVHSRFSTNTFPSWDRAQPLRWLAHNGEINTLRGNKNWMRAKEGVMASAVFQDQLEKLYPIIEEGGSDSAALDNVLELLVINGVLSLPEAMCLMVPEAYHKDMDSNLKAWFDWAACLMEPWDGPALLTFTDGRYTGATLDRNGLRPCRFYITSDDRVICGSEVGVIPVANELVVCKGKLKPGDMLLVDTEKGEMVDTNMLKKEFSLRQDFKSWLSKVIKLDDLSEKTKKYTPQAFTPSHSTGHVQQDPRLLALGYTFEQVSLLLIPMALQGKEALGSRGKDVPLAGLNEDPVLVYDYFRQLFAQVTNPPIDPIREANVMSLECFVGPQGNLLEMHPSQCDRLLLRSPVLMWDEFEALKNIEKVHPTWSTAHIDITFQKSEGLLGYTNAIERITQEASDAIEQGKKILMISDRKIDAEHVPISSLIAVGAIHHHLIRNKQRSQVALILETGEAREVHQFCVLLGYGCDGIFPYLAMETLVRMNNEGLVRNVNDDYSDITDEQLLHNYKEAIDGGILKVMSKMGISTLASYKGAQIFEALGIDNSVIDLCFAGTASRIKGVTFEYIAQDAFSLHERGYPSRFTIKRSVNLPEAGEYHWRDGGYKHVNEPSAIAALQDSVRNKNEDAWSMYVQKEMEAIRDCTLRGLLDLDYESSTAIPLEQVEPWTEIARRFATGAMSYGSISMEAHSTLAIAMNRLGAKSNCGEGGEDPERSIVHPNGDTMRSAIKQVASARFGVTSHYLSDADEIQIKIAQGAKPGEGGELPGHKVSKEIAKTRHSTPYVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAILLGAESFTLATIPLIAMGCVMLRKCHLNACAVGIATQDPVLRAKFQGQPEHVINFFYYLIQDLRKIMAKLGFRTVTEMVGHSEKLRKRDDVSTKALNIDLSPILTPGHVIRPGVPTSFTKKQDHKLHVRLDNKLIDEAEVTLDKGLPVTIDASIINTDRALGSTLSYRVSKRFGEHGLPQDTIVVKINGSAGQSFGAFLASGITFILDGDANDYVGKGLSGGRIIIKPPQNSKFESDENVIIGNTCFYGATSGYAFIAGSVGERFAVRNSGATLVVERIKGNNAFEYMTGGRAVVLSQMESLNAFSGATGGIAYCLTSDYDDLVGKINLDTIELQSLSDPVEIAFVKNLIQEHYNYTKSELAARILHNFNHYLKNFVKVIPLDYKKVLENEAAEKTKEKERSANEYLRTFSKKLNLSADATNGEVSKLLSKKNQAAARPISIKATLAEPKVVDLEDAVQNPDQEDNIKKLDRINGFIKYKLRHEEYRNVATRTKDWKELTSAITKKAAKFQTARCMDCGVPFCTSDTGCPISNVIPKFNELVFKNQWKLALDKLLETNNFPEFTGRVCPAPCQGACTLGISEDPVGIKSIERLIIDNAFKEGWIKPCPPEVRTGRTVAIIGSGPAGLSCADQLNRAGHSVTVYERADRCGGLLMYGIPNMKLDKSIVQRRLNLLAAEGIEFVTNTEIGKDITMSELKSKFDSVVYAVGSTIPRDLRIPGRELKNIDFAMTLLKNNTQALLEKDLGTIRKHIEGKKVIVIGGGDTGNDCLGTSVRHGAASVLNFELLPQPPKERAKDNPWPQWPRVMRVDYGHAEVKEHYGRDPREFCILSKEFVGNENGEVTAIKTVRVEWKKSQSGVWQMVEVPGSEETYEADVVLLSMGFVGPELIEDPAVTKTRRGTIGTVSDMSYSVDGGKLFAAGDCRRGQSLIVWAIQEGRKCATAIDNYLMGSTNLPGNGGIVKRDYKLLEELASAF

SEQ ID NO: 23148 - protein, 759 aa, Pseudomonas aeruginosa
MLNTLRKIVQEVNSAKDLKAALGIIVQRVKEAMGTQVCSVYLLDTETQRFVLMATEGLNKRSIGKVSMAPSEGLVGLVGTREEPLNLENAAAHPRYRYFAETGEERYASFLGAPIIHHRRVMGVLVVQQKERRQFDEGEEAFLVTMSAQLAGVIAHAEATGSIRGLGKLGKGIQEAKFVGVPGAPGVGVGKAVVVLPPADLEVVPDKQVDDIDAEIALFKQALEGVRADMRALSSKLASQLRKEERALFDVYLMMLDDASIGNEVKRIIRTGQWAQGALRQVVMEHVQRFELMDDAYLRERASDVKDIGRRLLAYLQEERKQNLTYPEQTIIVSEELSPAMLGEVPEGRLVGLVSVLGSGNSHVAILARAMGTPTVMGAVDLPYSKVDGIDLIVDGYHGEVYTNPSAELVRQYSDVVAEERELSKGLAALRELPCETLDGHRMPLWVNTGLLADVARAQERGAEGVGLYRTEVPFMINDRFPSEKEQLAIYREQLSAFHPLPVTMRTLDIGGDKALSYFPIKEGNPFLGWRGIRVTLDHPEIFLVQTRAMLKASEGLDNLRILLPMISGTHELEEALHLIHRAWGEVRDEGVDIAMPPIGMMVEIPAAVYQTRELARQVDFLSVGSNDLTQYLLAVDRNNPRVADLYDYLHPAVLHALKKVVDDAHLEGKPVSICGEMAGDPAAAVLLMAMGFDSLSMNATNLPKVKWLLRQITLDKARDLLGQLLTFDNPQVIHSSLHLALRNLGLGRVINPAATVQP

SEQ ID NO: 23149 - protein, 206 aa, Zea mays
MFVKAMAGPAVLNERILSSMSQKHVAAHPWHDLEIGPGAPEFFNCVVEIPRGSKVKYELDKASGLIKVDRVLYSSVVYPHNYGFIPRTLCEDNDPLDVLILMQEQVVPGCFLRARAIGLMPMIDQGEKDDKIIAVCADDPEFRHYTDITDLPPHRLQEIRRFFEDYKKNENKEVAVNEFLPAKDAINAIKYSMDLYGSYVIESLRK

SEQ ID NO: 23150 - protein, 179 aa, Ashbya gossypii ATCC 10895
MSEQNQTVVLVSVEGERFTVERKIAERSLLLKNYLNDMHDNAFRDESDDEADAADDDDRIVMPVPNVRSSVLQKVIEWAEHHRDSNFPDEEDDDSRKSAPVDAWDREFLKVDQEMLYEIILAANYLNIKPLLDAGCKVVAEMIRNRSPEEIRRTFNIVNDFTPEEEAAIRRENEWAEDR

SEQ ID NO: 23151 - protein, 170 aa, Nocardioides sp. JS614
MADLQAVLKTNRGDITLNLFPDHAPETVANFTGLAEGTKAYDAGNGKTGPFYDGLGFHRVIEGFMIQGGCPLGTGTGGPGYTFKDEPHPELTFDKPYLLAMANAGPGTNGSQFFITVGATTWLNFKHTIFGEVADQASRDVVDAIATTATGPGDRPAEPVVIETVEIVRG

SEQ ID NO: 23152 - protein, 158 aa, Blastopirellula marina DSM 3645
MVRIYRGEPLGEAVRVAIVVARYNETITGKLCEGALTTLAAQGVVEDAVEVAWVPGAWELPVVAARFARSGQFHAVICLGAVIKGETTHDQYINSQVSSTLGQLALECELPIMFGVLTVNTLEQAMHRAGGNVGNKGSEAAEAALEMVHLMKQLPREE

SEQ ID NO: 23153 - protein, 210 aa, Salmonella enterica subsp. enterica serovar Paratyphi A str.
MLLHPSLASADPLRYAEALTALHDAPLGSLHLDIEDTSFINNITFGMKTIQAVAQYSRHPLSFHLMVSSPQRWLPWLAAIRPGWIFIHAESVQNPSEILADIRAIGAKAGLALNPATPLLPYRYLALQLDALMIMTSEPDGRGQQFIAAMCEKVSQSREHFPAAECWADGGITLRAARLLAAVGAQHLVIGRALFTTANYDVTLSQFTAL

SEQ ID NO: 23154 - protein, 320 aa, Mycoplasma genitalium G37
MSVIDIFKKRLQAVSKKPVIIFPEGWSASVLKAVEMLNESKLIQPAVIFHNRQEIPANFDKKITHYVIDEMDLTSYANFVYEKRKHKGMDLKEAQKFVRDPSSLAATLVALKVVDGEVCGKEYATKDTLRPALQLLATGNFVSSVFIMEKGEERLYFTDCAFAVYPNSQELATIAENTFNFAKSLNEDEIKMAFLSYSTLGSGKGEMVDKVVLATKLFLEKHPELHQSVCGELQFDAAFVEKVRLQKAPQLTWKNSANIYVFPNLDAGNIAYKIAQRLGGYDAIGPIVLGLSSPVNDLSRGASVSDIFNVGIITAAQAIK

SEQ ID NO: 23155 - protein, 1136 aa, Tuber borchii
MADKLLQDVYRKIEREKVLINGARAMRQSTDNAAVQQKLDNQIRESQRNLSYLEGRYGELQNMVITSGVGDMHVNDGGGYGGGYQNPQMLPPNKPFAQGSGGSAQPKTRPNYSKLDLIKYDTPHLGPRIQLMLSQLEFKLSVEKQYKEGIEKMIKLYQMEGDRKSRQDAESKHTDIGQKIQLLKQALKRYEDLHVDMDFGDEDSINSPNIRRPLTGRLAIRVLAVKDVDHATTSRFARGPETFVIIKVEDVARVRTKFTRNDKWLDEAHDIDVDKANEIEMTVYDKPGDNHMPIGLLWIRISDIAEELRRKKIEQEISSSGWVSADKMANSGAGRPGEGAYNYSQGFGGPAAAGGGNTGMYVNNSGQAQAQGGSAGIDAWFALEPVGQIHLNLNFVKYNRNKRPLDLGLGRKGAVRARKEEVHEMYGHKFVQQQFYNIMRCALCSDFLKYSAGMQCSDCKYTCHKKCYPKVVTKCISKSNAETDPEEEKLNHRIPHRFEPMTNMGANWCCHCGYMLPVGKKNARKCTECGLTCHSQCAHLVPDFCGMSMEVANQILGEIKKTKKRGPSMTDRNLRTNVPPVPSSPLSGRPTSDPYVSALDPRNSVQGEPAQLSQRTHSYTPSSPTAVNAANVAYGTASSPARPQQPAPYSPEQRPNRVPEPTAVAAAAHAGQRPPSTVQSQTGYPPRQSADFYQGAPTSPTQPNHPTELPSSPSPYQQGQGYDNPYQQHHAPTPQQPPAAPPKASPAPSGYGQPQATQYDQRQSYGQPPPAPAKVAPPAHTPAAEKQPPPPPVLEPQHVVSRPTKIGLDHFNFLAVLGKGNFGKVMLAETKASKKLYAIKVLKKEFIIENDEVESTRSEKRVFLIANKERHPFLLNLHACFQTETRVYFVMEYISGGDLMLHIQRGPFGSRRAQFYAAEVCLALKYFHENGVIYRDLKLDNILLTLDGHIKIADYGLCKEEMWYGSTTSTFCGTPEFMAPEILMDKRYGRAVDWWAFGVLIYQMLLQQSPFRGEDEDEIYDAILADEALYPIHMPRDSVSILQKLLTKEPELRLGSGPTDAQEIMSHPFFANINWEDIYHKRIPPPFKPSIQSATDTSNFDQEFTSVTPVLTPVQSVLTQAMQEEFRGFSYVQDFS

SEQ ID NO: 23156 - protein, 337 aa, Mycoplasma genitalium G37
MAAKNRTIKVAINGFGRIGRLVFRSLLSKANVEVVAINDLTQPEVLAHLLKYDSAHGELKRKITVKQNILQIDRKKVYVFSEKDPQNLPWDEHDIDVVIESTGRFVSEEGASLHLKAGAKRVIISAPAKEKTIRTVVYNVNHKTISSDDKIISAASCTTNCLAPLVHVLEKNFGIVYGTMLTVHAYTADQRLQDAPHNDLRRARAAAVNIVPTTTGAAKAIGLVVPEANGKLNGMSLRVPVLTGSIVELSVVLEKSPSVEQVNQAMKRFASASFKYCEDPIVSSDVVSSEYGSIFDSKLTNIVEVDGMKLYKVYAWYDNESSYVHQLVRVVSYCAKL

SEQ ID NO: 23157 - protein, 294 aa, Petroselinum crispum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRITGTPNEDTWPGVTSLPDFKSAFPKWPSKELETVVPNLDSAGLNLLKKMLCLDPSRRITARIALEHEYFKDIGIVP

SEQ ID NO: 23158 - protein, 701 aa, Candidatus Pelagibacter ubique HTCC1002
MNSLIETILLFTIAAGSLSIVYGFFTGMNILNSSAGNAKMQEIASAIQIGAKAYLARQYKTIAVVGVVVLVIIFFVFSPLVGLGYFIGATLSGIAGYVGMLVSVQANVRTAEASRKGLASGLAVAFKSGAVTGMLVAGLALLAIAVYYYFLLKAGIDDREVINALVALGFGASLISIFARLGGGIFTKGADVGADLVGKVEAGIPEDDPRNPAVIADNVGDNVGDCAGMAADLFETYAVTIVATMVLSSIFFYGDINMMIYPLTIGGACILTSILGTFFVKLGKSKNVMNALYKGFVVSAVSSLIILYPVTDYVIGFASKYTVNGKSFTGMSLYYCGIIGLVITGLLIWITEYYTGTEYRPVRSIAKSSTTGHGTNVIQGLAVSMEATAVPALIIVAGILATNSIAGLYGIAISVTTMLALAGMVVALDAYGPVTDNAGGIAEMAKLPNSVRKTTDALDAVGNTTKAVTKGYAIGSAGLGALVLFAAYVEDIKHFSGVAGSKLEGIVVTFDLSNPYVVVGLLIGGMLPYLFGSMGMQAVGRAGGAVVVEVRRQFKKYPGIMKGKQKPDYAKLVDLLTLAAIREMIIPSLLPVLSPIILYFVILAIGGQVAALAAVGAMLLGVIITGLFVAVSMTAGGGAWDNAKKYIEDGNHGGKGSEAHKAAVTGDTVGDPYKDTAGPAVNPMIKITNIVALLLLAVIAG

SEQ ID NO: 23159 - protein, 444 aa, Glycine max
MATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 23160 - protein, 443 aa, Petroselinum crispum
MASIPVVQQNRVEAAGGGAVKQKNMAAVEGRNRRALGDIGNLVTGHGIEGKQQQIPQVSRPVTRGFCAQLLANAQAGVVENNKKQRAIVGDGVVAVRQKKVSVKPKPEDIIVISPDTEEADRVNKHLNRKKATEGSLKKKGQTFTSTLTARSKAAAFGLTRKPKEQIVDIDAADANNELAAVEYVEDMYKFYKLAEHESRVFDYIDFQPEINQKMRAILVDWLIEVHNKFELMPETLYLAINILDRYLSTESVARKELQLVGISSMLTASKYEEIWPPEVNDLTKISDNAYTNQQVLIMEKKILGQLEWNLTVPTPYVFLVRFIKASIPNEPAVENMACFLTELGMMNYATVTYCPSMVAASAVYGARCTLDKAPFWNETLKSHTGFSEEQLMECGRTLVRFHSCATENKLRVIYRKYSLDERGCVAMLPPAKALLTVAKPQT

SEQ ID NO: 23161 - protein, 457 aa, Rhodopseudomonas palustris CGA009
MDARSPQMTADPSPAPEQTTGWRLARGEPSLAGMFGSVPTRAKGPFWRKLIAFLGPGYLVAVGYMDPGNWATSLAGGSKYGYALLTVALVSNIMAVVLQSLCTRLGVGAGRDLAQACRDAYPKWVSWPLWLSAEIAITATDLAEVIGTAIGLNLLFGIPLEIGVLITAADVFLVLALQAFGFRWIEAFVVALLGVIAACFAIQIAMADPDWGAVIRGFAPTTRVLTEPGMLYLALGILGATVMPHNLYLHSGLVQTRGFGHSPAEKHEAIKLATFDSTIALTFALTINASILILAAATFHHAGKTDIAELDQAHAFLAPLLGSTLAPTLFGIALLACGLNSTITATLAGQIVMEGFIQIRIKPWLRRMVTRLIAIVPAVAVTIIAGEKGTGQLLILSQVVLSLQLPFAVVPLVVFTASRAKMGEFVAPRWLTAIASLIAAIIVALNIKLVFDYATGG

SEQ ID NO: 23162 - protein, 203 aa, Helianthus annuus
PYGFSVIEKFLTGARSIDQHFHSASFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23163 - protein, 237 aa, Chlamydophila pneumoniae AR39
MKNSGNIMEPSTNKPDCKKIFDSIASKYDRTNTILSLGMHHFWNRSLIQILGSGYSLLDLCAGTGKVAKRYIAAHPQASVTLVDFSSAMLDIAKQHLPQGSCSFIHSDINQLPLENHSYPLAAMAYGLRNLSDPHKALQEISRVLMPSGKLGILELTPPKKTHPTYSAHKLYLRAVVPWIGKSVSKDPDAYSYLSKSIQQLPKDHDLEDLFSKSGFYIAKKKKLFLGAATIWLLEKQ

SEQ ID NO: 23164 - protein, 203 aa, Helianthus annuus
PYGFSFIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23165 - protein, 138 aa, Shorea leprosula
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSHFFAQPDALAFGKTPEELHK

SEQ ID NO: 23166 - protein, 209 aa, Pseudoalteromonas tunicata D2
MTRTIIAIAGASASGKSLFSQTIYSELVNELEPGAIAIIEEDAYYRDQSHLPFAHRTQTNYDHPDAFEHELMLSHLNQLRQGESVDVPIYDYAQHTRSDKTRKVLPAKILIVEGILLLCDKKLCDEFNIKVFIDTPLDICLMRRMKRDMEERGRSLQSVIEQYTSTVRPMFYQFIEPSKHNSDLVVTRGGKNRVAIDIIKSKIKQLLQQ

SEQ ID NO: 23167 - protein, 454 aa, Bacillus thuringiensis serovar konkukian str. 97-27
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFMIEEFKNFFISEVAPEMIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTAHV

SEQ ID NO: 23168 - protein, 453 aa, Corynebacterium glutamicum ATCC 13032
MSNRHLQLIAIGGAIGTGLFMGSGKTISVAGPSVILVYAIIGFMLFFVMRAMGELLLANLNYKSLRDAVSDILGPGAGFVTGWTYWFCWIATGMADIVAITGYTQYWWPEIPLWLPGVLTIALLFALNLAAVRLFGEMEFWFAIIKIVAIVSLIVVGLFMVVTAFESPNGTTAQFNNLIEHGGFFPNGITGFLAGFQIAIFAFVGIELAGTAAAETENPTKTLPRAINSIPIRIVVFYVLALAVIMMVTPWDQVRADNSPFVQMFALAGIPAAAGIINFVVITSAASSANSGIFSTSRMLYGLSLEGAAPKRWSRLSKNLVPARGLTFSVICLIPAVGLLYAGGTVIEAFTLITTVSSVLFMVVWSYILVAYIVYRRNSPELHKKSIFKMPGGVVMAVVVLVFFAAMLVVLSLEPDTRAALIATPVWFIILGIGWLSIGGAKGAKHRSQITSH

SEQ ID NO: 23169 - protein, 138 aa, Shorea leprosula
EKNIPVLLGLLSIWNVSFLGYPARAILPYSQALEKFAPHIQQLSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 23170 - protein, 230 aa, Corynebacterium glutamicum ATCC 13032
MAKADLDKDPFDVASMFDDVGKNYDLTNTVLSFGQDRVWRKRTRQRLDLKPGEKVLDLAAGTAVSTVELAKSGAFCVACDFSQGMLAAGKDRDVSKVVGDGMQLPFADNSFDAVTISYGLRNIHDFRAGLKEMARVTKPGGRLTVAEFSTPVIPVFGTVYKEYLMRLLPQAARAVSSNPEAYIYLADSIRAWPSQAELAREINQNGWSDCGWQNLTFGIVALHSAIKPEN

SEQ ID NO: 23171 - protein, 203 aa, Helianthus annuus
PYGFSVIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIMKSQQPVYLKDEVVNNHDELMSNFFAQPDALAYGKTPEQLQSENVAPHLTFTGNRPSLSLLLPSLDAYRIGQLLAIYEHRI

SEQ ID NO: 23172 - protein, 138 aa, Shorea leprosula
EKNIPVLLGLLSIWNVLFLGYPARAILPYSQALEKFAPHIQQLSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 23173 - protein, 233 aa, Chlamydia trachomatis D/UW-3/CX
MREEAMKKQGVLVAPSIMGADLACIGREARNIEESGADLIHIDVMDGHFVPNITFGPGVVAAINRSTELFLEVHAMIYTPFEFVEAFVKAGADRIIVHFEAAENIKEIISYIQKCGVQAGVAFSPETSIEFVTSFIPLCDVILLMSVHPGFCGQKFIPDTIERIQFVKQAIQVLGREGSCLIEVDGGIDKESARACREAGADILVAASYFFEKDSINMKEKVLLLQGEEHGAK

SEQ ID NO: 23174 - protein, 635 aa, Methanopyrus kandleri AV19
MAEHELRVLEIPWVEKYRPKRLDDIVDQEHVVERLKAYVNRGDMPNLLFAGPPGTGKTTAALCLARELFGEHWRDNFLELNASVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHNSDERGIDVIRTKVKNFARTRPMGGARFKIIFLDEADNLTRDSQQALRRIMEMYSDACRFILAANYSSAIIDPIQSRCVVFKFTKLPESAIKERLRKIAESEGVEITEDALDAIVYVSEGDMRRAINVLQAAAALGREIDEDTVFQIAATARPEEVREMIHHAWNGDFERARELLHELLTRYGMSGEDVVRQVHREIFDMDEIPEEAIPELVNAVGDFEYRLIRGSDERIQLEALLARIHALGNEYSGG

SEQ ID NO: 23175 - protein, 353 aa, Physcomitrella patens subsp. patens
MSKNGSLYAGSMGNGGEFELPQEVLSVLPSDPYEQLDVARRITAMAVAARVSKLESETGKLRQKLSEKEHVIYGLQDRVVEAENTLQETSARLSHALDEQNKLANDKNMLAAQVKKLMRDVAKLETFKRTLMNSLQEDDENPNGEGERRGVNSSLAIIRASQAESTVSRSPILDDDHQPGKLSYESDSSVITEERGYRQGAVLKPPTSHQGSAHNSARGTPHLSPRLTPSGSPKRQSARTSPRRSMSSSENSHRISLPSSKPTSQSTTAPNSPPSSGSMPSRTPRVDGKDFFRQARNRLSYEQFSAFLANIKELNAHRQTREETLQKAQETFGPDNKDLYSAFEGLLSRHLPS

SEQ ID NO: 23176 - protein, 672 aa, Physcomitrella patens subsp. patens
MQINNGFLHLVSTLLGLLHLATFATAELKTIEFSFPNFKSPENDGTINIPNATDVPSGRNVLFLPKEKNALSVGWVIYEEKVQFWDNSDDAASFSTEFTFSTSGYNASTGGSGLAFLITPDFSIGDIRGYLGIFSSTTNASTNNQKIAVEIDVFKNPWDPSASHIGLDVNSIESVKVKDYCPVMDNRCTYFTNKGDINVWIDYMAESETLEVRLAMGSSSVKPTQPDLQFIGLNLPRTIRNFMYVGFSAATGSDFYPAHTFRLRRWSFKTTAPSNGKKNILLIAVLSAAAGLIFIIIVVLLCICRARLRCCCCAPAPAPCLDDPFPQIAQLASGPRIFTYRELSDATKGFSENELLGQGGFGKVFRGVLRSGTMIAVKKISEGSDQGEQQFVAEVSIISNIRHRSVVQLQGWCHEQGQLILVYDYMPNGGLDQHLYASNCPLNWTMRYNVIVDLASALAYLHEELEQCVIHRDIKASNVMLDRDFKGRLGDFGLAKSSARDMVAATTKLAGTMVYMAPELPITFKPTTESDVYSFGILALEVICRRRPFDGTVILLDWVWEKHEQGELLQVVDPGLNQAFDRTQAQVALSVALMCANPNPNERLRMQMARQMLIGEVSVPPLPANRPFMLYSNVNSEQGSCNNSGFHSDAWNTAAIENGRVTIIQRPEMNPR

SEQ ID NO: 23177 - protein, 597 aa, Nocardioides sp. JS614
MSNHQPTVGGRYQLGELLGRGGMAEVRKGTDTRLGRVVAVKRLRTDLASDATFQARFRREAQSAASLNHPSIVAVYDTGEEPAADGSGISQPYIVMEFVAGRTLRDILREGRKILPERALEITSGVLSALDYSHRAGIIHRDIKPGNVMLTPSGDVKVMDFGIARAISDASSTMTQTAAVVGTAQYLSPEQARGETVDSRSDVYSAGCLLYELLTGRPPFVGDSPVAVAYQHVREPAVPPSDHDTELPPEIDAIVMKALAKRVEDRYQSAAAMRSDIERYLAGRPVQAPIPAPVPPPPSATDRTAVVGAVPAADDEPPRSRTGLLVLIGALLVALLLAGAYFVWPRLFEQAPEQVAVPNVVGKNETQARRLIGEAELAVGTIDRENSDTVKAGNVIRQSPEPDRYVDPDTAVDFVISLGVPEVNVPPVVGLDKDAARAQLEAADFVVRTEEKESDEPAGEVIETNPPANASVEQGSTVVVFYSDGPEEVPDVRGLMQPQAKNKIRAAGFEPRVIADPDSTEPAGTVTDQSPEPGETPSQGSTVTILVSTYEEPTESPTPSESPTDNPTEPPPPVLDRSAVSPRSVSSRRWGRAAPRS

SEQ ID NO: 23178 - protein, 199 aa, Prochlorococcus marinus str. MIT 9211
MMTNECIRVGQKAPDFTATAVIDQEFKEISLSNYRGKYVVLFFYPLDFTFVCPTEITAFSDRYSEFSSKNTEVLGVSVDSQFSHLAWIQTQRNDGGIGDINYPLVADLKKEISLAYNVLDDAEGVALRGLYIIDPDGVIMHATINNLPVGRNVDETLRVLQAFQYVQANPDEVCPANWTPGEKTMKPDPEGSKEYFSSL

SEQ ID NO: 23179 - protein, 400 aa, Exiguobacterium sibiricum 255-15
MNQTEKIITQTEKFGAHNYHPLPIVISEAEGVFVKDPEGREYMDMLSAYSAVNQGHRHPKIIEALKRQADKITLTSRAFHNDQLGFFYEKVAQLTGKDMVLPMNTGAEAVETAVKAARRWAYEVKQIPGDAEIIVCEGNFHGRTMTAVSMSTEAEYQRGFGPLLPGIKTIPYGDLEALKGAITENTAAFIVEPIQGEAGILIPYEGFLKDAQDVCKEQNVLLVSDEIQSGLGRSGKWFASDWDNVTPDMYILGKALGGGVFPISCVAANHDILSVFNPGSHGSTFGGNPLACAVSVASLEVLEEEKLPERSLELGTYFMNRLKEIDNPMIKEVRGRGLFIGVELTEAARPYCEALKEKGLLCKETHETVIRFAPPLVITKEELDWAFERIEQVLGVSVAQ

SEQ ID NO: 23180 - protein, 544 aa, Glycine max
  misc_feature (308)..(308): Xaa can be any naturally occurring amino acid
IFPLLLVGYGFGASFVALFAQLGGGIYTKAADVGADLVGKVEQGIPEDDPRNPAVIADLVGDNVGDCAARGADLFESIAAEIISAMILGGTMAQRCKIADPSGFILFPLVVHSFDLIVSSAGIFSIRGTRETGIIVPMEDPMTILQKGYSFTIVLAVLAFGLSTRWLLYTEQAPSAWFNFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQXGNTTKATTKGFAIGSAALASFLLFSAYMDEVSAFAHEPFKQVDIAIPEVFVGGLLGSMLIFVFSAWACSAVGRTAQEVVNEVRRQFIERPGIMDYKEKPDYGRCVAIVASASLREMIKPGALAIISPILVGIVFRILGYYTGQPLLGAKVVAALLMFATVTGILMALFLNTAGGAWDNAKKYIETGALGGKGSEAHKAAITGDTVGDPFKDTAGPSIHVLIKMLATITLVMAPVFL

SEQ ID NO: 23181 - protein, 434 aa, Acidovorax sp. JS42
MSNTPNPPLPTHALPSYLDPNHLGPWGVYLQQIDRVTPYLGSLARWVETLKRPKRALIVDVPIELDNGTIAHFEGYRVQHNVSRGPGKGGVRFHQDVTLSEVMALSAWMSIKNAAVNVPYGGAKGGIRVDPKTLSKAELERLTRRYTSEIGIIIGPSKDIPAPDVNTNAQVMAWMMDTYSMNVGTTATGVVTGKPVDLGGSLGRVEATGRGVFTVGVEAARLTGMAIEGARVAVQGFGNVGGTAGKLFAEAGAKVVAVQDHTGSIHNDKGLDVPALLAHVQRTGGVGGFAGAEPMANDAFWGVACDILIPAALESQITKDNAGRIQAKMVIEGANGPTTPEADDILNDKGVLVLPDVISNAGGVTVSYFEWVQDFSSFFWTEDEINARLVRIMKEAFAGVWQVAQENKVTLRTATFIVACKRILHAREMRGLYP

SEQ ID NO: 23182 - protein, 317 aa, Candida parapsilosis
MSIKLNSGHEMPIVGFGCWKVTNETAADQIYNAIKVGYRLFDGAQDYGNEKEVGEGINRAIDEGLVSRDELFVVSKLWNNYHDPKNVETALNKTLSDLNLEYLDLFLIHFPIAFKFVPIEEKYPPGFYCGDGDKFHYENVPLLDTWRALESLVQKGKIRSIGISNFNGGLIYDLVRGAKIKPAVLQIEHHPYLQQPRLIEFVQSQGIAITGYSSFGPQSFLELESKKALDTPTLFDHETIKSIASKHKKSSAQVLLRWATQRGIAVIPKSNNPDRLAQNLNVSDFELSKEDLEAINKLDKGLRFNDPWDWDHIPIFV

SEQ ID NO: 23183 - protein, 464 aa, Exiguobacterium sibiricum 255-15
MNQQKIGFFALAAMVIGSMVGGGAFNLPGAMAQKASAGPILIGWGITGLGMIMLALVFQHLANSKPELEGGIYAYAREGFGRFVGFNSAWGYWVSAWIGTVANITLVFNALSYFFPIFSSENRVFLLVMSIVVVWGLFFIVSSGIKEATLVNLITTIAKLVPILIFILLVAIAFNVKTFNLNFWGEGTELGSIFTQVKGTMLVTLWAFVGIEGAVVLSTRANKRSDVGKATVVGLVGVLVIYILISVLSLGVLNQEQLAGLQEPTMAYVLEAAIGPFGATLIMVGLIISLSGALLGWTILASEISYLVAKDGAFPKFFAKTNRKGAPVGALLITQIATQFVAGIALFSAQTYLVLSSIAGICALLPYLLSAVYSVRFSRAERNTKMLIFSTIAAAYSLWLVYASGIWYIVIAALVYAPGIIAYLMAEREQKRGGMSRYEMIASGILIILAAVAVYGMIGGQIQL

SEQ ID NO: 23184 - protein, 179 aa, Exiguobacterium sibiricum 255-15
MKYRVGQLVPNVDPSVYIADGAKVIGEVEIGKDSTVWFNTVIRGDEGPIKIGERVNIQDGSMIHQYEGYPTIIEDDVTIGHMAMIHGGIIRQGALIGMSATILDQAEIGSGAFVAAGSLVPPKMVVPPNSMVMGVPAKIVREISDHDRFIMERTIRKYVKRGQQYAADCTPLEEDLTTM

SEQ ID NO: 23185 - protein, 597 aa, Aspergillus nidulans FGSC A4
MNCPSRTDDTLGHPGWNQNPPPLNADATTREDFNGMANSKVRRGHISGLGEGGGISVLESPVPVPNSRDESALKAGAAGGAVSAYSRHQPERNSDSPRRSFPAFPHISSIPARVSQSLLKFARFVGPGFLVAVAYIDPGNYATDVAAGADFRYALLFIVLLSNLFAIFLQSLCIKLGTVTGLNLAENCREHLPKWLTIILYIFAEAAIVATDIAEVVGSAISLNLLLNIPLVAGCAITLADVLFILIFYRPNGSMWGLRLFEFFVMALVLGVVICFCIQLSLIKEQSIGDVFRGYLPSPAVVQSNGLYQSCGILGATVMPHSMFLGSGIVQARLKEFDVISGYADPTVCIGSTNGEVEYRPSLRAIRGCMKYSIIELALSLFTFALFVNSSILIVAGASLYNTPSATDDADLFGIYNLLSSSISKAAGTVFALALLLSGLSAGIVCTMAGQMVSEGMLNWSIRPWLRRLITRSISIIPSIVIAGAVGKEGLNKTLTASQVVLSVILPFVSAPLVYFTCRNRYMTVPMERVHDADADIDTDEQTQPQNAAEGDDNGGSATDGVKMGNGLLVSAIAVLVWVIIAVMNVALLVLVGMGKA

SEQ ID NO: 23186 - protein, 400 aa, Pseudoalteromonas tunicata D2
MIINGVAMKNLAVDVVIIGGGITGVGIAQFASAQGYRVQLLEQGVIGQQTSANSSKLIHGGLRYLETAQFHLVHKALHERRALLTLAPTLVKPIPFYIPIYQTSQRPSWQIRIGLSLYALLSGFDSLGRFKTLTNEQVKTLKGLKHDGLKTVFQYWDAQTDDALLTQAVARSASQLGAAITSRASCNKIEKNYQGYLVHYLKDNQANTTQAKMVINAAGPWVNQVLAKVSPAAQSEAIEWVQGSHLVLDIPAQDGIVYLESCFDNRVVFVIPWYGKTLLGTTELEITSLEQKPIPSQQEQDYLLGIYHHYFPAHGNLEQLTAKISATFCGVRVLPKQTGNAFAKPRDTLFHSPDGHPNLLNVYGGKLTTFRSTAKSSLDWLMEQLGPRQPIADVDDLPLQ

SEQ ID NO: 23187 - protein, 203 aa, Helianthus annuus
PYGFSVMKKFLTGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23188 - protein, 71 aa, Brassica napus
  misc_feature (58)..(58): Xaa can be any naturally occurring amino acid
  misc_feature (68)..(68): Xaa can be any naturally occurring amino acid
MATFGAAANANTNPNKSYEVTPSPADSISSLSFSPRADILVATSWDNQARCWEISRSXTSLVTAPKAXISP

SEQ ID NO: 23189 - protein, 241 aa, Brassica napus
  misc_feature (221)..(221): Xaa can be any naturally occurring amino acid
MDAMSSNFTLSKILNTEDPYSSVMLAAAALLAVICYFWIQGKSKSRNGPPLPPGPWPLPIVGNLPFLNSDILHTQFQALTQKHGPLMKIHLGSKLAIVISSPDMAREVLKTHDITFANHDLPEVGKINTYGGEDILWSPYGTHWRRLRKLCVMKMFTTPTLEASYSTRREETRQTVVHMSEMAHDGAPVNLGEQIFLSIFNVVTRMMWGATVEGEERTSLXGNELKTLISDISDIESIQNY

SEQ ID NO: 23190 - protein, 203 aa, Helianthus annuus
PYGFSVIEKFLAGARSIDQHFHSAPFESNISVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYKHRI

SEQ ID NO: 23191 - protein, 448 aa, Corynebacterium glutamicum ATCC 13032
MEDLSYRIPQSRTVAEQVPGPKSKALDERRQAAVARALAPGLPGYVVDADGGILADADGNRFIDLASGIAVTTVGGSNAAVAKAVGAAAARFTHTCFMVSPYETYVAMAERLNALTPGDHDKKSALFNSGAEAVENAVKVARAYTGKGAVVVFDNAYHGRTNLTMAMTAKNRPYKSGFGPLAADVYRAPMSYPLRDGLSGPEAAERAISVIESQVGAENLACVVIEPIQGEGGFIVPAPGFLAAISTWCRENDVVFIADEIQSGFLRTGDWFASDAEGVIPDVITTAKGIAGGMPLSAVTGRAEIMDAPGPGALGGTYGGNPVACAAALAAIEVMEQADLKTRAQEIETIIRDEFAQLSAFPEVAEIRGRGAMMAIELIDATGRPNAALTAAVAARAKAEGVLLLTCGTDGNVIRLLPPLVIAEDTLRDGLQVLVAALERETAHQKVG

SEQ ID NO: 23192 - protein, 453 aa, Corynebacterium glutamicum ATCC 13032
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 23193 - protein, 138 aa, Shorea leprosula
EKNIPVLLGLLSIWNVSFLGYPARGILPYSQALEKFAPHIQQLSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 23194 - protein, 332 aa, Bacillus thuringiensis serovar konkukian str. 97-27
MLMTRPNLKGRSFLAEKDFTPEELLYFLDLAAELKEKKKNGIPHHYLEGKNVALLFEKTSTRTRCAFTVACTDLGANPEYLGKGDIQLGKKESVEDTAKVLGRMFDGIEFRGFNHETVESLAQNSGVPVWNGLTDMWHPTQTLADLLTIREHVGKLKNVKLVYVGDGRNNVANSLLVGGAIVGMDVRICTPESLWPAQEVIDLAKKYNEQVMITSNVEEAVASADVIYTDVWVSMGEEEKFAERVELLKPYQVNMKMIKETGNKNVIFLHCLPAFHDVETMYGEEVYEKYGLKEMEVTDEVFRSKHSKVFDQAENRMHTIKAVMAATLGNME

SEQ ID NO: 23195 - protein, 521 aa, Pleurotus sapidus
MVLSTKLAALVASLPFVLAATKKLDFHIRNDVVSPDGFERRAITVNGIFPGTPVILQKNDKVQINTINELTDPGMRRSTSIHWHGLFQHKTSGMDGPSFVNQCPIPPNSTFLYDFDTAGQTGNYWYHSHLSTQYCDGLRGTFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPTGNPNLDVSLIRAILRYKGAPAVEPTTVATTDGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRTSNSDVVNLVNPPRRDVLPINGGNTTFRFFSGNSGAWFLHCHIDWHLEAGLAVVFAERPAEVNDGEQAQIVTQDWRTLCPAYDGLAPEFQ

SEQ ID NO: 23196 - protein, 292 aa, Aspergillus oryzae
MNKEAPLSIAERDFILNALREDVRLDGRQADQFRPLNVSFGEEYGHVKVQLGKTSLIVRISSEVTKPHDDRPFDGIFTIALELTAMGSPAWENGRQGDLETYVSNVLDRVIRHSNALDTESLCVLKGVSCWNVRADVHITNYDGNLIDAACIGVMAGLQHFRRPDAVVKDGQVIVYGVDERVPVALNITHKPLSVTFHTFDEGKRVIVDATRKEEQASEADVVMGLNNAGDVCYLSKFSGSPVSAMVFVNKSSVALEKVKEINGIIDKALQADLAKRAKGGLIEESRATNDR

SEQ ID NO: 23197 - protein, 324 aa, Ehrlichia ruminantium str. Gardel
MVKAVVIDKTGGVEVLKYVDCNVNEPKDDEVLIKHTAIGLNRYDLECCNGTRKIKKFPAVLGSEAVGIIEKLGKNVEVFNIGDRVGYCTVSGGAYSEKRVINQKYLVKIPDDITDQIAAAVLFKGMTAHYLTHVVYSTRPKSFALVHGATGGVGQILCQWASYKGSKVIGVTSSDDRANIALRSGCSYIINSNSESFVKQVMEITNGAGVNVVYDPIGALVGKVSFESLGLFGIYISYGQISGPLVNISASMMSSRSLFFTAPLIFHYKRSSFDLSMTAMELFEVMRKGHIKVNINKTYRFDDIITAHQDLEKRNLTGSNVILL

SEQ ID NO: 23198 - protein, 80 aa, Zea mays
ALLKQEGAEAVYACCTHAVFSPPAIERLSGGVFEEVIVTNSILLPEDKCFPQLTVLSMANLVGETIWHVHRDGSVSSIFQ

SEQ ID NO: 23199 - protein, 158 aa, Brassica napus
  misc_feature (153)..(153): Xaa can be any naturally occurring amino acid
MNSGSCSSLMEVGYDHHHHGHEELHVLAVDDNLIDRKLVEKLLKISSCKVTTAENAIRALEYLGLGDHNQHMALTNNNLKVNLIITDYCMPGMTGFELLKKVKESSNLKEVPVVIMSSEYIPTRISKCLASGAQMFMQKPLKLSDVEKLKCHXMNSRS

SEQ ID NO: 23200 - protein, 203 aa, Helianthus annuus
PYGFSVIEKFLSGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23201 - protein, 415 aa, Burkholderia mallei ATCC 23344
MSPTPVNPRLDTLQPYPFEKLRALFAGVTPSTPLPPISFGIGEPKHATPALIRDAAAAALDGLASYPATAGTDALRDTVARWLERRYGLPAIDATTQVLAASGSREALFSLAQAVIDSSPRENGATQDGERPIVLCPNPFYQIYEGAALLAGAAPYFVNSDPARNFAPDYSSVPADVWARTQLVYVCSPGNPTGAVLTLDDWRELFALSDEHGFVIASDECYSEIYFDETKPPLGGLEAAHRLGRDFTRLVMLSSLSKRSNVPGMRSGFVAGDAALLKRFLLYRTYHGAALSPVWQKASVAAWGDEAHVRENRALYAQKFATVTPMLAEVLDVRLPDAAFYLWANVARTGLSDTEFARRLYADYNVTVLPGSYLARDAHGANPGRDFVRIALVAGTAECVEGAQRIVDFCRGLAR

SEQ ID NO: 23202 - protein, 128 aa, Corynebacterium glutamicum ATCC 13032
MAKLTKDELIEAFKEMTLIELSEFVKEFEEVFDVTAAAPVAVAAAGAAGGEAAAAEEKDEFDVVLEDAGAKKIGVIKAVRELVSGLGLKEAKELVEGAPKAILEGANKDDAEAAKAKLEEAGAKVTLK

SEQ ID NO: 23203 - protein, 403 aa, Oryza sativa
  misc_feature (175)..(175): Xaa can be any naturally occurring amino acid
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGXLLPLPASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCRYSNHQSHFSI

SEQ ID NO: 23204 - protein, 426 aa, Leifsonia xyli subsp. xyli str. CTCB07
MRTDTLDPLRIRADFPAFDREVNGHPFVYLDSGATAQKPRQVLEAERTFAERHTSAVHRGAHTVAGEATEMFEEARARVTGFVGARPEELVWTAKATEGINLLAYGMSNASLGRGGPAAGRFRLGPGDDLVVTEAEHHANLIPWQELAARTGATLRVIGLTDDGRLRLDQAAELIGPRTRVVAFAHVSNVLGTVAPVAELVALAHEHGALAVLDACQSVPHFAVDFPALGVDFAVFSGHKMLGPTGIGALYGRQELLDALPPFLTGGSMITTVTLDGAEYLPAPQRFEAGTQPVSQAVGLASAVDYLGTVGMAAIASHEEALGARLLAGLGALDGVRVLGPGPGTPRVGLASFVVDGIHAHDVGQFLDDRGIAVRVGHHCAQPLHRRFAVTASTRISTYLYNTADEVDAAVAAVADARAFFGVIES

SEQ ID NO: 23205 - protein, 424 aa, Ashbya gossypii ATCC 10895
MVNTTALIRSPTFVAQFRVLKQVNRGLFSQTSYARTHARTSYTHTMAGTDRLQQTSQILSRSTSSEIRLERPFKVTVIGSGNWGTTIAKVVAENTQEYPQLFERRVDMWVFEEQIEGRKLTEIINEQHENVKYLPGITLPENLVANPSVAAAAADADVLVFNIPHQFLGRIVEQLKGHVKPGARAISCLKGFSVGKDGVQLLSTYIEEHLHIPCGALSGANLAPEVAKGNWSETTVAYTLPQDFRGTGKDVDHAVLKKLFHRPYFHVNVVDDVAGISVAGALKNVVALACGFVLGLGWGNNAAAAVQRVGLSEMIKFARMFFPESKVETFYQESAGVADLITTCAGGRNVRIGRAMAETGKSAQELEKELLNGQSSQGIYTTQEVHEWLQQCGKKDEFPLFEAVYKIVYEGVPMSKLPDMLEDA

SEQ ID NO: 23206 - protein, 121 aa, Prochlorococcus marinus str. MIT 9211
MAAQKLRWQCIRACGACCRLAPHERVEALQALSKEQTIQYLRLVADDGWCRFYNKSMKTCTIYNQRPDFCNVKNLLSIFKLDNTSIDTVAIMSCRQHIRSIYGGRSQVLKRFEHTLRSNST

SEQ ID NO: 23207 - protein, 457 aa, Ashbya gossypii ATCC 10895
MNNIIVFAGSSHPSLVNKICENLSIRPAEVKLGKFSNGETSINIGESVREKDVYVIQSGCGHVNDNFMELLILINACKTSSASRVTAVMPYFCYSRQPDIPYTAKGAPLISKARKAGEKGAEAVESVLTTQKPVSQSARKSIELAIENSISTLQLGESAPVRAKLEHSGSNSRIPVIQKHEEASSSEAAGTAFNSNNSSYKLWVAQSGTLVANLLTTAGADHVITMDLHDPQFQGFFSIGVDNLYCKPLIQAYIQHRIPEYKDAVIVSPDSGGVKRSSKVADALGLPFALIHKERRSQILKGPPDATLASGGGMPLSPKPLISNLNSTDVKSSLGSSKYVQTTMLVGQVRDKVCILLDDLVDTSYTITRAATLLKEQGATKVYAVVTHGVFSGDALNRVAQSAIDKIIITNTVPQEETVRILGKDRVDIIDVSRVFGEAIRRIHNGESISMLFEYVT

SEQ ID NO: 23208 - protein, 156 aa, Triticum aestivum
  misc_feature (89)..(89): Xaa can be any naturally occurring amino acid
PRPEHATLSSTSRPAASSACTNQPNGHHQRRRGDHRRRPCRHRQAEGPRSAPPEDKDREGECAPTPRTPRRLPLPAAVRGAGASLLAAXGAVTASAGPTLALVDERMSTEVTGLILVLTNNLLGWILLGVFGLIWSLYTVYTSDLDEDEESADLSL

SEQ ID NO: 23209 - protein, 480 aa, Mycobacterium smegmatis str. MC2 155
MTVEGANFIDGQWIPAASGRTFARHNPADPDDLVGVFPASDGVDVRTAVDALDKAAPEWAATPPERRAAILEAAAVQLESRAAELIAELIREEGKTTAEATMEVSRTPANLRFYAGEALRSTGTTYPAPGEGLVYTLREPVGIVGAITPWNFPFNIPSRKLGPALAAGNPVLYKPSELTPLMGQRLVEALLDGGLPPSAVALVQGDGVAGAAVAADPRVAAVTFTGSTAVGRAIHQQVGPQRRVQLEMGGKNPVVVAGDADLDAAAALIVKGAFGLSGQACTGTSRVIAVDEVHDALLDRVVAKADALQVGPGNEPGVQMGPLASAAQREKFLHYVHAGITEGATLRCGGTTVGDHGFFVRPAVFADALPTMRIVTEEVFGPLVAFQRAASLDEAVALANATEYGLAASIVTSDLAAATRFARQSKTGLVKINQPTTGMAMNAPFGGYKASSTQTFKEQAGPTLMEFYTLEKTVYLTPAL

SEQ ID NO: 23210 - protein, 235 aa, Exiguobacterium sibiricum 255-15
MLLTDAYEIAKFIKDAKKQTPVKLYVNGDLAGLTIEGATAFGTDQSKIFFADAGLASTFLEEYADRITEVHVEYDRRNSAVPMLDTRHLNARIEPGSWIRDHVVIGDNAVIMMGAIINIGASIGDGTMIDMNAVVGARGTIGKNVHVGAGAVVAGVLEPPSKTPVIIEDGVLIGANAVILEGVRVGKDAVVAAGSVVTEDVPAGSVVAGTPARVIKQKDEKTAEKTQLVDDLRSL

SEQ ID NO: 23211 - protein, 443 aa, Pseudomonas putida
MRTLDVHPIIDNARFTPFHWMVMAWCGLLLIFDGYDLFIYGVVLPVIMKEWGLTPLQAGALGSYALFGMMFGALAFGSLADRIGRKKGIAICFALFSVATILNGFASSPSEFGIYRFIAGLGCGGLMPNAVALMNEYAPKRLRSTLVAIMFSGYSLGGMLSAGVGIFMLPRFGWESMFFAAAVPLLLLPVILYYLPESIGFLVRKGRTEEARALLKRLDPQCDVQADDVLQAADRKAGGGASVLELFRNGLAIRTLALWLAFFCCLLMVYALSSWLPKLMANAGYSLGSSLSFLLALNFGGMAGAILGGWLGDRYNLVKVKVAFFIAAALSISLLGVNSPMPVLYLLIFIAGATTIGTQILLYAGAAQMYGLSVRSTGLGWASGIGRNGAIVGPLLGGALMGINLPLQLNFIAFAIPGAIAALAMAVHLASGRRQARAIAAQA

SEQ ID NO: 23212 - protein, 180 aa, Streptococcus pyogenes MGAS315
MIKKENIPNLLTLVRIAMVPFFLFITSSSNKVGWHIFAAVIFAIASFTDYLDGYLARKWHVVSNFGKFADPLADKMLVMSAFIMLVGLGLVPAWVSAVIICRELAVTGLRLLLVETGGKVLAAAMPGKIKTATQMLSIILLLCHWIFLGNVLLYIALFFTIYSGYDYFKGASFLFKDTFK

SEQ ID NO: 23213 - protein, 402 aa, Streptococcus pyogenes MGAS315
MKIAVAGSGYVGLSLGVLLSLQNEVTIVDILPSKVDKINNGLSPIQDEYIEYYLKSKQLSIKATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMVIQGISYDDRIGMHYNNPSFGYGGYCLPKDTKQLLANYNNIPQTLIEAIVSSNNVRKSYIAKQIINVLEEQESPVKVVGVYRLIMKSNSDNFRESAIKDVIDILKSKDIKIIIYEPMLNKLESEDQSVLVNDLENFKKQANIIVTNRYDNELQDVKNKVYSRDIFGRD

SEQ ID NO: 23214 - protein, 304 aa, Streptococcus pyogenes MGAS315
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFDILERQVPGAGNEVQLTDAIDTLNKTQRVFAREFKGNRYDVGDKFGFMKTSIDYALEHPQVKEDLKNYIIKLGKALEKSKVPTHSK

SEQ ID NO: 23215 - protein, 289 aa, Geobacter sulfurreducens PCA
MQVKKAVFPVAGLGTRFLPATKSSPKEMLPLIDKPLVQYVVEEAVASGIEQLLFVTGRSKRAIEDHFDISFELEALLQEKGKDDMLQEVREIADMVKIFYVRQKQALGLGHAILCAREFVGDEPFAVLLGDDIIDAEQPCLGQLLDVYRKYRGPVVALEKVPIEAISSYGCVKATGITDRIFEVTDLVEKPRREEAPSDMAIIGRYVLTPDIFPILERQTPGKGGEIQLTDALLTLSREEAIYGCLFKGKRHDCGDKLGFLKATVDMALKREEFNEEFRDYLREVLARG

SEQ ID NO: 23216 - protein, 163 aa, Rhodopseudomonas palustris CGA009
MADARRAPLKDQTDVSGARVLIVEARFYDDIQDALLEGAVAELKAAGATHDVLTVPGALEIPAAVAIAIDSAEAAGKPYDAAIALGCVVRGETIHFEIVSMESARALMDLSVARKFPLGNGIITVNTDEQAWARAKPGDLNKGGDAARAALAMLRIKRRLAKA

SEQ ID NO: 23217 - protein, 85 aa, Glycine max
VNRAQARMYVICTGHKYMVGFPTRKTNNDITCIVSNGGRVQCMQVWPPFGKKKFETLSYLGDADDAQSLEELQFRFRNEGSLAWI

SEQ ID NO: 23218 - protein, 536 aa, Chlamydomonas reinhardtii
MAMSTLRAALGHAARVAHEGSLVGLLSRGMASAAQPAVDHAHHEKSRSALSYAQKLPNQLFIDGKWVDALSRKTMPVVDPRTEEVVVEVAEGDAADVDRAVEAARRAFDTGPWPRMTAKERGRLLYRLADAMEAHVDELAQLETLDNGKPFFYSRHVDVPFAIDHLRYYAGWADKIHGKTIPVDGPYLAYTFHEPLGVVGQIIPWNFPILMAAWKLGPALAAGNTVVLKPAEQTPMTALKVAQLAKEVGLPDGVLNVVTGYGPTAGNRVASHPGVDKTAFTGSTEVGRLVAKAAAEQLKPCTLELGGKSPIIVCPDVDVDKAVADAHMALFFNHGQCCAAGSRVYVHEAVYDEFVRKSTEAAATRKVGDPFSSVEQGPQVDDDQFKKILSYIDSGKRQGAKLMTGGGRKGDRGYYVEPTVFADVKDDMKIAREEIFGPVQSIMKWKSLDDVIARANNSPYGLAAGVFSNNIDTVNTLTRALKSGTVWVNCYNLYDNAVPFGGYKESGIGREKGEYALSNYTQVKAVYQPLSNPAWR

SEQ ID NO: 23219 - protein, 203 aa, Helianthus annuus
PYGFSVIEKFLAGARSIDQHFHMAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23220 - protein, 706 aa, Rhodopseudomonas palustris CGA009
MTALWVIVLCGALSIVYAIWATSSVLAADQGNARMQEIAGAVREGAQAYLKRQYMTIAIVGVVIFALLAYFLGILVAIGFAIGAILSGAAGFIGMNVSVRANVRTAQAATTSLAGGLELAFKAGAITGLLVAGLALLGVTLYFIYLIHFAGLQANSRTVVDALVALGFGASLISIFARLGGGIFTKGADVGGDLVGKVEAGIPEDDPRNPATIADNVGDNVGDCAGMAADLFETYAVTAVATMVLAAIFFGSATPDQLQSVMTLPLAIGGICILTSIAGTFFVKLGASQSIMGALYKGLIATGVLSLVGVGVVIHQLIGFGPLPGVSYTGLALFECGIVGLAVTGLIIWITEYYTGTDFRPVKSIAQASVTGHGTNVIQGLAISMESTALPAIVIIAGILITYSLAGLFGIAIATTTMLALAGMIVALDAFGPVTDNAGGIAEMAGLPKEVRKSTDALDAVGNTTKAVTKGYAIGSAGLGALVLFAAYNEDLKFFIAQKSPYFVGVAPDFSLNNPYVVVGLLFGGLLPYLFGAMGMTAVGRAAGAIVEEVRRQFREKPGIMKGTDKPDYGKAVDLLTKAAIKEMIIPSLLPVLSPIFVYFAIYAIAGGGAAGKSAAFSAVGAMLLGVIVTGLFVAISMTSGGGAWDNAKKYIEDGHHGGKGSDAHKAAVTGDTVGDPYKDTAGPAVNPMIKITNIVALLLLAILAH

SEQ ID NO: 23221 - protein, 386 aa, Glycine max
  misc_feature (78)..(78): Xaa can be any naturally occurring amino acid
MEHKLATTEGQPIRCKAAVCRKAGEPLGIEEIMVAPPMPGEARIRIICSSLCRTDISFRNMQGPPANFPTILGHEAIXVVESVGEDVTEVAKGDMVVPIFIAECGECIDCKSSKSNLCSKFPFKVSPWMPRHATSRFTDLKGEIIHHFLSVSSFSEYTVVDIAHLIKIDPEIPPNRACLLSCGVSTGVGAAWRTAGVEPGSTVAIFGLGSIGLAVAEGARLCGATRIIGVDVNPEKYEIGKKFGLTDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 23222 - protein, 526 aa, Triticum aestivum
MDCVLLSSHLSSHATVNARLQQCSVSLNSIGFAVIRKGCLRLRCYAIGDAGRRNDPLNENKNGPISQELNGSSASFTTVGAEITQETGDFFSSDAEGDPDKPTEGFSSIEDAINSLREGKFVIAVDDEKGDNEGDLIMAADQASPESIAFMIRNGSGIISVGMKEEDLERLMLPMMSPVTEIGDISAAASTVTVDARVGISTGVSAADRAKTILALASPDSKPSDLRRPGHIFPLKYRNGGVLKRAGHTEASVDLVALAGLRPVSVLSSIIDPKDGSMASTPALKQMALEHDIPIVSITDLIRYRRKREKLVELIAVSRLPTKWGLFRAYCYQSKLDGTEHIAVAKGDIGDGEDVLVRVHSECLTGDILGSARCDCGEQLDLAMQLIEKAGRGVLVYLRGHEGRGIGLGQKLRAYNLQDQGSDTVEANVELGLAIDSREYGIGAQILRDIGVRTMRLMTNNPAKFVGLKGYGLAVVGRVPVISPITKENQKYLETKRTKMGHLYGSDLPGGLLKEFLNPTEDNATN

SEQ ID NO: 23223 - protein, 237 aa, Lolium perenne
MCPIKEEMGGESGSPCSGDYYSPSTSSELQQVHSQNQTPWTKRPAGRTKFRETRHPVYRGVRRRGNAGRWVCEVRVPGRRGSRLWVGTFDTAEIAARAHDAAMLALAAGDSCLNFADSAELLAVSASSYRSLDEVRHAVTEAVDEFERHHALGEEDALSGTSASTPSSSSSVTDDETSSSWAADSPFELEVMGDMGRDLYYSSLAQGMLMAPPTAAAALGDYGEANLADVALWSYQS

SEQ ID NO: 23224 - protein, 226 aa, Methanopyrus kandleri AV19
MSVPPHLEEWEPKTKLGRMVKEGEIKTIDEVFAQGWKILEPEIVDWLLPDLEEEVLDVNMVQKMHKSGRRVRFRVTVVVGNKDGFVGVGQGKAREVGPAIRAAIDRAKLNIIKVRRGCGSWECGCGRPHSIPFEITGKCGSVRITLKPAPRGTGLVAGETAQKVLEMAGIEDVWTKTTGGKGKGETRTTINFAKATFDALRNLIYVRMREEEAERLGIVSGSAEGA

SEQ ID NO: 23225 - protein, 452 aa, Arabidopsis thaliana
MTPPPNSISSRNVAVIGAGAAGLVAARELRREGHTVTIFERQKQVGGLWVCTPNVEPDLLSIDPDRTVVHSSVYQSLRTNLPRECMGYSDFPFVTRPDDESRDPRRYPDHREVMRYLQDFAKEFKIEEMIRFETEVFRVEPTAENSCKWRVQFRSSSGVSGEDIFDAVVICNGHFTEPRLAHIPDPFKGQVVIVIGYQSSGSDISRDIAILAKEVHIAAKSDAYAKESSIYSNLHFHPTIDRVYEDGSVVFQDGKLIFADAIVHCTGYKYCFPFLETKGYVNVEDNRVGPLYKHVFPPALAPGLSFIGLPSMALQFFMFEIQSRWVASVLSGRVKLPSEEQMMEDVIAFYAKLKSLGIPKRFTHFLTDPQWTPMFEKLKPHEAVLISQSEYFNWIAEQCGCSSIERWREEQYNIAIKKDDDNFRDEWDDDDQIIQEAYRDFAKFKPSKVWST

SEQ ID NO: 23226 - protein, 369 aa, Leifsonia xyli subsp. xyli str. CTCB07
MIGAGSWGTTFAKILADGGNDVVVWARRPELAREIDEGKRNSDYLQGINLPRSLRATSHLGEAMRGAEQVFVSLPSQTLRSNLDAMIPYLGPATVVISLMKGVEKGTGLRMSEVIAQGLPIDPEQIAVVSGPNLALEIAREQPTAAVVSSVSPATAVAVATSATNRYFRSFVNTDVIGTEFGGVLKNLIAVAIGIVDGVGYGENTKASIITRGLVEMTDFAVAYGADPQTLSGLAGLGDLIATCESPLSRNNTAGRLLGQGYSFTDVVKQMDQAAEGLASVTPILSLAEARGVEMPIVRQVSQVLAGTLAPKDIAPHLTTDDEPQGERTRGERTTDDGQGQGRTSVWGSLKRAFDQLRDGGGSSRRDRP

SEQ ID NO: 23227 - protein, 268 aa, Ashbya gossypii ATCC 10895
MAKTHTPRCIVIRHGQTEWSKSGQYTGLTDLPLTEYGVGQMRRTGAAIFSAKYIDPAHITYVFTSPRQRARKTVDLVLESLSEDERARIQVVVDEDLREWEYGDYEGLLTSQIIELRRSRGLDCKRPWNIWRDGCENGESTQQVGLRLSRVIARIQALHRQHQAEGRPSDILVFAHGHALRYFSALWMKMGVEAPTPDCAMPSSNRNDDSVPLVRLEQFRYLQDNPNFLLDAGGIGVLSYAHHNIDEPALALAGAFVCPPQEESQHDG

SEQ ID NO: 23228 - protein, 399 aa, Exiguobacterium sibiricum 255-15
MTTVLKFGGSSVATVEQIQSIANYLKNRTEQGEKLVVVVSAMGKMTDSLIAQAQAITDRPERRELDRLLAIGEEQTISLLSIALNSLGIKALSQTGAQAGISTMGLHTKSKIKQIDGELLRKKLETYDVIIVAGFQGVNELGDVTTLGRGGSDTTAVALAAVLDKRCEIYTDVDGVYTADPRIHATAQPIPHISYDEMMEMSALGSKVMEMRSVELGKKYGVHIFVGKTLESERGTWIMEATETMEQKAVTSVSVTKNVLTVSIKHVPQTNSAVADIFELLSGRHVNIDMISQTTFDSDIFLSFSCPLDEEEFLEEALQDIINRFPTVKVDRHNQHAKLSVVGIGMRDATGVASKLFATFRAENITFYQVTTSEISISYTIAQADIERTVAAIAKAFDL

SEQ ID NO: 23229 - protein, 433 aa, Prochlorococcus marinus subsp. pastoris str. CCMP1986
MKSPVLKNPNQDWHPNIWPPFTQIINSKPQLEVTHGKNALIYTKNPKQELIDGISSWWVTLHGHSNDYIADAIYHQAKTLEQVIFADFLHPQAQILSERLSGLTKLERLFFSDNGSTAVEVALKIAYQSWQNQGETRNQIIAFDGAYHGDTFGAMALGERNIFNENFDNLMFPVKRAPWPSTWINDEEVERKENNAIQILTKLLKKPTVAVILEPLVQGAGGMNMVRPEFIRRVSEVVKNNNSLLIADEVLTGFGRCGSLFAFQKANIIPDLISISKGLTGGFLPMGITLAKETIFQSFISDSPKKTFWHGHSFTANPLGCAAANASLDLLEKDPIKYLSFEEKHLSHLKKIKKLPFVKNIRVTGTIAAFDIEIGKNEGYLNNVGKRIKALSIKKGLFIRPLGNVIYLLPPLCITDRQLEKSYRIIFEILSDL

SEQ ID NO: 23230 - protein, 108 aa, Triticum aestivum
CVQLGGKGANLAEMASIGLSVPPGFTVSTEACEQYQAAGRALPPGLWEETLEGLRWVEEYMGARLGDPARPLLLSVRSGAAVSMPGMMDTVLNLGLNDEVAAGLAAKN

SEQ ID NO: 23231 - protein, 297 aa, Phaeosphaeria nodorum
MPLDNVRNIVLVLSGKGGVGKSSITTQLALTLSLQGHTVGVLDIDLTGPSIPRFFGIEESKVRQAPGGWIPVDVHAQQTLSAHRLQKTAEGQEIGALSCMSLGFILPNRSDAVIWRGPKKTAMVRQFLTDVLWPKVDYLLIDTPPGTSDEHISLLETLLKNTSTTPHASLPYLAGAVVVTTPQAISISDVKKELNFCKKTGIRVLGVVENMAGFVCPNCSECTNVFSKGGGEVMARDFNVPFLGSVPIDPAFVQLVEEGTRPLYPEGTIMAGTDVSAAPNGKEAGSTTHGSRLLICE

SEQ ID NO: 23232 - protein, 242 aa, Vibrio fischeri ES114
MLFFDNLHPSRIIVGEQSERAQVFADLLVEGAIKENIEVLLTNSTEAEAVKLFSNTYLAMRVAYFNELDSYAEAHGLDARQIIEGVGLDPRIGNHYNNPSFGYGGYCLPKDTKQLLANYQEVPNNIIGAIVDANRTRKDFVAESIMKRNPKVVGIYRLIMKAGSDNFRASSIQGIMKRLKAKGIEVVVYEPVLKEADFFNSRVIEDLAEFKQVSDVIVSNRMMEELSDVESKVYTRDLFGSD

SEQ ID NO: 23233 - protein, 217 aa, Ralstonia solanacearum GMI1000
MIRNELIDQLARTQASALETQGLGLVPMVVEQSGRGERAYDIYSRLLKERVIFMVGEVNDQTANLVVAQLLFLESENPDKDISLYINSPGGSVSAGLAMYDTMQFVKPDVSTLCMGMAASMGAFLLAAGAKGKRYALPNSRIMIHQPLGGARGQASDIEIQAREILYLRERLNTILSEVTGQPVDKIARDTDRDNFMSGDQAKEYGLIDKVLARRGA

SEQ ID NO: 23234 - protein, 335 aa, Vibrio fischeri ES114
MNILVTGGMGYIGSHTCVQMIEAGLTPIILDNRYNSKEVVLDRIEALVGVKPKFYQGDIRDPKILETIFAENQIDSVIHFAGLKAVGESVEKPIMYYDNNVSGTLVLVEAMRKAGVNSIVFSSSATVYGDPASTPIREDFPTSATNPYGRSKLMVEECLTDIQKAHPEMSVTLLRYFNPVGSHKSGTMGEDPQGIPNNLMPFISQVAVGRREFLSVFGNDYPTVDGTGVRDYIHVVDLADGHLAALKYKGQEAGLHIYNLGTGNGNSVLQMVTAFEKASGAKVPYKIVDRRPGDIAECWADPAKAREELKWEAKLSLDDMTADTWRWQSNNPEGY

SEQ ID NO: 23235 - protein, 510 aa, Vibrio fischeri ES114
MSAKKPMALVILDGYGHRETQADNAITNANTPVLDGLMANQPNTLISASGMDVGLPDGQMGNSEVGHTNIGAGRVVYQDLTRITKAISDGEFQQNETLVNAIDKAVKAGKAVHIMGLMSPGGVHSHEDHIYAAVEMAAARGAEKIYLHCFLDGRDTPPRSAENSLKNFQELFAKLGKGRIASLVGRYYAMDRDNNWERVQKAYDLMTEAKAEFTFATAVEGLEAAYAREENDEFVQATEIKAEGEESAAIVDGDAVIFMNYRADRARQITRTFVPSFDGFTRNVFPAIDFVMLTQYAADIPLLCAFAPASLENTYGEWLSKEGKTQLRISETEKYAHVTFFFNGGIEDEFEGEERQLVASPKVATYDLQPEMSAPELTEKLVAAIKSGKYDAIVCNFPNCDMVGHTGVYDAAVKAVESLDECIGKVVEAIKEVDGQLLITADHGNAEMMIDPETGGVHTAHTNLPVPLIYVGSKAVEFKEGGKLSDLAPTMLALTDTAIPAEMSGEVLFK

SEQ ID NO: 23236 - protein, 297 aa, Salmonella enterica subsp. enterica serovar Paratyphi A str.
MKPQIYHVDAFTSEPFRGNSAGVVLHADTLSDAQMQLIARELRHSETAFLLKSEESDVRIRYFTPTVEVPICGHATVAAHYVRATVLGLGNTTVWQTSLAGRHRVEIHAEHNDYRITLEQGQPSFEPPLVGEIRAAIITALNLTEDDIVPGAPIQVASTGHAKVMILLKPDVDIDALSPNLAALTAISQQIGCNGFFPFQIRPGKNETDGRMFSPAIGIVEDPVTGNANGPMGAWLVHHGLMAHDGKTLQIQGHQGRALGKEGTVDVSVTIRDNQPENVTISGQAVILFHAEWAITF

SEQ ID NO: 23237 - protein, 517 aa, Aspergillus nidulans FGSC A4
MGAIDIPELQFTPIEEIQERVSRVKKTFLEHKTRDVEFRLVQLRKLYWAIKDHEQQIVEALRSDLGKPQFETEVSESVWLENDIVFISKNLHKWVKDEKADDIDLTFKFMNPKIRKDPLGTVLLTLGPVLGAIAAGNTVVIKPSENAPKSAVVMQQIVEAALDPSCYTIVQGAIPETQALLAERWDKIFFTGGATVGRIIAKAAAPHLTPVVLELGGINPAIISKSANPRLVARRLLWGKLMNAGQVCTSQNYLLVDRSLVPAVVEEFKKAYKEFYPNGAKASPDYARIVNEGAFRRLKGMIDNSQGKILMGGTMDEKDLFIEPTLVQVESPDDSMLVQESFGPLIPILPVDNIDEAINIANSIQSTPLGLYPFGSKADTEKILSQTRSGGVSVNDAALHIPTLPFGGVGESGYGAYRGRASFDVFVHRRPITSSPGWLESILAIRYPPYAGKLAKFKAASVSAPDFDRSGRKVHLGWLRYILTLGGGSAKAGAGRAAVVAAVAYFVMKIIERRSKL

SEQ ID NO: 23238 - protein, 159 aa, Streptococcus pyogenes MGAS315
MKVKLICVGKLKERYLKDGISEYQKRLSRFCQFEMIELTDERTPDKASFADNQLIMSKEAQRIHKKIGERDFVIALAIEGKQFPSETFSELISGVTVKGYSTITFIIGGSLGLDSIIKKRANMLMSFGLLTLPHQLMRLVLTEQIYRAFMITKGSPYHK

SEQ ID NO: 23239 - protein, 256 aa, Geobacter sulfurreducens PCA
MKNLNLYHFFDCKDRKITMYRLTEKGERIRDMFSDIAPRYDFLNRLLSFGVDRRWRRNAVKCIRWSEGGRVLDVATGTGDVALEIARQTPPSVAIVGVDFSEGMVALGRDKVAGSPYAGRITMEIAPCEAIPFPDDTFDSVTIAFGIRNVVDRSQGLSEMLRVLKPGGRAVILEFSTPRSRLFKRIYSFYFLRVLPVIGGLFSQFGAYKYLPDSVLEFPSQEEFKALMASVGFRDTAHRDQTFGIATIYTGEKGLK

SEQ ID NO: 23240 - protein, 539 aa, Ralstonia solanacearum GMI1000
MPTALPAWQSLSQHAQAIRATHMRDWFAAPDAEQRVHAFTVEAAGLTLDYAKNRITPETLALLLQLADEAGVLTLRDAMLRGERINNTEHRSVLHAALRGHAEDDYRANGAAVMPDVLRVRAQMRDFAQRVHSGTWTGHAGQRITDVVNIGIGGSDLGPRMVCRALAHLAVPQVRVHFVSNVDGTDLAETLAGLNPDTTLAIVCSKTFTTLETMANAHSMRRWFIEHGVPEAQLKQHFVAVSTNRDAVVAFGIDPDNMFTFWDWVGGRFSLWSAVGLSIVLAIGPEQFETMLDGARAMDRHFASAAPRENMPLILGLLSVWYRGFFGAASACTVPYCAPLELLTDFMQQLEMESNGKSVQRNGAAIGTDTGPIVWGTAGTNGQHAYFQLIHQGSQIVPVDFITTLEPVRSLPGHHTKLLANCFAQGEALLRGRTAEEVRADGITDAALVPHMVFEGNRPSNTILMQRLDAASLGALIACAEHRTFVQGAVWNINSFDQWGVELGKKLAKPILEELEGAPASVAHDASTAALIRRAKAAR

SEQ ID NO: 23241 - protein, 203 aa, Helianthus annuus
PYGFSVIEKFLTGARSIDQHFHSAPFESNIPVLLGLLSVWNVSFLGYPARAILPYTQALEKLAPHIQQVSMESNGKGVSIDGVRLPFEAGEIDFGEPGTNGQHIFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23242 - protein, 781 aa, Aspergillus nidulans FGSC A4
MTVCYEHPSRGLTPTSMATLSDRFELMKEVGDGSFGSVAVARVRTAGSNIARRGTLVAIKTMKKTFDSLAPCLELREVIFLRTLPPHPHLVPALDIFLDPLTRKLHIAMEYMDGNLYQLMKARDHKYLDGKHVKSILYQILCGLDHIHAHHFFHRDIKPENILVSTSAPNDSTFSRYSNLVTPPSTPTTYTVKIADFGLARETHSKLPYTTYVSTRWYRAPEVLLRAGEYSAPVDMWAVGAMAVEIATLKPLFPGGNEVDQVWRVCEIMGSPGNWYSKSGAKLGGGEWKDGSRLAQKLGFTFPKMAPHSMESILPAPQWPAALSNFVTWCLMWDPKNRPTSSQAMQHEYFADAVDPLSVRPRSSTARLLGRKQSEKSVKSPTKDTYESPTLSSKPSWFRRSLIGRSESPALVEPEQPSKPTLPALDSNVDPQLLKPKHSTSKRATWAHGAPMPILPSIRPVSPLSNAVTAQANPPAQESNTNAAKSSKKIGRQLSVNSHGNHYGDVHRQEAERALNGLGNNSTSTISQKESFFSHLRKRARRLSGRNQNAMNDDIEANAGCMPWSNRSSLALDSVNVSEAKQNSDFSELDKAVQNVRYSMDSAALGNVPVSITTPVEASKRQSMPQGSIRSMGDSPASMNGNGGPISSRTRRAMQMTNHPVHRYETPEEEDELLDEVLHSASSAAMRLAQAQMSDTSSNYSRPLCNEQSHNLPSPYPTPSPSAKCDGVSFGNEDAAPNRRLPLSDEKSATSATRQWPTPPYDDGDWMNPASTKFLTGSTYR

SEQ ID NO: 23243 - protein, 195 aa, Azoarcus sp. BH72
MLLMIDNYDSFTYNLVQYFGELGAEVKVFRNDEITLEQIAHMKPDHLVISPGPCSPAEAGISVAAIREFAGKLPILGVCLGHQSIGAAFGGRIVHAQKLMHGKTSPVHHKDLGVFRGLPNPLTCTRYHSLAIERASLPDCLEVTAWTDDGEIMGVRHKTLDVEGVQFHPESIMTERGHDLLKNFLDSTRSLPAAA

SEQ ID NO: 23244 - protein, 203 aa, Helianthus annuus
PYGFSSIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23245 - protein, 95 aa, Glycine max
  misc_feature (85)..(85): Xaa can be any naturally occurring amino acid
MEMFSSMISFPAVATVNRAGAGMVAPFTGLKSMAGFRTRKTYYVITSIASVGVRVQCMHVWPLIGWKTFATFHYLPDLDDALFAXVVAFLVRKGW

SEQ ID NO: 23246 - protein, 233 aa, Azoarcus sp. BH72
MFRIAPSILSANFARLGEEVSQVVASGADWIHFDVMDNHYVPNLTIGPLVCEALRPVTTAPIDVHLMVKPVDRIIPDFAKAGANIITFHPEASEHIDRSLGLIRDSGCQAGLVFNPATPLHYMDHVMDKLDVVLLMSVNPGFGGQKFIPETLNKLRAARARLDAYEAQSGRRILLEIDGGVKVDNIAEIARAGADTFVAGSAVFGAGKDSDPNRYDGVIGALRAELAAVGTPG

SEQ ID NO: 23247 - protein, 275 aa, Zea mays
MGHSLSSHSKSTLSSPPRRSRSLSPMSPPPLRLTAPMQIAAEDSGSDSSSSFAPPARDYTQDLPDEILALVFASLSPTDRNACSLACSRWMEVDATALPSGRLSRLKLRGLRQLSDAGLASLAAAAPAIRKLSVASCTFGPKAFVAVLQSCPLLEDLSVKRLRGLPDTAGATTSIAEDIKFPPASSLRSVCLKDLYSALCFVPLVASSPELRSLKILRCSGAWDLPLEVITARAPGLVELHLEKLQVGDRGLAALSACANLEVLFLVKTPECTDS

SEQ ID NO: 23248 - protein, 555 aa, Candida glabrata CBS 138
MASSNTYSNFKLATELPAWSKLQKLYDAQGKSLNVKEEFQKDSARYNKYAKTLTNYDGSKILFDFSKNLINDEILATLIELAKEAKVTDLRDAMFAGEHINFTEDRAVYHVALRNRANKPMKVDGVDVAPEVDAVLQHMKEFSEQVRSGEWKGYTGKKITDVVNIGIGGSDLGPVMVTEALKHYAGVLDVHFVSNIDGTHIAEVLKVVDPETTLFLVASKTFTTAETITNANTAKNWFLSKTGNDQSNIAKHFAALSTNETEVAKFGIDTKNMFGFENWVGGRYSVWSAIGLSVALYIGFDNFEAFLKGAEAVDKHFVETPLEDNIPLLGGLLSVWYNNFFGAQTHLVAPFDQYLHRFPAYLQQLSMESNGKSVTRGNVFSTYSTGSILFGEPATNAQHSFFQLVHQGTKLIPSDFILAAQSHNPIENNLHQKMLASNFFAQAEALMVGKDEAQVKSEGATGGLVPHKIFSGNRPTTSILAQKITPAALGSLIAYYEHVTFTEGAIWNINSFDQWGVELGKVLAKVIGKELDNTEKITAHDASTNGLINQFKEWL

SEQ ID NO: 23249 - protein, 480 aa, Campylobacter jejuni RM1221
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVENIDDQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGTDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQITYYLQ

SEQ ID NO: 23250 - protein, 471 aa, Bradyrhizobium japonicum USDA 110
MRSAVRSTVGRASKDERPRCSRSRRPSRLTIRRDAPHGSRLKVTDHVMNGTEQEEGQPMHDNDNLTIERPTFVTHLECAMEGDHYAADQVHNLSKAGKPLLVRYDLAGVRKALTKDALKERPADMWRYRELLPVRKCKDIVSLGEVTTPLIRLPKLGKKLGGGEIIVKDEGRLPTGSFKARGLVMAVSMGKALGIKHMAMPTNGNAGAALAAYATSCGIKTTIFCPADTPEVNVSEIELQGATVYRVNGYIDDCGKIVGEGNAKVGWFDTSTLKEPYRIEGKKTMGLELAEQLGWDVPDVIFYPTGGGTGLIGMWKAFDELEKIGFIGSKRPRMVAVQASGCAPMVRAFDAGTEHATRWEDAHTIASGIRVPQAIGDFLILRAVRESKGFAIAVDDDKISAALNEVAREEGLLLCPEGAATYAAYKESLADGRVSKTDRVMLFNCATGLKYPLPPVTRTLDRHKPIDFSQF

SEQ ID NO: 23251 - protein, 199 aa, Trifolium subterraneum
GLAFMAAAKGYKLIITMPASMSLERRIILLAFGAELVLTDPAKGMKGAVQKAEEILAKTPNAYILQQFENPANPKVHYETTGPEIWKGTDGKVDAFVSGIGTGGTITGAGKYLKEQNSNIKLIGVEPVESPVLSGGKPGPHKIQGIGAGFVPGVLEVNLIDEVVQISSDEAIETAKLLALKEGLFVGISSGAAAAAIQI

SEQ ID NO: 23252 - protein, 473 aa, Bradyrhizobium japonicum USDA 110
MADTSFDIIIIGSGPGGYVTAIRAAQLGFKVAIVEKSYLGGICLNWGCIPTKALLRSAEIYHYMQHAKDYGLSAEKVSFDPKAVVQRSRGVSKRLNDGVGFLMKKNKVTVIWGAASIDAPGKVTVKKSDVEAPKGALGEGTYQAKHIIVATGARPRVLPGLEPDKKLIWTYFEAMVPERMPKSLLVVGSGAIGIEFASFFHTMGSDVTVVEVLPQILPVEDAEIAGLARKRFEKQGIKILSSTKVTKLEKKADSVVATIDDGKGKPVTTEFERVISAVGVVGNIESLGLEKLGVKTDRGCIVIDGYGKTNVPGIYAIGDVAGPPMLAHKAEHEGVICVEAIKGLHPHPMDKNLIPGCTYCQPQVASVGLTEAKAKENGREIRVGRFPFVGNGKAIALGEDQGLVKVIFDKKTGQLLGAHMVGAEVTELIQGYVVAMNLETTEEELMHTVFPHPTLSEMMKEAVLDAYGRVLNI

SEQ ID NO: 23253 - protein, 315 aa, Blastopirellula marina DSM 3645
MARKVIIDCDPGIDDAVALMVALFDAELDVVAVTSTAGNVPADQAGRNLQGLIERLDPPRRPRIGVGSGPSSAPPVDGTELNGSDGLANLQLVVSSLHQRHPAEKLICDEIRAAPEEVTIVALGPMTNIARALQRDPTIASQIGRIVIMGGAINCVGSVTPAAEFNCHFDAMAARTVFKSRTTKTLIPLDVTRQAAFGLDLLDQLPNLESSPASQLLHQLLPFVYRSHRQVLGIEGIFLHDAIALAAVLHPEMFEMEEMAGDVETSGEITLGATIFDRREHRSWATNMEVATKINVPQVQDCLVQGLRAAIRGAR

SEQ ID NO: 23254 - protein, 274 aa, delta proteobacterium MLMS-1
MSKEAYKLAFIGGGQMAGALLKGILAADLYRAGEIVVAEPEAARRELLAREFGVAVVAGAADFPAACPVVVLAVKPQVLGKVLESYRGRLAGERLLISIAAGISLAFIEECLAPEPVRVIRVMPNTPALVQAGASALAPGSRADADDLEVGRRLFAAVGSVVILEERQLDAVTGLSGSGPAYVFTFFEALVEAGVKVGLSREVATELARQTISGSMQLAAADQQQNPAALRAMVTSPGGTTIAGLHVLERGGFRGLLMDAVETATRRSVELGRG

SEQ ID NO: 23255 - protein, 310 aa, Exiguobacterium sibiricum 255-15
MNVTQQQLEELIAECRPYTVLGQVASYIPELAKSEPTQLGIAVCNADGSFVSAGDAETMFTLQSVSKIITLAFVLETFGEDYVFSKVGMEPTGDAFNSIAKLEETIPTKPLNPMINAGALAVTSMLPGEDAADKLNRLRQFIADLLDIELDMVKYDAEVAKSEFETTDLNRALLYFMRYHGVIEGNVEEIIDVYTKQCAILTNCKGLAMMGKILSQSGKTPSGNQVISRRNARIIRAIMTTCGMYDASGEFSVQVGLPGKSGVSGAIVACGRSDFDMADLGIGIFGPALDLKGNSIAGTKMLELLVQRHP

SEQ ID NO: 23256 - protein, 237 aa, Lolium perenne
MCPIKEEMGGESGSPCSGDYYSPSTSSELQQVHSQNQTPWTKRPAGRTKFRETRHPVYRGVRRRGNAGRWVCEVRVPGRRGSRLWVGTFDTAEIAARAHDAAMLALAAGDSCLNFADSAELLAVSASSYRSLDEVRHAVTEAVDEFERHHALGEEDALSGTSASTPSSSSSVTDDETSSSWAADSPFELEVMGDMGWDLYYSSLAQGMLMAPPTAAAALGDYGEANLADVALWSYQS

SEQ ID NO: 23257 - protein, 114 aa, Oryza sativa Japonica Group
MASQEKPTPPPPPPPHPPAPEAVPRVRRFGGGPPGGGGGGGYPNPPDAAIPDAATLREQWRFAVRQYSRWYSHAWGTAILAGAAFFGLGWLVKGSNPLPSRAEHHASNAKEEEG

SEQ ID NO: 23258 - protein, 81 aa, Triticum aestivum
  misc_feature (58)..(58): Xaa can be any naturally occurring amino acid
MAEESGRPLPKFGEWDVNDPASADGFTVIFNKARDEKKGGNGQDTDSPSKDPRTERVXESYAAKPSTKKWFCCVTASPTQS

SEQ ID NO: 23259 - protein, 214 aa, Listeria innocua Clip11262
MTFVAPSLLAADYMNMANSIKEAEQAGADYLHIDVMDGHFVPNLTFGIDMVEQIGKTATIPLDVHLMLSNPENYIEKFAAAGAHIISVHIEAAPHIHRVIQQIKAAGCKAGVVLNPGTPASVLDAILGDVDLVLQMTVNPGFGGQSFIDSTIENMRYLDNWRQENNGSYVIEVDGGVNAETAEKCKQAGVDVLVAGSYFFGADDKVACVQGLKK

SEQ ID NO: 23260 - protein, 243 aa, Prochlorococcus marinus str. MIT 9211
MSKTVIAGNWKMHMTCAQARDFISAYLPLIKNVPKGRELVLAPPFTAISTLSEILKGSNVSLSSQNVHWEDNGAFTAEISPKMLLEHSVSYAIVGHSEPRKYFSESDKQINLRAKSAQANGLIPIVCVGETIEQRERGEAERVIRRQVEQGLEETDKKKLIVAYEPIWAIGTGKTCEANEANRICGLIRQWANCPEILIQYGGSVKPGNIDEIMAMSDIDGVLVGGASLDPESFARISNYKVE

SEQ ID NO: 23261 - protein, 256 aa, Vibrio fischeri ES114
MRHPVVMGNWKLNGSKEMVVELLNGLNAELEGVTGVDVAVAPPALFVDLAERTLTEAGSAIILGAQNTDLNNSGAFTGDMSPAMLKEFGATHIIIGHSERREYHNESDEFVAKKFAFLKENGLTPVLCIGESEAQNEAGETVAVCARQIDAVINTQGVDALNGAIIAYEPIWAIGTGKAATAEDAQRIHAQIRAHIAEKSEEVAKNVVIQYGGSVKPENAAAYFAQPDIDGALVGGAALDAKSFAAIAKAAAEAKA

SEQ ID NO: 23262 - protein, 191 aa, Mycoplasma genitalium G37
MDAHFLKSASDLKDCPQDNIPEICFMGRSNVGKSSLINAFFKKKLAKTSATPGRTQLLNYFEYKDKRFVDLPGYGFAKINKNKKDFITNLLTQFLNFRSNLVGVVLIVDSGVVTVQDQEVVKIILQTGLNFLIVANKFDKLNQSERYFSLKNIANFLKVNFDKCVFASTKTHHNLALVHKKIFELFVEDER

SEQ ID NO: 23263 - protein, 408 aa, Mycoplasma genitalium G37
MSAIKFNPSSFRKNFKWFENNKNWINFDNAATSIALDVVAEASKEYYQYFCVNPHNKNPEINQKLIAIIEETRDLLAKFFNAKKNEIIFTSSATESLNLFAFGLSSLVKSNDEIILKEDEHAANVFPWVNLAKENKAKLKIIKKTPNKSWTDAFLKACTPSTKLLVITATSNLFGNSIDYEKISKHLKKISPNSFIVVDAVQAVPHHKIDITSANIDFLTFSTHKFYGPTGLGIAFIKSELQSRLKPFKLGGDIFKSLDNNFKIIFKEGPSKFEAGTLNIMAIYALNKQLKFMQKEFNFSEMVFYSKQLKNLAYQLLSQNPNIVLANHDQDVPIFAFKHKYINSADLATFLNIKKIIVRQGSICVGKFKNKESFLRVSLLHYNTKEELLYLEKLLKTSKNSIINELIY

SEQ ID NO: 23264 - protein, 522 aa, Vitis vinifera
MNNAINFFSETKLASAKTVFSTAASLLATAMVFRSVLQDFLPYEAQQIFCSGIRRLFNRFSPQMTMVIDEFDGIAYNQIFEAAETYLGSKVCSSQRLRVSRPAKERKFNINVERDQEIVDVFRGVKFRWLLICIKTESRSIYNPRDFNSTIRSEVRSFELSFHKKHLDMVLNSYFPYILKESVSLIQEKKTLKLFTVDFEKMFGKMSDAWSSISLDHPSTFDTIAMDSELKSKILEDLKRFVRRRDYYKKVGKAWKRGYLLYGPPGTGKSSLIAAIANYLNFDIYDLELTELRCNSELRRLLLATANRSILVVEDIDCTIQLQDRSAESQVMNPRSFQFEKQVTLSGLLNFIDGLWSSCGDERIIIFTTNHKDKLDPALLRPGRMDMHIHMSYCTPYGFKILAANYLGIINHYLFSYIENLIQTTEVTPAEVAEHLLQSDEPEKALRDLIKFLEVKKEEARVQKEKEELEEEEEEEEEEEEEEEAKPEKELELQQGGSVGENDEVMMMNKRMPQLGFTLGDG

SEQ ID NO: 23265 - protein, 308 aa, Corynebacterium glutamicum ATCC 13032
MYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 23266 - protein, 395 aa, Chlamydophila caviae GPIC
MQRNNNFSKLETSYLFSSIRQKIRAFREAHPDVSIIDLSIGDTTQPLHTAVMDTFTKSVQKLGNPETYRGYGPELGLSTLREKLSEVFYQGKVSPEEIFISDGAKMDIFRLLSLFGPGKTIAVQDPSYPVYIDTALLAGAKKVIKLPCRKETDFFPVIPQGEEIDIFCLCSPNNPTGTVLTKEQLEELITYANSHGSIILFDAAYSAFISDPSLPKSIFEIPEARSCAIEINSFSKSLGFSGVRLGWNVVPKDLRYSNGLPIIDDWKRFLHTTFNGASLPVQEAAITGASLFPNLEAIAHYRHNSSLLREALQKAEFSVYGGEHAPYLWVEVPKILPDEDFFDFFLTQYHIAITPGKGFGACGKGYVRFSSLGKIEDIMAACQRLTLTSVYDRMV

SEQ ID NO: 23267 - protein, 336 aa, Salmonella enterica subsp. enterica serovar Paratyphi A str.
MKAAVVTQDHQVDVTEKTLRPLRHGEALLKMECCGVCHTDLHVKNGDFGDKTGVILGHEGIGVVAEVGPGVTSLKPGDRASVAWFYEGCGHCEYCNTGNETLCRNVKNAGYTVDGGMAEECIVVADYAVKVPEGLDSAAASSITCAGVATYKAVKISHIKPGQWIAIYGLGGLGNLALQYAKNVFNAKVIAIDVNDGQLKLAEEMGADLTINSRTEDAAKIVQEKTGGAHAAVVTAVAKAAFNSAVDAVRAGGRVVAVGLPPEAMNLDIPRLVLDGIQVVGSLVGTRQDLTEAFQFAAEGKVVPKVALRPLEDINVIFKEMEQGQIRGRMVIDFRR

SEQ ID NO: 23268 - protein, 138 aa, Shorea singkawang
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLEGEVVSNHDELMSNFFAQPDALAFGKTPEELHK

SEQ ID NO: 23269 - protein, 813 aa, Arabidopsis thaliana
MGRSRVQVNKAHKTRFSSKSSRNLHRTNLQDSGRIGKSDSNYVKGAKAARVQRGKMLREQKRAAVLKEKRASGGINSAPRVIVLFPLSASVELNSLGEDVLKLLSSDGSGIASSTVASSEYKLRATVLKAPHGDLLTCMEMAKVADLMAFVASASAPWEENSSNFIDSFGSQCLSVFRSIGLPSTTVLIRDLPSDVKKKNEMKKMCASQLASEFPEDCKFYPADTRDELHKAGMLVDDESSGKCTLLLSGYLRARKLSVNQLVHVSGVGDFQFSKIEVLKDPFPLNERKNQNSMELDDSHDEEVLKSLVPDPMKQEPLVIENTPDPLAGEQTWPTEEEMAEADKNQKQGRLKKKTLPRGTSEYQAAWIVDETDEEDSDNGDSDDNGMVLDRGEDSNQEGMYDQEFEDDGKSLNLRDIDTETQNESEMVDDEDLTEEQIKDEIKKIKEAYADDEEFPDEVETPIDVPARRRFAKYRGLKSFRTSSWDPNESLPQDYARIFAFDNVARTQKLVLKQALKMEEEDRDDCVPIGSYVRLHIKEVPLGAASKLSSLVNTTKPIIGFGLLQHESKMSVLHFSVKKYDGYEAPIKTKEELMFHVGFRQFIARFSCLRSFVIFVVGISRPVFATDNFSSDKHKMERFLHPGCFSLASIYGPISFPPLPLVVLKISEGSDPPAIAALGSLKSVEPNKIILKKIILTGYPQRVSKMKASVRYMFHNPEDVKWFKVKEKNRIDGLNNIRINFYVKLKLAQCLCVQPVEVWSKCGRRGRVKEPVGTHGAMKCIFNGVVQQHDVVCMNLYKRAYPKWPERLYPQLL

SEQ ID NO: 23270 - protein, 203 aa, Helianthus annuus
PYGFSSIEKFLTGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23271 - protein, 271 aa, Coccidioides immitis RS
MALPSDVKESYVRIIDEILAGSDLNTVSEKRIRRGLQDATGNDLTPYKAEIKELIMQRFDIFADLAESGADMTAAVATGPAVPVTSVSAGPSSRKRSPDAESPSEGTERYPPQKKRKSDLIDADAAFAAKLQAEENSRARPTRAAKKAAPSKKKKPAAKSKTSKKVKASDDSELEGSGSEKKKEVNRSGGFHKPLNLSPALSALFDGEISLSRPQSVKRIWQYIHDHGLQDPSDRRQIRCDERMRAVFKQDRVHMFTMTKILNQNLYNPDE

SEQ ID NO: 23272 - protein, 386 aa, Azoarcus sp. BH72
MKIHEYQAKEVLRKYGVVTPRGIPCFSVDEAVKAAEELGGKIWVVKAQIHAGGRGKGGGVKLGKSLDEVRTLAGQILGMQLVTHQTGPEGQKVRRLLIEEGADIKKEYYVAALTDRATQKVAMMASSEGGMDIEEVAHNTPEKIIKVFVDPLAGLTDAQAIELAKGIGVPEASIPQAVDTFKKLYTCYMETDASLAEINPLILEGNGNIKALDAKFNFDSNALFRHPEIVAYRDLDEEDADEIEASKFDLAYISLDGNIGCLVNGAGLAMATMDTIKLFGAEPANFLDVGGGATTEKVTEAFKIMLKNPKVKGILVNIFGGIMKCDTIATGVVAAAKEVNLSVPLVVRMKGTNEDLGKKILAESGLPIISADTMAEAATKIVAEVK

SEQ ID NO: 23273 - protein, 138 aa, Shorea ovalis
EKNIPVLLGLLSLWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 23274 - protein, 414 aa, Glycine max
  misc_feature (159)..(159): Xaa can be any naturally occurring amino acid
MEMDSLPNGNNTSGTPISATATANPAQPPSSNLPQLTESLKLEHQFLRVPFEYYKKTLRANHRAVEKEMSAVISGVNEAAATDLSPDDAVNHLNSLVSRLQGLKRKLEEGSRAEHLQAQKCRVRLDHLESADAENMSEWNNTRMKRILVDYMLRMSYYXTAVKLAESSNLQDLVDIDVFQEAKKVIDALQNKDVAPALAWCADNKSRLKKSKSKLEFQLRLQEFIELVRAENNLRAITYARKYLAPWGATHMKELQRVIATLAFKRDTECATYKVLFEAKQWDYLVDQFKQEFCKLYGMTLEPLLNIYLQAGLSALKTPYCYEDDCTKEDPLSQEAFRTLAMPLPYSKQHHSKLVCYITKELMDTENPPQVLPNGYVYSTKALEEMAKKNNGTIICPRTGLVCSYTELVKAYIS

SEQ ID NO: 23275 - protein, 482 aa, Escherichia coli CFT073
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 23276 - protein, 505 aa, Bradyrhizobium japonicum USDA 110
MNKVEFLSVTKVPFAERYDNFIGGKFVAPISGKYFDNASPVNGQIVCKIARSDAQDVEAALDAAHAAKAGWGSTSVAERAAILNKIADRMEENLERLAIAETWDNGKPIRETRAADIPLAIDHFRYFAGVVRAQEGSIGEIDHDTIAYHFHEPLGVVGQIIPWNFPLLMACWKLAPALAAGNCVVLKPAEQTPASIMVWAEIIGDLLPPGVLNIVNGFGLEAGKPLASSPRIAKIAFTGETSTGRLIMQYASQNLIPVTLELGGKSPNIFFKDVTAEDDDFFDKAIEGFVMFALNQGEVCTCPSRALVHADIYDRFMERALKRVAAIKQGDPRAADTMIGAQASGEQLAKILSYIDIGKQEGAKVLAGGGRAELGGDLSGGFYVQPTVFEGHNKMRIFQEEIFGPVVSVTTFKTDDEALAIANDTLYGLGAGVWSRDANRCYRFGRAIQAGRVWTNCYHAYPAHAAFGGYKQSGVGRETHKMMLDHYQQTKNLLVSYSPKKLGFF

SEQ ID NO: 23277 - protein, 428 aa, Escherichia coli CFT073
MRMSSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANVLGQKLKDGLLAIAEKHPEIGDVRGLGAMIAIELFEDGEHSKPDVKLTAEIVARARDKGLILLSCGPYYNVLRILVPLTIEDAQIRQGLEIISQCFAEAKQ

SEQ ID NO: 23278 - protein, 246 aa, Glycine max
MSAAVSSTTPHLEEELKNKATNNKKKNNVGGESDQPPYNDGANSDVAEETEPEEDDDSKLESNKDLDLGPQFTLKEQLEKDKDDESLRKWKEQLLGSVDMSVVGSECKDPEVKILSLIITSPDKPDLTLPIPFTTDPKKSLFILKEGSKCQMKFTFTVSNNIVSGLKYTNVVWKTGVRVDSRKKMLGTFSPQQEPYTFELEEETIPSGMFVRGTYAARTKFVDDDRKCYLDVSYYFEIQKNRPTPQ

SEQ ID NO: 23279 - protein, 224 aa, Listeria innocua Clip11262
MRKIAASIMCADQLHLGEELRRLESAGVELLHCDVMDGIYVNNLALGPEYLEIVRNNTEIPLDIHLATITPLKYIDMYATAKPEYISFHVEVAEDVSEVIQKIRSYNIKPSIAINPETPIEAIYPYLDEVEMVLMMTVNPGFAGQKFQTDVLPKLHDLKAKLEGKVHAPLIEVDGNINKETVGLMRDCLPDIYVLGTSALFHDRDKTSYAERLVHIWSDVEKHV

SEQ ID NO: 23280 - protein, 175 aa, Triticum aestivum
MVPTVMSSSDTSVALFQGLKSTAGLPVSRRSNGASLGSVRNGGRIRCMQVWPIEGIKKFDTLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 23281 - protein, 200 aa, Vicia sativa
GLAFMAAAKGYKLIITMPASMSLERRIILLAFGAELVLTDPAKGMKGAVQKAEEILAKTPNAYILQQFENPANPEVHYETTGPEIWKGTDGKVDAFVSGVGTGGTITGAGKYLKEQNSNLKLIGVEPVESPVLSGGKPGPHKIQGIGAGFVPGVLDVGLIDEVIQISSDEAIETAKLLALKEGLFVGISSGAAAAAAIQI

SEQ ID NO: 23282 - protein, 535 aa, Bradyrhizobium sp. ORS278
MTLHSTIDPSSADFARNAESMRALVADLKTKLAQVAEGGGEASRKRHLSRGKMLARQRVDLLLDPGTAFLELSPLAAHGLYGGDVHSASIVTGIGRIAGRECVIVANDATIKGGTYYPMTVKKHLRAQDIARQNNLPCVYMVDSGGAFLPLQDEIFPDERHFGRIFYNQAQMSAIGIPQIAVVMGSCTAGGAYVPAMSDESIIVRNQGTIFLGGPPLVKAATGEVVSAEELGGADVHSRQSGVTDHYAQNDAHAIGIARRVVGTLKPPGARTVLNMRAVREPRYAAEEIYGVVPADGRKPFDVRDIIARVVDGSEFDEFKKLYGQTLVCGFAHIFGYPVGIIANNGILFSESSLKGAHFIELCCQRNIPLVFLQNITGFMVGKKYEAGGIARDGAKLVTAVATASVPKFTVVIGGSYGAGNYGMCGRAYAPRFLWMWPNARISVMGGEQAAMVLSQVRRDGIEAKGESWPAEEEEKFRAPIREQYEAQGNPYYATARLWDDGVIDPADTRLVLGLGLSAAANAPVEPTKFGLFRM

SEQ ID NO: 23283 - protein, 343 aa, Listeria innocua Clip11262
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTICPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFIQVGLFAEKKNAIDEESIIQREIAYIGSRSQKPSSWILALDLLANGKINTDKMITKVYGLDDWREAFEAVMAGNEIKVLVKS

SEQ ID NO: 23284 - protein, 231 aa, Prochlorococcus marinus subsp. pastoris str. CCMP1986
MKQIVADSAIEEVEDGMILGLGSGSTAALMIKSLAEKIRSGKLKNIKGVPTSFQSEVLALELNIPLIDLASVPYIDLAIDGADEVDPDFQLIKGGGACHVREKLVASKANKLLIVIDESKLVQNLNQVFPLPVEVMPSAWKQVKDIISEMSGVSNLRMATKKAGPVVTDQGNLILDVLFDAGIRDPKDLEMRINNIPGVLENGLFVDLADKVLVGKIEDDVPVLFSPSRRS

SEQ ID NO: 23285 - protein, 350 aa, Listeria innocua Clip11262
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIEPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 23286 - protein, 323 aa, Vitis vinifera
MDSNTNPELSFNFPPFLRVFKDGKVERFVGTDSVPPSLNIETGVNSKDIVIDPETGVSARLYIPKINDQSQKLPLLVYFHGGAFCIETFSSPTYHNYLDSLVAEANVVAVSIEYRRAPEHPLPVAYDDCWAAVKWLVSHSNSQGPEPWLNDYADLDRLFFAGDSAGANLSHNMAIRAGTRGHELGSVKVSGIILIHPYFWGKDPVGAEVKDLQKKGLVDSLWLFVCPTTSGCDDPLINPATDPKLASLGCQRVLVFVAEKDTLRDRGWFYHETLGKSGWSGVVEVMEAEGEDHVFHLFNPTCDKAVAMLKQMAMFLNMAQCNS

SEQ ID NO: 23287 - protein, 1239 aa, Kluyveromyces lactis NRRL Y-1140
MDPQQPASDNSEWQFQVSPGAAWNLRAQARRGQTGSRDAIPLRVDELTDENELNWEALNNRNLSILGNDTLSDIFRSNQLINNGTNDNNSNNNIDGEILNTTGTDEDNRRSTDIDNNTADHFEELTRGAAREANLSRESAHVSSGLPADWFTTMNPSKLSLHQRPFLARERKSALSGIAQIEDDLRQLFENIEKEGWKLPPIEGDSEQLQEYFDKHKIDMRARQNIENFVLKMQKEALDDSSNWTEKEALLDFLLKQVQLTPEDTTALSEIVELSRYRFKFALGIIELRKNYLKESLQLGIQRLRDLNYSAFLAESNLSTEVVEHLKSTIMKQQRVILRAIEMELYSLHSYQEKYSEIIKRMARSIHDYYKRKNTNPNVPNPIYYYRDLFLKYSPWTKRGLDLALYDMHVSEEEWKFMSNHVRSQLPQMLSMVSKDNALYTRIKTPKNTFPLSDLPHEILAMVLEAKSQKANIVPLMAVSKAWAEVIAKLIYYRPHINKQQQLNSFLITMSKPKEETLFDYRSLIKRLNFSFVGDYMTDRKLEHFIGCPNLERLTLVFCKYITTKSVAKVLKGCQYLQSVDITGIHHIRDDLFEVLASDCERIQGLYVPHSNDVSPNAISNFITHAPMLKRVKITFNQSIENDLVMKMVKCCPFLVEVDLTSTPNIDNHGLVTLFTSLPQLREIRVTHNTNITDEFMLAVSQETMGLPALRLVDFSGCENITDKTIDKLVTLAPKLRNLFLGKCSRITDSALKSLARLGKNIQTMHFGHCFNISDEGVRVLVSNCPKIQYIDFACCTNLTNKTLYELAELPKLKRIGMVKCSQITDEGLLTMISIRGRNDTLERVHLSYCTSLTIYPIYELLMACPKLSHLSLTAVPSFLRPDITQFCRSPPSEFTANQRQIFCVFSGKGVHKLRHHLMGIHEPTDGPSTKSDEIFISFLKNKNAIQSDTIEDEDLERLSHNADLDSAALFAASAVFNFANEPFNQIEFAHLDHVFSSMLITSEDEHVVSSADLTALEDFDRSFYDNPLDPRFTDRYVTVAPPASSNINNELADVIRKFRKILNRVLDFEVNVASLCRIQFQYCGTLIAEMSSIYITFVDLNRYISEIYQRIKASEEPKDLLGFVLWKKWWSPCFKDLMRNFKITALVLRIYVKESLTVLTRQRELVLQRARETWDREAANDLPDGEGDIDMGVNMLLPPGGTVAEETDNNDNNIDLRLFLPPGNEQNRETPDDQIIEE

SEQ ID NO: 23288 - protein, 224 aa, Idiomarina loihiensis L2TR
MSKVLLITGASSGIGEASARKAAKEGLKLILTARRKEKLDALVKEFGADNAIGVAADAGNYDQLAEAVKQGVDKFGQLDAVFANAGTGVSTAGTEEGDPDEWKSMVDVNINGLLYTAKLTLPHLRKTTGHFLMTGSAAGRITLKGSVYGATKWFVHGFAQNLAEEMKEWNGRCTTIAPGMVNTPFFDEPKPDKLAPEDVADAVLYSINANPRNCVREVFLMPAY

SEQ ID NO: 23289 - protein, 308 aa, Vitis vinifera
MDSSDNSELTFNFPPFLRVFKDGRVERFLGNDTVPPSLNVENGVHSKDIVIEPETGISARLYIPKITYPSQKLPLLIYFHGGGFCIETSSSPTYHNYLDSLVAEGNVVAVSVNYRRAPEDPLPVAYDDCWTAFKWVVSHSNSQGLEPWLNDHADFNHLFLAGDDAGANLAHNMAIRAGTRVNELGGVKVSGIILMNDLQKKARVDTLWHFVCPTTSGCDDPLINPATDPQLRSLGCQKVLIFLAEKDMLRDRGWFYYETLGKSGWDGVVDLTEAEAEDHVFHIFKPTCEKAVAMRKRMALFLNPQNFN

SEQ ID NO: 23290 - protein, 162 aa, Zea mays
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKAL

SEQ ID NO: 23291 - protein, 143 aa, Vibrio fischeri ES114
MDLLIGMVPIVNLEWIQKFVRDTRDRGHSREAVMDSIVRSMDDYLNYITPQFSRTHINFQRVPTVDTSNPLNAKGIPSLDESFVVIRFRGLSKVDFPYLLAMIDGSFMSRHNTLVVPGGKMSFAMELIIRPLLQQLIDTGKIN

SEQ ID NO: 23292 - protein, 156 aa, Vibrio fischeri ES114
MSAKHPIIAVTGSSGAGTTTTSEAFRKMFNMMDIKASWLEGDSFHRFTRPEMDVEIRKAKEQGKHISYFGPQANDFPALEQFFRQYGEDGTGQYRRYLHTFDEAVPFNQMPGTFTPWQDLPDDTDVLFYEGLHGGVVDGDITYLNMWIYLSAWCQL

SEQ ID NO: 23293 - protein, 304 aa, Vitis vinifera
MDSTTAEVAYNFAPFLRVYTDGLVERLIGTDVVPPAMNSETGVSTKDVVIAPETGVSARLFKPNSVNPEKRLPLLVYFHGGGFSLCSPYCSIYHNYLTSLVLEADIIAVSVAYRLAPENPVPAAYEDSWAALQWVVSHCNGQGSEPWLKDHADFQRVFLAGDSAGGNISHNLAVQAGVEGLGGVKLQGICVVHPYFGRKSEDDVGKVDDNASGPVGFNDPRYNPAADERLWRLGCSKVLVCVAEKDALRERGWFYYETLGKSGWSGEVEIMETEGEGHVFHLFKPSCGRAVTLMKRIVSFINQE

SEQ ID NO: 23294 - protein, 545 aa, Bradyrhizobium sp. BTAi1
MPALAHVLLAALRDHGAREIFGIPGDFVLPLFKVIEESRILPAVTLSHEPAVGFAADAAARYHGGLGVAVVTYGAGAFNLVNSVAGAYAERSPVVVIAGAPGARERVSGFLLHHQARTVDTQLAVFKEITCDQAVLSDPATAPAQIARVLRSAKEMSLPVYLEFPRDMVDVEAEPVVPLPPRRADQDALGECVEEILGRIARAERPVIVVDVEIRRYGVEARIAALARKLGLPLVTTFMGRGLLDQADDVVAGTYLGAAGNPAITALVEDADLVLMLGVILSDTNFALSNRAPDPRRMILAASCEVQIGHHVYRDMPLGDLIDALDDRATPRAAPADRVRQRSAYPRGLVADSNPIAPSDIATAINDMFDRHGRMPMTADIGDCLFTAMEIDNTALAAPGYYAGMGFGVPAGIGVAATGLRPLILVGDGAFQMTGWELGNCRRYGLDPIVVLFNNCSWEMLRVFQPESRFNDLDDWHYADIAKSIGGVGERVTTRAELVAALERAVERRGQFSLVEVMLPRGKTSDTLARFVAGFKSARERMAGG

SEQ ID NO: 23295 - protein, 643 aa, Vibrio fischeri ES114
MITFSDIQLLRGGKPLLEQASATIHPGDKVGLVGKNGCGKSTLFALIKGELSVDAGSNRVPHNWEMAWVAQETPALERKAIDYVIDGDREFRGLEAQLAKAEEADNGTLVAELHGKLETVGGYTINSRAAELLNGLGFSQQQMEWNLTQFSGGWRMRLNLAQALICRSDLLLLDEPTNHLDLDAVMWLERWLQNYPGTLLLISHDRDFLDPVVNRIIHVENQKLNEYTGNYSSFEVQRSEKLILQQAQYQKQQKNMAHMQSYIDRFRYKASKARQAQSRIKALEKMEKVLPAQLDNPFSFNFREPDALPNPILMMDEVSAGYENNTILEQIRLNLVPGSRIGLLGRNGAGKSTLIKLLSGELAPQSGVFTYSQGVKIGYFAQHQLETLHVEETPLQHLMQIAPNHTEQQLRDYLGSFGFQGDKALEKIGPFSGGEKARLVLALVVWQKPNMLLLDEPTNHLDLDMRQALTMALQTFEGAMVIVSHDRYLLRATTDDLYLVHDRQVVPFDGDLTDYYKWLTEQNKSERKEQQQQDKQDNPSTSTSLSAAEKKEQKRKEAEFRKLIAPLRKEVTKLETRMDKLNEALSQAEEELGDVSLYEAENKKRLTEVLAIQASAKSELEEVEMEWMDLQEQIEEKENAAKQ

SEQ ID NO: 23296 - protein, 180 aa, Vibrio fischeri ES114
MAGDWLHTSSIFLAAAVVTVPLAQRFGLGAVLGYLLAGIAIGPWGLKLISDVDAILHFSEFGVVLLLFLIGLELNPSKLWKMRKPIIGLGGSQVVVSSVVITAAMMFFGLAWQVSLVIGMGLALSSTAIALRVIEERKLSDSESGQSGFAVLLFQDIAVIPMLAILPVLAGGASGNWLDG

SEQ ID NO: 23297 - protein, 351 aa, Vibrio fischeri ES114
MLAESEFRHELEVAIEPFKGLLLGLFFIAVGMSVNLGLLLQYPFEILAAVLLLVVVKGLLIYGLARAFGTRAKARSQMAMILSQGGEFAFVLFTAAQMEGLLSRELTAFLLVVVSISMMTTPLFLIAQDKWFARTLNSEEEMPLSDFTHATQPEVIIAGFGRFGQIVGRLLFANKIKLTILEADPSQIRLLRKFDYKVYYGDATQVELLRAAGAEKAKAIVVCKKDPQKVMEVVALCQRHFPHLKILARARSRVEAYELLSEGVDNFSRETFYGALDLGRQTLTSLGMHPYQAKRAESHFKKLDVAMLKELLPLHSDDKSLASKAKAARIELEEIFSLEMENERSSQNHWD

SEQ ID NO: 23298 - protein, 266 aa, Burkholderia vietnamiensis G4
MVMSAVPRTASAAAAAERAAGRSWWALLRGDARCVLERDPAARSRLEVWTIYPGLHALAAHRVAHALWRRGWRYLPRVLSFVARMVTQVDIHPGATIGPRLFIDHGSGVVIGETAEIGADCTLYHGVTLGGTSLHAGKRHPTLGERVIVGAGATILGPIAVGDGARIAANSVVIDAVPDHATVVGIPARVVAPRDRRTAHGYDLNHHLIPDPVGKALACLLDRVARLEQSSQGGPLPPRPGAPGEPCCGDGCMDAVHAPSPSRRPE

SEQ ID NO: 23299 - protein, 360 aa, Aspergillus nidulans FGSC A4
MCIYKQPEDTAANNKRRRNRMGLPTFLYNQLLITPAIPTNPFTGQTAIITGSNTGLGLETARHIARLGADKVILAVRNTAAGENAAKDIEESTICKPGTCEVWPLDLASRHSVLAFAEKAKKELGRIDVLVLNAAVATKIFQLADGGYEHSITVNTINHFLLAIALLPKLQETGTNFTNRLAPPHLTVLTSQVHAWPEFPQSTDPRGIFVALSDKATAKMDERYPVTKLLNVYLTRELVEQLYSDSDGKDGEPSVVINMLDTGFCHSQLSRENQGVDALVFNLFKRLFARKEEVGARTTVTAASAGVESHGKYMVNGIVADEALSERIYNEEGRMIQKRLWKELTDIIKGFKPQIMEEFK

SEQ ID NO: 23300 - protein, 839 aa, Arabidopsis thaliana
MPLCNNFSGNLVVAVALFFAGALYIFNYQNYVNTLRTTQYPVDELEAALYTAAAGNNKTVIITMVNKAYVKEVGRGSTMLDLFLESFWEGEGTLPLLDHLMVVAVDQTAYDRCRFKRLHCYKMETEDGVDLEGEKVFMSKDFIEMMWRRTRLILDVLRRGYNVIFTDTDVMWLRSPLSRLNMSLDMQISVDRINVGGQLINTGFYHVRSNNKTISLFQKWYDMRLNSTGMKEQDVLKNLLDSGFFNQLGLNVGFLSTTEFSGFCQDSPHMGVVTTVHANCCLHIPAKVFDLTRVLRDWKRYKASHVNSKWSPHLKSNVSMRIFRFTSISPRILPSNHYSTFPLKQNVSSLSPAKYIAGALQEHINSPAPKAGKKIHADIIKTGFQPDLNISIKLLILHLKCGCLSYARQVFDELPKPTLSAYNYMISGYLKHGLVKELLLLVQRMSYSGEKADGYTLSMVLKASNSRGSTMILPRSLCRLVHARIIKCDVELDDVLITALVDTYVKSGKLESARTVFETMKDENVVCCTSMISGYMNQGFVEDAEEIFNTTKVKDIVVYNAMVEGFSRSGETAKRSVDMYISMQRAGFHPNISTFASVIGACSVLTSHEVGQQVHAQIMKSGVYTHIKMGSSLLDMYAKCGGINDARRVFDQMQEKNVFSWTSMIDGYGKNGNPEEALELFTRMKEFRIEPNYVTFLGALSACSHSGLVDKGYEIFESMQRDYSMKPKMEHYACIVDLMGRAGDLNKAFEFARAMPERPDSDIWAALLSSCNLHGNVELASIAASELFKLNADKRPGAYLALSNVYASNDKWDNVSKIREVMKRRRISKTIGRSWTSED

SEQ ID NO: 23301 - protein, 534 aa, Vitis vinifera
MDPENVKSNLVLILDYGSQYTHLITRRIRSLSVFSLCISGTSSLKSIVDLKPRVIILSGGPHSVHSPNSPSFPDGFVDYVESNGVFVLGICYGLQLLVQRLGGIVRVGERQEYGRMEIEVVRACGLFGSKEVGHKQTVWMSHGDEAAELPEGFEVVARSQQGAVAAVENRERRFYGLQYHPEVTHSPEGMETLRYFLFDVCRVDAGWNMEDVLNEEIKLIKGMVAPDDHVICALSGGVDSTVAATLVHKAIGDRLHCVFVDNGLLRYKERERVMETFERDLHLPVTCVDATNQFLSKLKGVVDPEMKRKIIGKEFISSFDAFGQDLEHKFGKKPVYLVQGTLYPDVIESCPPPGSGRTHSHTIKSHHNVGGLPKDMKLKLIEPLKLLFKDEVRELGRILNVPRAFLQRHPFPGPGLAVRVLGDVTEGNALDILRQVDEIFIQSIKDAGIYDSIWQAFAVFLPIRSVGVQGDQRTHSHVVALRAVTSQDGMTADWYNFEHKFLDDVARKICNSVRGVNRVVQDITSKPPSTIEWE

SEQ ID NO: 23302 - protein, 203 aa, Helianthus annuus
PYGFSVIEKFLAGARSIDQHFHSAPFESNIPVLLGLLSVWNVSFLGYPARSILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23303 - protein, 444 aa, Bacillus cereus ATCC 10987
MHILVVSVNYRTAPVEFREKLTFQATELEQAMTTLQKQKSVLENVIVSTCNRTEIYAVVDQLHTGRYYIKKFLADWFQLEIEEVAPYLTIFEQDGAIDHLFRVTCGLDSMVVGETQILGQIKDSFLEAQQVKATGTIFNELFKQVITLAKRAHSETTIGESAMSVSYAAVELGKKIFGELTDCHVLILGAGKMGELALQNLYGSGARKVTVMNRTLSKAEIMAEKYMGHAKPLSELQCALLEADILISSTGASDYVITKEMMTKVEKMRSGRPLFMVDIAVPRDIDPAIDELEGSFLYDIDDLQGVVEANRAERLKEAEKIQFMIEEEIVLFKTWLSTLGVVPLISALRDKALAIQSETMESLERKIPTLSDRERKVISKHTKSIINQLLKDPILVAKEIAAEEGADEKLALFAKIFDLEMEDVESRAEEVEHKRAWTPSVPSL

SEQ ID NO: 23304 - protein, 174 aa, Burkholderia mallei ATCC 23344
MTIYKLGENAPSIHESVFVADSATIVGKVVLEENASVWFGATIRDDNEPITVGAGSNVQEGAVLHTDPGCPLTIAPNVTVGHQAMLHGCTIGEGSLIGIQAVILNRAVIGRNCLVGAGAVITEGKAFPDNSLILGAPAKVVRTLSDEDIARMHMNTKSYAMRRAYFKEQLVRIG

SEQ ID NO: 23305 - protein, 237 aa, Triticum aestivum
  misc_feature (37)..(37): Xaa can be any naturally occurring amino acid
  misc_feature (45)..(45): Xaa can be any naturally occurring amino acid
  misc_feature (76)..(76): Xaa can be any naturally occurring amino acid
  misc_feature (86)..(86): Xaa can be any naturally occurring amino acid
  misc_feature (119)..(119): Xaa can be any naturally occurring amino acid
  misc_feature (136)..(136): Xaa can be any naturally occurring amino acid
  misc_feature (187)..(187): Xaa can be any naturally occurring amino acid
PPGYDLTSRFPLLEGWQRWANMRQLLRLGSRIPLAVXIDQNAQGXARMASSARGKLCSHCEPEILVDRLHDIIRCXFVAEIVLPPXFKNLTAQHVLLEDALVNIHMVSPGCDFKKVTPXEVIPEFTCRILQRGVPXAVSAIVFLCGGQSEEEATLNLISMNKLQTKKSWNLSLSFGRSLQQSTLKTXSDKTENEEKTMAAFLVRCKSNYESSLGTYKGDANLSEGTSEIIHVKEFKY

SEQ ID NO: 23306 - protein, 180 aa, Geobacter sulfurreducens PCA
MVQSEPERAMVGEPAPAFSLEAVVNKEFKRVNLADYRGKWVVLFFYPGDFTFVCPTEIRGFNAAVDRFTELNAVVLGASVDSKFSHLAWINRGDLGDLKFPLLADNKKEATIRYGILDEKEGVALRGLFIIDPNGVLQYQVVQTPSVGRSVEETIRVLEALQTGELCPLGWKPGEKTIKK

SEQ ID NO: 23307 - protein, 269 aa, Corynebacterium glutamicum ATCC 13032
MTLSLPPIGFGTVHLDGAPGVEAIATAIDAGYRLIDTAYNYENEGTVGKAVRESGVPREELIVTSKLPGRFHARDLGRVRIEESLYRLNLDYIDLLLIHWPNPSKDLYVEAWETLIEVRDAGLVKHIGVSNFLPNHIDRLRRETGELPAVNQIELHPYFPQVEQVDFHDELGIITEAWSPLSNGRGLVEEPLLKEIGERYGVGSGEIALAWHHARGIVPIPRSTNPARQRSNLEAVKISLIDEDVQAITALARKNGRIKDQDPAVYEEF

SEQ ID NO: 23308 - protein, 186 aa, Zea mays
  misc_feature (174)..(174): Xaa can be any naturally occurring amino acid
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIXPFIAFFGALAYV

SEQ ID NO: 23309 - protein, 203 aa, Helianthus annuus
PYGFSVIEKFLAGARSIDQHFHSAPFESNISVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23310 - protein, 308 aa, Aspergillus nidulans FGSC A4
MASTAKLEISHPQQQVVKPVKKVHYPFWFGGSASCFAAAVTHPLDLVKVRLQTRGPGAPSTMLGTFGHILRNNGFFGLYNGLSAALLRQLTYSTTRFGIYEELKSRFTSPSQSPSFFTLLGMACTSGILGGIAGNPADVLNVRMQSDAALPPAQRRNYRHAFHGLVQMTRTEGFSSLFRGVWPNSTRAVLMTSSQLVSYDVFKRLCLEKFGMKDNVVTHFSASFAAGFVATTVCSPVDVIKTRVMSASPSETRGHNIVGLLREISRKEGLAWAFRGWVPSFIRLGPHTIATFIFLEEHKKLYRYLKGI

SEQ ID NO: 23311 - protein, 236 aa, Candida glabrata CBS 138
MKLNIAYPVNGTQKTVEVDDEHRVRVFYDKRIGQEIEGEAVGDEFKGYTFKITGGNDKQGFPMKQGVLLPTRVKLLLAKGHSCYRPRRSGERKRKSVRGAIVGPDLAVLSLVIVKKGEQELEGVTDATVPKRLGPKRANHIRKFFGLTKEDDVRDFVIRREVTKGEKTYTKAPKIQRLVTPQRLQRKRYQRNLKVRNAQAQREAAAEYAQLLAKRLAERKAEKAETRKRRASSLKA

SEQ ID NO: 23312 - protein, 310 aa, Pseudomonas aeruginosa UCBPP-PA14
MPFPHWSPHTPLQRLELDWLQRAGVELALLRLDQADPLISGNKGFKLAPHLALAREQGLDGLISLGGAHSNHLHALAGAGARFDFRCVGLLRGHEVDTPTVRDLRSLGMELHWLGYGGYRQRHAAGFWLPWRERYPGLLPVAEGGGGLLGARGCIGLVERIATQLPTLGWDDYDAIWVAAGTGTTLAGLVLGEAGRHPVVGALAVPEDHGVAAQVAATLAEAGWADTGYRLLDASRGGFACLDGRLARFIVEFETASGVALEPLYTGKLLLALREAVESGAVARGSRLVALHSGGLQGRRALQERLLALL

SEQ ID NO: 23313 - protein, 290 aa, Corynebacterium diphtheriae NCTC 13129
MENSSDPRTQSAATASLSEMIATITKTFIIAHVDDSDEHLAQALVYNAGRLAWRMREQGVHTDYKTSLSDVVTDADRAAEEFVSGVLTTLRPEDGIVGEEGATRNSTSGRTWVIDPVDGTYNFVNGSDFWCSALALIEGEPEDPTSVIFGAVHRPAMGYTWFGGPEIPTTCDGQPVAKLENKSTELINFATYLNPPCLQQPEIVTRWLTIAQAFLSWRMMGSGSVELANVADGTIGAYVQHSVKDWDWLPGRALVEGAGGKCIKVESGGVTWSIASNPQATDEVAAMLSR

SEQ ID NO: 23314 - protein, 639 aa, Vitis vinifera
  misc_feature (84)..(84): Xaa can be any naturally occurring amino acid
  misc_feature (576)..(576): Xaa can be any naturally occurring amino acid
  misc_feature (612)..(612): Xaa can be any naturally occurring amino acid
MKPFHFLLFFTFSSLILLPTGKSDLASERAALLVLRSAVGGRSLLWNVSQSTPCLWVGVKCQQNRVVELRLPGMGLSGQLPAGXIGNLTELHTLSLRFNALSGSVPPDLASCVNLRNLYLQGNFFSGDIPEFLFTLSNLIRLNLAGNNFSGEISSDFNKLTRLGTLYLNDNHLTGSIPKLNLNLQQFNVSNNQLDGSIPSKLSNFPATAFQGNSLCGGPLQSCPHKSKLSGGAIAGIIIGSVVAFVLILVVLILLCRKKSSKKTGSTDVAPVKHTETEMLGEKSVGDGDSTSMGYPIRGAAVLAAAATSKGSGDKRLVFFRNSNRIFDLEDLLRASAEVLGKGTFGTAYKASLDMEVERVVVAVKRLKDVSVSEKEFREKIEIAGAMDHENLVPLRAYYYSKDEKLIVYDYMPMGSLSALLHGNRGAGRTPLNWEARSGIALGAARGIAYIHSRGSASSHGNIKSSNILLTKSYEARVSDFGLAHLVGPTATPNRVAGYRAPEVTDARKVSQKADVYSFGVLLLELLTGKAPTHALLNEEGVDLPRWVQSVVREEWTAEVFDLELLRYQNVEEEMXQLLQLALDCAAQYPDKRPSMLDVTSRIEELCRSSSXHEQEPDHNIINDVHSVDSGAPVPSVVD

SEQ ID NO: 23315 - protein, 476 aa, Candida glabrata CBS 138
MIVKRLFRTMAPVAKHFDYLVIGGGSGGVASSRRAASYGAKTLLIEGKALGGTCVNVGCVPKKVMWYASDLATRLTHAHEYGLAQNVPLSKESITFNWPEFKKKRDAYIHRLNGIYENNLKKEGVEVVFGWAKFNKDGNVEVTKHDNTTEVYSADRILVATGGKPVYPEKVPGFELGTDSDGFFRLEEQPKKVVVVGAGYIGIELAGVFHGLGSDSHLVIRGKTVLRKFDEIIQNTVTDYYVEEGINVHKETNVDKVEKDEKTGKLSVHLTNGQVLEDVDELIWTMGRRSLLGIGLENVGVKLNDKEQIITDEYQNTNVPNIYSLGDVSGRVELTPVAIAAGRKLSNRLFGPEQYRNDKLDYTNVPSVVFSHPEAGSIGLTEDEAIKQYGKDNIKVYTSKFTAMYYAMLEHKSPTRYKIICEGPNEKVVGLHIVGDSSAEILQGFGVAIKMGATKADFDNCVAIHPTSAEELVTMR

SEQ ID NO: 23316 - protein, 288 aa, Leifsonia xyli subsp. xyli str. CTCB07
MPKDSTGHLIPGRVSASRPVPSHIPQPEYVGKAGPAPSDRGDVYSAEEIALIRESARIAAQAIALVGEAARPGVTTEELDAIGHQFLIEHDAYPSTLGYRGYPKSLCSSVNEVVCHGIPDDTALDDGDIVNIDITAYKNGFHGDSNQTFVVGTATEDVSLLVERTREALNRGIKAVAPGRQVNVIGRAIESYAKRFGYGVVRDFTGHGVGASFHSGLIIPHYDSAPQHDDVMEPGMVFTIEPMLTLGTHEWDMWADDWTVVTRDRSVTAQFEHTTVVTERGAEILTLP

SEQ ID NO: 23317 - protein, 460 aa, Oryza sativa Indica Group
MTRKKERSGWGSLFRGCLSGGGAAGSRKVRPGPRTAAAAAAKHGGGASSAAAQRLSFTDVMSTASEQELSVSLVGSNLHVFTVGELKAATQGFLDGNFLGEGGFGPVYKGNVADKAKPGLKAQPIAVKLWDPEGAQGHKEWLSEVIFLGQLRHPNLVKLIGYCCEDEHRLLVYEYMAKGSLENHLFKKFPSMLSWSTRLNIAVGAAKGLVFLHDAEKPVIYRDFKTSNILLDPEYKAKLSDFGLAKDGPEGDDTHVSTRVMGTHGYAAPEYILTGHLTAKSDVYSFGVVLLEILSGRRAVDKTRPSREQHLVEHMRSWLKDPQKLSRVMDPALEGQYFATAAHKAALVAYKCLSGNPKNRPDMCQVVKDLEPLLNVTDDVSDESVAPIAPVREDNAVRKERTARRRPVNQWTVLIVARDHECGGSSSSRLDPAAGEPFGQQVSACGNTSILQTCGLQVAT

SEQ ID NO: 23318 - protein, 1321 aa, Magnaporthe grisea 70-15
MVETPDEMGSLTRYVDVTSHGGSHVSLATNGSARSHRNSGGESTAAGYTNGGATPRPAQRPMGPARTPSNTYQPPRKPTAQQTPSYLHTSTSDLRNGSRMRNGYGQQEKEYVRSLRAQHYGGDYFVSYSNGSQLGASSGDGYPDSDSEGETPSSEAPYDDAYDQNVIMIDSNEDTAPSEEELKDPASRERLEWHGMLEAVLTGDVVRQEKKRLIAGTGEDLGKLQRGAELWMGIRARVCGRHLSVQRRMVEETRATLARMIDEVIDFSVKGESTAGKSAAEQIAEVLEKIDKIEGQYPTRNALLAVHTSANTERFQEACDAVYTWTNINYLINTELTILRNWVGNHELDFTRAREKSPNGHHGLSDESSFMDRLMKEEGLKSLHDHEEDEGDRKSRRNGMLHRVGKTIEKAKEALVEQHQVFKKRQMSLDMDELLMLLGFPARLIEEIIKVRLAYTKRMKESAQQNPMMQDNMIAQFQTLLKLAIRIKQEAAKLSEPQPGWELPPCIDESFDQVVLDALKYYFKMLNWKLGGNKNTFKEAELLFQEWGFANEIASHLYRGDIEVAEQFSSLTYKTLNRLAITFEKELQRRPKETPSEMSKRYKQVLESVRVRQRMLQRFSRMLNDNYENASDFSINFRPDKMQEFFLRLQETGHFQVYTGSLEHEGLLVIASPSLANRESEIQSLIGTTAYDEIVQDATNPYILIMRPEGQLGWWGPKIQLSVREEPVELKMGHLRLIAGGSQTRLSNAKQNFLATIEMHLDLLIEQRSNLPKVNARLMEIRKVQYKLSNTFMDSVEIIRNNTKGLGLQDLIQTCFIFATEFGQRSLLYLDSNRRQMNNIKLTKLALDWVGFVCDDCQSSDRKAFKWAVLALEFAMVMTRGRHILALGEAEFVKLRLKVAGCMSLLISHFDIMGARSTVAAQAEKLKLEAMVGQMRRMDHNMMDDQEAIRYVRNHRLSGLNLIDEARKEIALERSALGRVLEVSNEVDRSLAYLSSTATNFTMRWQQGHFVGGGTFGNVYAAMNLDTGHLMAVKEIRLQDPKLIPSITGAIKDEMRVLESVDHPNVVSYYGIEVHRDRVYIFMEFCSGGSLASLLEHGRIEDESVIMVYALQLLEGLAYLHEIKIAHRDIKPENILLDHNGIIKYVDFGAAKVIARQGRTLANQDLMSAATKPNKSMTGTPMYMSPEVIKGENPGHFGAVDVWSLGCVILEMATGRRPWANLDNEWAIMYNIAQGNPPQLPTPDQLSPEGIDFLKCCFARDSTKRATALELLHHKWIMTIRDRIVPQQPPTPSDTSSSSAQNTPNPASSSKGGGASSDGYY

SEQ ID NO: 23319 - protein, 552 aa, Leptospira interrogans serovar Copenhageni str. Fiocruz L1-130
MNPNMKLSKKYTFRSRKVLLIILDGVGYSPKGPESGNAIAGAKLPFLNRVWNQFPTLHIQAHGKAVGMPSDDDMGNSEVGHNVLGSGRIFDQGAKLVSNSIASGDIFNGQAWKEVIGNSKKNNSTLHLLGLFSDGNVHSHIDHTKALISQAILEKVPKIRLHILLDGRDVPEKSALDYLNPFETWLNSLRKSGTDIRIASGGGRMTITMDRYEADWSMVERGWKVHVKGEGRYFSSAKEAIETFRSENPKIIDQYLPSFVISDNGKPVGKIQDGDSVVFTNFRGDRAIEISLAFTEKNFDKFDRGPLPNVLYAGIMQYDGDLKLPERFLVAPPAIDRTLGEYMASSNIPQYALSETQKYGHVTYFWNGNKSGYFDQNSEEYREILSDVIPFDQSPEMKALLITEALEKALNENKQDFYRVNYANGDMVGHTGNYLATVQAMEFLDGCVERLWKTCEKQNIVLLVTADHGNADEMFQLDKKGNVEKDSHGNPIPKTSHTLNPVPISILDPENKIRFNSKLSNPGLANVAATILDVMGYETPEGYHPSLIQNES

SEQ ID NO: 23320 - protein, 179 aa, Triticum aestivum
  misc_feature (164)..(164): Xaa can be any naturally occurring amino acid
MAPSLETPESIDDVFANPIKQKPQLVAPEPQNCVGPDSQQAGKADSCAGCPNQAICASAPKGPDPDIPVISARLENVKHKILVLSGKGGVGKSTFTSLLAHAFATNPDSNVGIMDTDICGPSIPKMMGVEGETVHVSGTGWSPIWVMDNLAVMSIQFLLPNRGXDPVIWRGPKKNGLIK

SEQ ID NO: 23321 - protein, 118 aa, Prochlorococcus marinus subsp. pastoris str. CCMP1986
MINRFSCNYNQKVMSNIKFEKGENNNAAVLEKKTAPLKNKSPKYKVLLHNDPVNSMEYVTNALREVVPQLSEQDAISIMLEAHNTGVGLVIVCDLEPAEFYSESLKSKGISSSIEKED

SEQ ID NO: 23322 - protein, 408 aa, Prochlorococcus marinus subsp. pastoris str. CCMP1986
MVKVNENYLKLKAGYLFPEISKRVNNYTQANSSSKVIKLGIGDVTEPLPKACVKAMGEALNEMGTNNGFKGYGPEQGYGWLREKISVNDFISRGCQISSEEIFVSDGSKCDSSNILDILGSDNLIAVTDPVYPVYVDTNVMTGRTGETLQNGTYQGLVYLAINEENKFQPEIPKKKVDIVYLCFPNNPTGATITKQELKKWVDYAIENKSLILFDAAYEAFIQDKNIPHSIYEIEGAKNCAIEFRSFSKNAGFTGVRCAYTVIPKNLSGQNSKGDKIDLWSLWNRRQCTKFNGVSYIVQRGAEAVYSSQGKKEVNSLIDFYMKNAEIMQNKLRSAGFKVYGGDNAPYVWIKVPDRMTSWDFFDYLLEKADVVGTPGSGFGLAGEGYFRLSAFNSRMNVNNAMERIINI

SEQ ID NO: 23323 - protein, 456 aa, Xanthomonas campestris pv. phaseoli
MSARYDYDVVILGGGSGGLAAGFRAARHGARVAIMEPSELGGTCVNLGCVPKKAMWLAADLAGKIELASALGFDLPRPTLAWQELVTHRQGYIANIHASYRRRLNEDGVVLIPQRGVLQDRHTVMGSDGVPVTAEHIVIATGAHPLRPDVQGAEHGEVSDDFFNLCHAPEQVAIIGGGYIAVEIAGLLQALGSRVHLFVQGERLLERFDAELTLQLADNLRHLGVRLHFGFTTTALERDLHGALRVHGHSVHPREQGNDVFDKVFFAVGRRANTAGLGLDTVGVALGDKGEVVVDDGQTTNVPNIHAIGDVGGKVGLTPVAIAAGRKLMDRLFGHQPDARMDYENVPSVVFSHPPLGHVGLTEEQARARYNGAVRVYRSNFRPMLHALADAPQRSLFKLVCVGEEERVVGVHLLGESADEMLQGFAVAVKMGATKRDFEETVAIHPTSSEEIVLMH

SEQ ID NO: 23324 - protein, 87 aa, Zea mays
MGKLRGALSVLQSSTVHHEDSKMVNVIKGLLFISCDVPMAQLIVNLNASMPPSEKFIVHMLVHPRVAEMIRSKISEFRDQNIYEKPQ

SEQ ID NO: 23325 - protein, 331 aa, Mycobacterium smegmatis str. MC2 155
MQQTVRARVACLGEPLVLVSEAGDPHPAGAELNVAVGLAGLGVPASLLGRLGADEYGVLIRAALQQRGIDDSAVETDPARPTGSYSKVTGTDAAGERTTTSRYARAGSAASAMGPDFLDRDEVSAALGAAAIVHCSGITAALSDTCRALMCRLLTDRPGIPGLVSFDVNWREQLWPDADPAVVLDLADRADLVLVGADEAARVAGTGDPVALRRVLPSPATLVVKDGARRAVAVDRDGVTTEVPALRVDVVEPVGAGDAFAAGYLSGLVRGDDTATCLRRGHIGAAATLTVATDWAPPPPAGTLQRLLACSPPEWAATTVTTAGFALPEGM

SEQ ID NO: 23326 - protein, 423 aa, Solanum lycopersicum
MATPMAEDSNFEDDQLHAMSTEDIIRASRLLDNEIRIIKEELQRTNLELDSFKEKIKENQEKIKLNKQLPYLVGNIVEILEMNPEEEAEEDGANIDLDSQRKGKCVVLKTSTRQTIFLPVVGLVDPDNLKPGDLVGVNKDSYLILDTLPSEYDSRVKAMEVDEKPTEDYHDIGGLEKQIQELVEAIVLPMTHQERFQKLGVRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDDRIKVIAATNRADILDPALMRSGRLDRKIEFPHPTEEARARILQIHSRKMNVNPDVNFEELARSTDDFNGAQLKAVCVEAGMLALRRDATEVTHEDFNEGIIQVQAKKKASLNYYA

SEQ ID NO: 23327 - protein, 400 aa, Herminiimonas arsenicoxydans
MEFSQYPVNALLYITNRPELVFTEGDGMWLTDHNGKRYLDYLQGWAVNCLGHSPKCIQDALAAQSKKLINPSPAFYNEPSIALAALLTENSCFDRVFFANSGAEANESAIKLARKWGKLNQSAAGENRYEIITFDHSFHGRTLATMSASGKAGWDTIYAPQVPGFFKATLNDIASVEKLITGKTVAVMLEPVQGEAGVLPATRAFMQALRALTKKHNILLITDEVQTGMGRCGELFAYQLSGIEPDIMTLGKGIGGGVPLAAMLCREEIACFEPGDQGGTYNGNPLMAAVGLAVAQALLAPGFMQSVKDKGEYLSKALLKLTAQHGLAGERGDGLLRALKLGSDIGPQIVEKARDMGPVGLLLNSPRPDLLRFMPALNVTIEEIDQMIAMLSDVLAQLKK

SEQ ID NO: 23328 - protein, 335 aa, Idiomarina loihiensis L2TR
MKKQILVTGGCGFIGSHTVVELILSGYQVIVIDDLSNSNASVIDKIQCITGERPEFHQVDICNRDALTKLFKQYAFDAVMHFAALKNPQESYHLKEKYFLTNVEGTRRLLAVMEDCSVNHLIFSSSAVVYGNPSCVPVAESAPAGATTNPYGENKYRSECDLAEFCEKNLAFSAISLRYFNPAGAHPSGVIGEQPIKPAANLIPAIGNVITRKVDSVQVYGGDYSTCDGTAIRDYIHVCDVAKGHVAALEAGFARTGHHIFNLGTGKGESVLGVIHAFEQASGQIIPVNFSERRQGDVASCYAQADKALQELNWRAEHDLQTIARDYCHWLSLSN

SEQ ID NO: 23329 - protein, 646 aa, Leptospira interrogans serovar Copenhageni str. Fiocruz L1-130
MLQFIDIKHQYGSNVLFNGFSWHIKPGSRVCLVGPNGSGKSTLFRIAEGKFIPDEGSVAKSKNTEISVFQQIPEFNPEALVIDTALEKHKHYREYSERLKEINRKFDLVSHDSKEFTTILDEQSALEEYAFTYGVHELESKARKVLGGLGFSNVQMEMKVREFSPGYQHRLGLAITLLNPGNLLLLDEPTNHLDNTSKEWLADYLNSTGQSFVLVTHDPEFLDATCDTIAELSSSEVIEFRGTLEEYFEHKNELQEKLRAQYRKEETYLKKRMEWIERFRAKATKAKQVQSAIKKLEKRNKVEAPEESFWNSKSDYRFNFISSGKITVRIEDGAFSYSDKTPSIFSGANLEISAGDKIAVVGPNGAGKSTFLRCLLEIHKLTSGKIYYGPKTKIGYFSQNHHEELDPSKNLIQTVMSAYPDLSEQQARSLLGYFSFSDDSVYKQTSLLSGGEQSRLRLAMLVRFPANSIFLDEPTNHLDLVVRDNLLRALMEYEGSLLIISHDPEFLRSLCNRTISVDKGQIRDFNCTFEDYLKYNLQETTSSKQQIGNLVFKKEETGQTRSKRNSDKNRIKKIQKDLEQLETKIELLEKSKKNLEEVLADPDFFKNRSYQLELDNLNETKNEITRLTLEWESLQLEFEELSGTVN

SEQ ID NO: 23330 - protein, 342 aa, Herminiimonas arsenicoxydans
MTFQVTVQPSGRQFSCEADETILSAAIRAGVGLPYGCKNGACGSCRGMVLSGDVTHGAHQERALPAADEAKGFSLFCCARPHGDVVIEAREVLGLGEFPIKKLPSRIARLERVGDDVMSIALQLPASEKLQYRAGQYIEFMLKDGKRRSYSLANAPHVGEHVTLHIRHMPGGLFTDQVFSTMKERDILRFEGPLGSFFLREDSDKPMVLLASGTGFAPIKAIVEQAVHIKSERPMTLYWGGRRPKDLYMHALCEEWARTIPNFRYVPVISNATQEDQWNGQTGFVHQVVMNDLPDLSNYQVYACGAPAMVDAARTDFSASCNLPEEEFYADAFTSEADLAMG

SEQ ID NO: 23331 - protein, 304 aa, Herminiimonas arsenicoxydans
MKIKTTNKKLSCKFGKPRLLILGCGDVGMRLLPLLCTRFRIFAVTTQASRQDALRAAGAIPIIANLDQPATLARLARLAQNIIHLAPPQSDGSIDRRTRNLTSILPDHAVLVYVSTSGVYGDCGGACIDETRTVQPHNLRATRRVDAEQVLRNWARRSQSRLGILRVPGIYAGDRLPLERLQKGLPALAADEDVYTNHIHADDLAQVIALALFRAQPGRVYHAVDDSEMKMGSYFDAVADAFALERPPRLTREKLRYAVSPMMLSFMSESRRMSNQRMKAELGMRLRHPTVAHALKQAGNVPLK

SEQ ID NO: 23332 - protein, 505 aa, Vitis vinifera
MVDYSKKCQFKMDSVKRSAVTPSKSRLARTFAKVLHLRMVTGVAPVDGIQKIKAPESSKDDQDAGSWSRSQSYDDNDEKLRNTAELEAHLAQLFASISSVKSAYAQLQYAQSPYDSNGIQSADQIVVSELKNLSELKRCYLKKQFDPSPGRTLCLAEIQEQKSLLKTYEIMRKKLECQMKLKDSEITFLREKLEDCHKQNKSLEKRLNPSAHLSVLDNLHLSGISPSHFITVLQHTVKSIRSFVRLMINEMESSGWDINAAAAAIQPSVVFLKATHRCLAFESFVCREMFDSFHFPNFSLPNESLPEQNQWQRFFFERFIKLKSTRVKEYLAQKPKSTFGKFCRAKYLKLVHPKMESSFFGNLSQRSIVNSGKFPDTPFFTSFSEMAKRVWLLHCLAFSFNPEAKIFQVNKGCPFSEVYMESIIDEPSPPPDCPPETHSRVAFTVVPGFRIGKTVIQCQQAPALSSVKGRFEIRQPWVFIIECWTVCICLLTSCLCLSTQLRWTP

SEQ ID NO: 23333 - protein, 606 aa, Aspergillus nidulans FGSC A4
MPLNSKAVYSRQNPDFAPFASRRSTVHSTKGIVTCTQPLAAAAGQKILSQGGNAADAAVAVAAALNVTEPSSTGIGGDMFCLYYDAATKKIHSLNGSGRYPGAATLEKIRADLQAKPDEAGGIPMHSPLAVTVPGAAAGWVDTVEKFGSGKLSLEQILSPAIELAEEGFAVSELASYFWHESESLLRKASPNSHEMLKADPEAQDGYRSPLPGEILKNPTMAQTFRSLAANGKKGFYEGRVAQEIVNVIQSLGGYMTLDDLKAHAETGSQETEAISLKFSGQNITDKQTAGTDGETNQGVEIWEHPPNGQGIVALMALGILQELEKTGKIPSFTEKQHNSAEYLHAIIESLRIAFADASWFVTDPDTTPVPTKELLSPSYLAERAKIFNPSAASDILDHGSPAHNHCDTVYFAVTDGAGNGISFINSNYAGFGSGIIPKGCGFTLQNRGANFSLSPNHPNVLAPGKRPYHTIIPAMITNASDGSLHSVYGVMGGFMQPQGHVQVLLNMLAFGYHPQAALDAPRICIAAGNPELGKQLDRTVYVEEGISEDAVEGLRKLGHQVKVLKGWERGMFGRGQIVRCHYDGGKLVYSAGSDLRGDGMAVPIV

SEQ ID NO: 23334 - protein, 525 aa, Ralstonia solanacearum GMI1000
MPTSAAVQTDDSLASPFDWPGRPHAAPGFARLGERFLTRLPPVPMPAAPYLVGFSPEAAAPLGLSRAGLDTPAGLDVFVGNAIAAWSDPLATVYSGHQFGVWAGQLGDGRALLLAELQTADGPCEVQLKGAGLTPYSRMGDGRAVLRSSIREFLCSEAMAGLGIPTTRALCVIGADAPVRRETIETAAVVTRLAPSFVRFGHFEHFAANEKLPELRALADFVIDRFYPACRAEPQPYLALLREVGRRTAALIAQWQAVGFCHGVMNTDNMSILGLTLDYGPFGFLDGFDANHICNHSDTGGRYAYAQQPQIAYWNLFCLAQALLPLCGSDPTAFTDLSDEAQAQPAIDAAQEALLVYRDTYGEAFYARYRAKLGLTQAHDGDEALFGDLFKLLHTQRADYTLFFRHLADVRRDDTPAQAQARTVRDVFFDRDSADAWLAAYRQRLQTEPAPDAARAEAMRRVNPKYVLRNHLAEIAIRRAGEKDFSEVENLRAVLARPFDDHPGFEHYAGPAPDWAASLEVSCSS

SEQ ID NO: 23335 - protein, 301 aa, Oryza sativa
MRRVQLRTHTHARNEIALIPRHTHTRTLGMRLHSYHDTRTHCTGNVQSTTHAHTCPVPLNVHACIPPGKRRKTPVRHSVTNWSSSSSSSSSSSPARSPTAAATPDRRRSPGSPARAGECRDKGGVVEYRVKEREISPRLVVSSAPRAAAKTSRGGGAAIEQSRGGEGILGGVTGGNARPKRYATSQIKAEPELLRREVPLTSGKTKKAPKITFKNEPRHSAPQSDWGTPDSVPEFGPADEYRALRKKYLLLEDENGELDKQLSQAEEEASVLEDEKFALLDQLVVLEGLVDPSQMQPPRRL

SEQ ID NO: 23336 - protein, 424 aa, Striga hermonthica
LSTDMIEEWIDKNPKASITTREGVHAFRNIALYQDYHGLPEFRNGVAKFMSKARGGRVSFDPDRIVMGGGATGASELLMFCLADSGDGFLVPSPYYPGFDRDLRWRTGVQLLPVMCQSSNNFKITKEALEEAFDQAQKANIKVKGLMIANPSNPLGTTLDRPTLKSLVTFINERQIHLVCDEIYAATAFRAPEFISISEVIEEVECNRDLIHIVYSLSKDMGLPGFRVGIMYSYNDVVVDRGRKMSSFGLVSSQTQHLLATMLSDEEFTDKFMLENTRRLANRHEMFTKGLEEVGITCLESNAGLFCWMDLRHLLKEPTFEGEMGLWRVIITEVKLNVSPGMPFHCHEPGWFRVCFANMDDETLKVALTRIRVFVAKGSEVDAKVKKPWQMNLRLSFSSRIYDETMASSPRVMSPHSPLVRAWT

SEQ ID NO: 23337 - protein, 211 aa, Corynebacterium glutamicum ATCC 13032
MPGRERRDGGRSADDNKQNDRNERRGGGRRDDRRNQQQDERSQYIERVVTINRVSKVVKGGRRFSFTALVIVGDGKGMVGVGYGKAKEVPAAIQKGAEEARKNFFRVPMVNGTITHPVQGEKAAGIVMLKPAAPGTGVIAGGAARPVLECAGIQDILSKSLGSDNAINVVHATVDGLKQLVRPEEVAARRGKTIEEVAPARILRARAGQEA

SEQ ID NO: 23338 - protein, 281 aa, Prochlorococcus marinus subsp. pastoris str. CCMP1986
MSKQVAYLGPKGTYAEKAAHILSKLANFKSPLFVPCNGLYSVIKSIAYNNCDAAIVPIENSVEGGVTTTLDALWKFSDININKAIVLPINHALISDGKISEISEVLSHPQALAQCSEWLSENLPEAITLATKSTSEAVNMVKGSSFRAAIGSKSLIEIEGLQELAFPINDVPGNCTRFVLLSKEYIVDKANIASFAFSLLSNNPGALLEALNYIAEFGFNMSKIESRPSKRELGEYIIYVDVEINTKTNIEAFNKLKKKIQPLCKHLIDFGCYLSEKINLD

SEQ ID NO: 23339 - protein, 485 aa, Solanum lycopersicum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEQKQQWKKNNLRLSFSKRMYDESVLSPLSSPIPPSPLVR

SEQ ID NO: 23340 - protein, 405 aa, Azoarcus sp. BH72
MTGDRHGCENAALVRRREAAMPHFPAPVVSRLPQVGTTIFTVMSRLAQECGAINLSQGFPDFNADDALFERVAHWMRTGHNQYAPMAGVPALREAVAGKVAALYGSTYDVEHEVTITAGATQALFTAVAALVHPGDEVIVFEPVYDSYGPAVELAGGRVVRMQLAAPDYRPDWAAVAAAITPRTRMIMINSPHNPTATVWTAADYDRLAALLRDTGIIVVSDEVYEHIVFDGLQHRSCAAHPELAARSIVVSSFGKTYHITGWKVGYVVAPRELMAEFRKVHQFNVFTVNTPVQYALADYMAEASRHLGLAAFYQAKRNLFRDALAGSRFELLPSRGTYFQLARYSAISDEGDVAFCNRLARQVGVAAIPVSAFFADGRDERVIRFCFAKNDTTLNAACERLRAL

SEQ ID NO: 23341 - protein, 502 aa, Bordetella parapertussis 12822
MSTDYLKRILTSKVYDVAVESPLERAPLLSQRIANNVLLKREDTQAVFSFKLRGAYNKMANLTPAARSRGVIAASAGNHAQGVALAATRLGCRAVIVMPTTSPQVKVDAVRRLGGEVVLAGDSFTDAYEHAQQLEKSEKLTFVHPFDDPDVIAGQGTIGMEILRQHPGEIEATFVAIGGGGLIAGVAAYIKQLRPEIKIIGVQTEDSDAMVRSVRAGRRVQLSDVGLFSDGTAVKLVGAETFRLARQYVDDFVVVNTDAICAAIKDVFQDTRSVLEPAGAMAVAGAKQYAAEHKLKGKTLVAVACGANMNFDRLRFVAERAEVGEMREAVFAVTMPEQRGSFRRFCELVGNRSVTEFNYRISDAERAHVFVGVQVSTPAEPEKIAANFRRHGFDTLDLTHDELAKTHLRHMVGGHSALARNELLYRFEFPERPGALMRFLNAMNPDWNISLFHYRNQGADYGNILIGIQVPPTDKKLFKTFVAELGYPHWNETDNPAYRLFL

SEQ ID NO: 23342 - protein, 369 aa, Magnaporthe grisea 70-15
MSRAGGVSGGEEGARYGPSIMPGGSEAAWPHIKDIFQSISAKSDGEACCEWVGDEGAGHYVKMVHNGIEYGDMQLICEAYDIMKRGLGMSNKEIGDVFTQWNKGVLDSFLIEITRDIMYFNDEDGLPLVEKILDKAGQKGTGKWTTINALDLGMPVTLIGEAVFGRCLSGIKEQRVRASQKLEYIGRTSSFEGNKEQFIKDLEQALYASKIISYAQGFMLMQEAAKEYGWKLNKPSIALMWRGGCIIRSVFLKDITSAYRKNPDLENLLFDDFFNKAINNAQPGWREVVGRAAFLGIPTPAFSTALSWFDGYRTKDLPANLLQAQRDYFGAHTFRIKPEFANAKYPEGQDIHVNWTGRGGNVSASTYQA

SEQ ID NO: 23343 - protein, 470 aa, Leifsonia xyli subsp. xyli str. CTCB07
MSESVSLPALGESVTEGTVTRWLKNVGDHVDVDEPLLEVSTDKVDTEIPSPVSGVIEAILVQEDKTVEVGTALVTIGDGSGAGEPPAAPAAETTAPAAEAAPASPGPAAQETAAAAAVLSAPTVDATPAPAQQATVAPAVAAPTVEAALAPAQQAAPAAAPAPAPGGAHTGNVGYVTPIVRMLANQQGVDLSAVTGTGVGGRIRKEDILSAAAPAATGLAAAAVPAPAAEVSPLRGTTQPMSRLRKVVAERAVVSMQSTAQLTSVVEVDVTKVAALRDRVKSDFLAKTGVKLSFLPFFALAAAEALKTYPVINATVDGDNIVYPNQENMSIAVDTERGLLTPVVRNASELDLAGLAKEISDLAERTRDNRLKPDELAGGTFTLTNTGSRGALFDTPVVFLPQVAILGTGIVTKKPVVVSADGTDSIAIRSTIYLALSYDHRIVDGADAARFLVAVKNRLEGADFERSLGL

SEQ ID NO: 23344 - protein, 123 aa, Brassica napus
  misc_feature (101)..(101): Xaa can be any naturally occurring amino acid
PRVRFLQLIHPKMEEALFGHLHLRNQVSAGEFPETSLCSGFLEMAKRVWLLHCLAFSFEREAEIFRVPKGCRFSEVYMRSVAEEGLEEAEPRVAFTVVPGXFKIGKTSIQCEVYLSDGGGPQG

SEQ ID NO: 23345 - protein, 457 aa, Leifsonia xyli subsp. xyli str. CTCB07
MSEQNFDIVVLGGGSGGYAAALRAVELGFTVGMIEKDKVGGTCLHRGCVPTKALLHAAEVADYSRESGKYGIVTQMQGVDINGVTEYRQGIVTKKYKGLQGLVKARGITVIEGEGRLVSPTTVQVGEDTIVGKNIILATGSFSRSLPGLEIGGRVITSEQALELDFVPQKVAVLGGGVIGVEFASVWKSFGADVTVIEALPHLVPNEDESISKSLERAFRRRGIDYRLGVRFAGVSQHENGVVVSLEDGSTVEEELLLVAVGRGPLTQGLGFEEAGITLDRGFVITDERLRTSVPGVYAVGDIVPGLQLAHRGFQQGIFVAEEIAGLNPVVIPDVNIPKVTYCDPEVASIGLTEIKAVEQYGADRVTSYDYSLAGNAKSEIIGTNGSVKVVRVNDGPVVGVHMIGARVGELIGEAQLAVNWEAYPEDIAPLIHAHPTQNESLGEAFLYLSGKPLHTL

SEQ ID NO: 23346 - protein, 470 aa, Lactobacillus plantarum WCFS1
MAYQTINPYTNEVVKTYDNATTDQIEQALTTGDALYHQWRHEPVSSRAASLHKIAALLREHKDELAKIATIDMGKLLSESQGEVELCAMIADYYADHGAELLAPTPISTQATGDAEIEKQATGVLMLVEPWNFPYYQIMRVFAPNYMVGNPMILKHASNTPGSAAAFAKIVEEAGAPAGSLTNLFLNYDQVSDIIADPRIQGVALTGSKRGGQAVAKAAGANLKKSSMELGGSDAFVVLADADIDEAVNLAWRVRLYNAGQVCTSSKRFIVAADVYDDFLAKLKERFAKLVPGDPMDPQTTLAPMNSKRAKEKLQDQVDRAIAGGATVAYGNEPIDLPGQFFQPTILTDIDQDNPLFYEEMFGPVAQVFKVDSEQAAIDLANNSELGLGGIVFAGTAAHGKAVAQQIETGMVFVNTFLSSLPELPFGGVKGSGYGRELSSLGLMAFVNEKLVVTAQKPDYDNGAGGLVVL

SEQ ID NO: 23347 - protein, 248 aa, Desulfitobacterium hafniense DCB-2
MIELKNPSQIAVMRKAGKIVADTLQLMRENVRPGITTGELDGIAEEYIRKCGAVPAFKGYNGFPSSLCTSVNEQVVHGFPGLRTLKSGDIISIDCGAVFDGYVGDAAITLPVGEISEELQLLLRVTEESLMMGIPQAIKGNRLQDISHAVQTHVEAHGLSVVRDYVGHGIGRAMHEDPQIPNYGKPGRGPRLEIGMVLAIEPMVNLGTYEVKVLSDHWTVVTKDGKASAHFEHTVAITENGPEILTRS

SEQ ID NO: 23348 - protein, 479 aa, Exiguobacterium sibiricum 255-15
MNGKFLINGQWLDQGRERTDVKNPATGEVVGSVPNGTKSDVNDAVEAAHNAFPDWSKRTVYERAALLEKLYAKMLEKKDELARLMTLEMGKPLAESEGEVEYAANFVKWFAEEGKRAYGRIIPSHDATKRLHVIKQPVGVVAAITPWNFPAAMITRKLAPALVAGCTFVLKPPTATPLTALRLLELCQEVGIPDGVVNAVTGSGKDLGESLATHPHVAKITFTGSTEVGRTLMAQGAETIKAMSLELGGHAPILVFDDCDLDLAVRETIKSKFRNGGQTCVCGNRIYVSDSIYDEFVEKLGQETAKLKTGNGLDQETKIGPMINKAGYDKVKKHVDDATSAGARIVTGGSGQTDDDNDVYYYEATVLADVTPQMLIMNEETFGPVAPVQRVSSDEEAVHYANQTPFGLASYVFTNNYARAFKAIEHLDYGIVGWNDGVPSAAQAPFGGMKQSGVGREGGSEGLEAYLETKYVSIGGLDQ

SEQ ID NO: 23349 - protein, 501 aa, Oryza sativa Japonica Group
MAAAAAVWFSAIAAVLLAASTIAVVVVAKMTGKRNGGAAAAAAAAAEAELPLPPVVSGVSLIIPVITRGPMAVADELYVKLGSVFTVSFLGVVKATFLVGPEVQGGFYSRPESEVHQGGTYRMTVPMFGRGVMYDVDVATRSEQIAVCFEALRPTKLRSSTVTMVRETEEYFAKWGEQGTVDLKRELDLLILTIASRVLLGKEVRETMFADVVASFHELMDNSMHLISLCFPNLPIPRHRRRDTASARLKELFSRAIQLRRGSGRAEDDVLQRFLESRYRDGRAMSDNEITGMLIALVVAGQHMSSSASTWTGAFLLRDPKHLAAAVDEQRRLIGDDRVDYDALTTGMSTLHRCIKEALRMHPPAPALVRTVRRGFAVWTREGKEYRMPAGHSVVSYAAFNHRLGYVYRDPDEYDPERFGPERKEDRVAGKFSFTAFGGGRHACLGEHYAFLKMKVIWSYLLRNFELELVSPFPEVELNNIMLGPRGEVMVRYKRRKLTST

SEQ ID NO: 23350 - protein, 198 aa, Arabidopsis thaliana
MAGGLGKCSKIRHIVRLRQMLRRWRDQARMSSSFSRCVPSDVPSGHVAVYVGSSCRRFVVRATYLNHPVLRNLLVQAEEEFGFVNQGPLVIPCEESVFEESIRFISRSDSTRSRRFTCPDDFQKNCHVVGIRSKLDLWIESRPLLHGVTEKAVCLRAENVIGDNFAAEFDSDSFFLYFFIGEAASFIGGGSEMAVKGG

SEQ ID NO: 23351 - protein, 539 aa, Coprinopsis cinerea
MFKNLLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGQLTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVVRRAEPTGFSAKFRREGL

SEQ ID NO: 23352 - protein, 448 aa, Roseovarius nubinhibens ISM
MRVLGPVHVWALGVGIVLVGEFMGWNFSVGKGGAMGALIACWVIGLLYTCVAMIDSEVTSTVAAAGGQYAQAKHIMGPLMAFNVGLYLVMAYTMLEAADALIVGDLLTILAEQTGYDALDPKPFVILIISMLAFLNYRGVFMTLTLNFIITAAAFVTIVILFVGVQPWTAGAVLKHSDLLTDLPYGWIGVIAAFQFGIWYYLGIEGTCQAAEEVRSPSRSLPLGTMTGIMTLLIAATLTWYVCSGLLPWEYLGQATVPLYDAARMTGSTTLQVFLFVGTLFAATASANGCINDASRAWFSMGRDRYMPHWFGAVHPRYRTPYRSILFLIPIAVSFAFTGLLDQVITFSILSGLLGYTFMPINMIMFRRKWPLGSIRRGYVHPFHPIPAIVLMLLCITTFFATYLGFGTQLLAMMLFYVVVSLWFSMHRYKYVRRADQFTMNWPKPQGY

SEQ ID NO: 23353 - protein, 226 aa, Triticum aestivum
MGKEVDVGALEAGGARDYSDPPPAPLVDVDELGKWSLYRAVIAEFVATLLFLYITVSTVIGVSLVRALLYMAAQCLGAVCGVGLVKGFQSGLYARHGGGANEVGAGYSVGAGLAAEIVGTFVLVYTVFSATDSKRNARDSHVPVLAPLPIGFAVFMVHLATIPITGTGINPARSLGAAVIYNGDKAWSDQWIFWVGPFIGAAIAALYHQTILRASARGYGSFRSNA

SEQ ID NO: 23354 - protein, 517 aa, Coprinopsis cinerea
MLLLATALATSLLPFVLGAIGPSTNLVVANKVIAPDGFSRSAVLAGATQPTVQFPGPVIQGNKNSFFAINVIDALTDPTMLRTTSIHWHGMFQRGTAWADGPAGVTQCPISPGHSFLYKFQALNQAGTFWYHSHHESQYCDGLRGAMVVYDPVDPHRNLYDIDNEATIITLADWYHVPAPSAGLVPTPDSTLINGKGRYAGGPTVPLAVISVTRNRRYRFRLVSLSCDPNYVFSIDGHTMTVIEVDGVNVQPLVVDSIQIFAGQRYSFVLNANRPVGNYWVRANPNIGTTGFVGGVNSAILRYVGASNTDPTTTQTPFSNPLLETNLHPLTNPAAPGLPTPGGVDVAINLNTVFDFSSLTFSVNGATFHQPPVPVLLQIMSGAQTAQQLLPSGSVYVLPRNKVIELSMPGGSTGSPHPFHLHGHEFAVVRSAGSSTYNFANPVRRDVVSAGVAGDNVTIRFRTDNPGPWILHCHIDWHLVLGLAVVFAEDAPTVATMDPPPAWDQLCPIYDALPPNT

SEQ ID NO: 23355 - protein, 509 aa, Ralstonia solanacearum GMI1000
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 23356 - protein, 446 aa, Nicotiana tabacum
MASRNVLQQQNIGEAVPGALKQKNMAAAAQGRNRKALGDIGNNMVTVRGVEGKPLPQRPITRGFCAQLLANAQAAAENQKKSMVVNGDAPIVAKGVLPVKGAAKKPVQKKAAVKPKPDVIEISPDTEEQVKENKQKKKAGDDSSVKKATLTSTLTARSKAACGLSHKPKVQIVDIDAADVNNELAVVEYVEDIYNFYKIAENESRIHDYMDSQPEITARMRAILIDWLIEVHHKFELSQETLYLTINIVDRYLAVTTTSRRELQLVGMSAMLIASKYEEIWAPEVNDFVCISDKAYSHEQVLGMEKRILGQLEWYLTVPTPYVFLVRYIKAAVSNAQMENMVYFLAELGLMNYATNIYCPSMIAASAVYVAQHTLNCTPFWNDTLKLHTGFSESQLLGCAKLLVSYHMEAPEHKLKVIYKKYSKPERGAVALQPPAKSLLAASSYE

SEQ ID NO: 23357 - protein, 512 aa, Ralstonia solanacearum GMI1000
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 23358 - protein, 706 aa, Ralstonia solanacearum GMI1000
MPFAVPRTTKGTSMTAEYKVQDGVAVITLSNPPVNGLGHATRLGIVEGMVRAGDDPDVKAIVITGAGKAFSGGADIREFNTPKAMQEPTLHAVIQAVESSGKPVVAAIHSVAMGGGLELAMGCHYRVAAPGAQIALPEVKLGILPGAGGTQRLPRAIGLEPALNMIVSGTAVPSEQLAKSGLFDQMIEGDLMAGAIGFALKAAAEGKLPKLRDRKVEHDNPEGFLQFARNTVAAVAKNFPAPGKCVDAVQAAVEKRFDDGIRFERDLFIALVNTTESRALRHAFFGERAASKIPDVPEDTPVRKVETVAVIGAGTMGGGIAMNFLNAGIPVTILETKQEALDRGIATIRKNYESSAKKGKLTPGKVEARMALLKPTLSYDDIRDADLVIEAVFEDMGVKETVFKTLDAVAKPGAILASNTSTLDVDRIAGFTQRPQDVVGMHFFSPANVMKLLEVVRGKATAKDVLATVMKLAKAIKKTAVVSGVCDGFIGNRMIEQYSRQAGYLLDEGALPEQVDRAVETFGFAMGPFRMGDLAGNDIGWAIRKRRAVDKPDIVYSKTADLLCEKGRYGQKTGAGWYDYKAGDRKPYPSQEVNDMIIQHSKDLGITRRKISDEEIVERLVFALVNEGAKILEEGIASKASDIDMVYLTGYGFPLFRGGPMLYADTVGLYNVAQAMRRYGKGYHGEAWKPAPLLQKLADAGQGFNG

SEQ ID NO: 23359 - protein, 516 aa, Coprinopsis cinerea
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLYDVDNENTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLGSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 23360 - protein, 371 aa, Nicotiana tabacum
MANEENKAAPTNTSRASNKRAFDDTLAAASSNGNDPLLKRVVLGELTNLEYVVGSTKTNTHNSKHKIKLKKTAPTKRKKIAIQSFKSDAATNFSPNDDLQKCAYAPLIYQHLHSLEVEARRRPLSNYMEKVQNDVTPTMRMILVDWLVEVADEYKLVSDTLYLTVTFVDRFLSSHVMARNSLQLLGVSCMLVASKYEEISPPHVEDFCYITDNTYTGEEVVNMERDLLNFLNFEISNPTTKTFLRIFTKVSQDNVDFLTLHFEFLGCYLAELSLLDYSCVRFLPSAVAASAIFLSRFTLLPKVHPWNLALQHCTGYKPSELKDCVLVIHELQSGRRAASVQAVRKKYMDHKYKCVAALHPPDIPACFFDDA

SEQ ID NO: 23361 - protein, 512 aa, Chlamydia trachomatis
MLGCTLEEIKDFGPTLPACPPCIVVIFGATGDLTSRKLFPALYNLTKEGRLSENFVCVGFARRPKSHEQFLEEMKLAVQHFSHSSEIDIRVWESLENRIFYHQANFSDAEGYSALKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFSSEEIKKEKIKILKKILPIREEDAVRGQYGEGIVQDVSVLGYREEENVDPNSSVETYVALKLFIDNPRWKGVPFYLQAGKRLTKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVHPIFPNYMAGSLRPQEADELLSRDGKAWRPY

SEQ ID NO: 23362 - protein, 496 aa, Chlamydia trachomatis
MFYSLIPVSRFMIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESALLFIQVVYSPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETASGAHPVHAVKTMRSIIQETEKTFDYHAFFQLNDKNSALKVSPYLEANWVFWIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDALSPSLDEIVP

SEQ ID NO: 23363 - protein, 429 aa, Yersinia pestis CO92
MKLYNLKDHNEQVSFAQAIKQGLGKQQGLFFPLELPEFELTEIDKLLDLDFVTRSSRILSAFIGSEIAPDVLTKRVQAAFEFPAPVAQVENDIAVLELFHGPTLAFKDFGARFMAQMLAEVAGDQPVTILTATSGDTGAAVAHAFYGLKNVRVVILYPRGKISPLQEKLFCTLGGNIHTVAIDGDFDACQALVKQAFDDEELKTALSLNSANSINISRLLAQICYYFEAVAQLPQEARNQLVISVPSGNFGDLTAGLLAKSLGLPVKRFIAATNANDTVPRFLVNGQWQPKPTVATLSNAMDVSQPNNWPRVEELYRRKIWQLKDLGHGAVSDKTTKDTMRELAGLGYISEPHAAIAYRVLRDQLQDGEFGLFIGTAHPAKFKESVEAILGQELPLPKPLAVRAQLPLLSHDLPADFAQMRAFLMALPK

SEQ ID NO: 23364 - protein, 114 aa, Sinorhizobium meliloti
EKITGRVFGDTIRPLLLSVRSGARASMPGMMDTVLNLGLNDQSVHALGHDADDARFAWDSYRRFIQMYGDVVMGVDHEVFEEVLEDEKARLGHEQDTELSAVEWQHVISRYKEA

SEQ ID NO: 23365 - protein, 65 aa, Sinorhizobium meliloti
DPEVQLWGAIGAVFSSWMNPRAITYRHLHGIPAGWGTAVNVQAMVFGNLGNSSATGVAFTRNPST

SEQ ID NO: 23366 - protein, 405 aa, Chlamydia trachomatis
MSMDKLSIRDLSLEGKKVLVRVDFNVPIKDGKILDDVRIRSAMPTIHYLLKQDAAVILVSHLGRPKGGVFEEAYSLAPIVPVLEGYLGHHVPLSPDCIGEVARQAVAQLSPGRVLLLENVRFHKGEEHPDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCTSQISHVSTGGGASLEFLEKGSLPGTEILSPAQS

SEQ ID NO: 23367 - protein, 339 aa, Pseudomonas syringae pv. phaseolicola 1448A
MISEKRDTPADIEKSAFSLSRRFSVAPMMDWTDHHCRYFMRKLSKHALLYTEMVTTGALLHGDRERFLRHDETEHPLALQLGGSTAADLAACSRLAEEAGYDEVNLNVGCPSDRVQNNMIGACLMAHPELVADCVKAMRDAVGIPVTVKHRIGINGRDSYAELCDFVGNVQEAGCGSFTVHARIAILEGLSPKENRDIPPLRYDVVAQLKSDFPDLEIVLNGGIKTLEQCSEHLQTFDGVMLGREAYHNPYLLAHVDQQLFDSTALVISRYDALESMRPYIAAHIASGGNMHHVTRHMLGLGLGFPGARRFRQLLSVDIHKAENPMLLLDQAAAFLEGH

SEQ ID NO: 23368 - protein, 397 aa, uncultured delta proteobacterium
MKLAERIARIKPSETLAITAKTNALRAQGRDVIGFGAGEPDFDTPVNIKNAAIKAIEGGFTKYTPVTGTDELKDAIVAKLKQDNSLDYKRSQIVVSCGAKHTLYNLAQALFEEGDEVIIPSPYWVSYPDIVVLAGASPVYVTTDEKDGFKMKPQQLSSAISERTRAVIINSPSNPTGAAYSPDELKSLAKVLLDKDILVITDDIYEKIFYADFAFANIASAEERIKDKTIVVNGVSKTYAMTGWRIGYAACSEEIASAMNKIQSQSTSNPTSIAQKAALEAISGDQSAVPQMVNEFSKRRDFIVGALNAIDGIKCFSPEGAFYVFPNVSGVYERAFQGKKITNSAEFIDFLLDEANVAAVPGAAFGSDDHIRLSYATSMKNIEEGIRRIKNAVSKLD

SEQ ID NO: 23369 - protein, 525 aa, Campylobacter jejuni RM1221
MVEVKNLTMRFANQLLFENVNLKLVRGQRYGLIGANGAGKSTFLKILSGEIESSSGEIVFDEGLKIAVLGQDQFAFENYTIKDAVMCANKRLYEALKEKEKLYMSEEFTDEINERLGELEIITAEEDPNYDCETRCEKILSSLKIKDFDALMSTLQSADKFKVLLAQVLFLGADVLFLDEPTNNLDLEAIFWLENELLRHEGTLVVISHDRHFLNKICTRILDVDFKQIRDFAGNYDDWYMASTLLAKQAELKRDKTLKEREELENFIRRFSANASKAKQATSRAKALEKLELEEIKISSRRDPSIVFRTNREIGNEVLEFKGIGKAYDKQLFSNLELKIEKNDKIALIGANGVGKSTLAKIIANAINPDSGSIHLGATIELGYFPQDASNLICENLKLYEWLMSEKFKDLDEIRKCLGRMLFSGSDQEKMAASLSGGEKHRLMLSRLMLERPNFLLLDEPDNHLDLESIIALGEALYNFKGVVLCISHDRELVSAFANRIWHLENGKLTDFRGTYQEFLGENDG

SEQ ID NO: 23370 - protein, 595 aa, Aspergillus oryzae
MARLPSQQGRQVHATSTSYVNHAAPVEANYDTANPPYIRKYLRTYGLTPPRAESYEVQKTRCLAQLALKQTAIDKFLYLSTLRKNNVHLFYRLVTDHLRELTPLIYTPVVGEACQRWSEIYQQPEGMYLSWEDRGNLAAVIANWPQPNVEITCITDGSRILGLGDLGINGMGIPIGKLALYTACAGIRPEATLPLTLDLGTSNKTLREDPLYMGSNRDKITPEEEREFMDELMSALTERWPGIVIQFEDFKNPFPALERYRDIYTCFNDDIQGTGAVILGGVINAVKRSGLPCKDHRAVFFGAGSAGVGVAKQIVAFFMREGMTEDEARSCFYLVDTKGLVTNDRGDKLAEHKVYFAREDNEGQQYKTLEEVVDYVKPTILMGLSTIGGVFTPEILRKMADWNTAPIIFPLSNPSSKSECDFETAITHTDGRALFASGSPFQPFSFTNSAGETRTYYPGQGNNMYVFPGIGLGTILSKAVKITDSMIYASGAALSQALTAEEIERGLLYPDLTRIRQVSVVVTRKVIRAAQEDKVDRETALRSMNDDALDAWIKARMYDAHSEVLALEREVGALLHNLNPASLLNGLSSEENAKL

SEQ ID NO: 23371 - protein, 191 aa, Bordetella parapertussis 12822
MLLFPGTFTMQTDYAELVRRTIRSVPDWPTPGVTFRDITPVLQDPRTFRVLIDLFVYRYMRQRLDLVAGVDARGFIVGAVLAHELNLGFVPVRKKGKLPYRTVAEEYSLEYGNAAVEMHTDSVRTGQRVLLVDDLIATGGTMLAAIKLLQRLGANVVEAAAIIDLPYLGGSAQITATGTPLYTVCQYQEGD

SEQ ID NO: 23372 - protein, 605 aa, Dianthus caryophyllus
MDTKIGSLDTCPPQNSDICCPNKTTTTATHLHAPPTTHAPPESTLGRHLARRLVQIGVNDVFSVPGDFNLTLLDHLLAEPGLNLVGCCNELNAGYAADGYARSRGVGACVVTFTVGGLSVLNAIAGAYSENLPVICIVGGPNSNDYGTNRVLHHTIGLPDFSQEMRCFQTVTCYQAVVNNLEDAHEQIDTAISTALKESKPVYISVSCNLPAIPHPTFSREPVPFSLSPRMSNKMGLEAAVEAAAEFLNKAVKPVMVAGPKLRVAKACNAFVELVDASGYATAVMPSAKGLVPEHHSHFIGTYWGAVSTAFCAEIVESADAYIFAGPIFNDYSSVGYSLLLKKEKAILVQPDRVVIGNGPAFGCVLMKDFLTELAKKIKKNTTAFENYTRIFVPEGQPLKCEPKEPLRVNVLFQHIQKMLSSDTAVIAETGDSWFNCQKLKLPKGCGYEFQMQYGSIGWSVGATLGYAQAVPEKRVLAFIGDGSFQVTAQDVSTMLRCGQKTIIFLINNGGYTIEVEIHDGPYNVIKNWNYTALIDAIHNGEGKCWTAKVFCEEELVNAIKTATGPKADCLCFIEVIVHKDDTSKELLEWGSRVSAANSRPPNPQ

SEQ ID NO: 23373 - protein, 409 aa, Aspergillus oryzae
MPQQKKQHTVAVIGSGNWGSTIAKILAENTASHPELFTPKVQMWVFEEQIQIPSDSPHHSKYGDKPQNLTEVINAVHENVKYLPGIRLPENVVANPNLEDVVKDATILVFNLPHQFIEKTLDQIKGKHLPYARAISCVKGVDVTDGMVTLFSELIMEKLAIYCGSLSGANIAPEVAAEKFSETTIGYDTPPMDVKAEDGSPEDNKIKIDEQRQVKTRPTHTKLTRVPQELVTVDAELWRTLFGRPYFHVNVVDDVAGVALSGALKNIVALAAGFVAGKGWGENGKAAVIRVGVVEMVKFGRTWFPQSVNERTFTEESAGIADLVASCSAGRNFRSAKHAVEKGVNVDEIEKTEMNGQKLQGTSTAKSVHEFLEKHGKVQDFPLFDAVYGILEGKTSVDSLPKLLDKRFG

SEQ ID NO: 23374 - protein, 380 aa, Dianthus caryophyllus
MSSTAGQVIRCKAAVAWEAGKPLVIEEVEVAPPQKMEVRVKILFTSLCHTDVYFWEAKGQTPVFPRILGHEAGGIVESVGEGVTELQPGDHVLPVFTGECKECAHCKSEESNMCDLLRINTDRGVMLADGKSRFSINGKPIYHLVGTSTFSEYTVTHVGCLAKINPKAPLDKVCILSCGISTGFGATVNVAKPKKGQTVAIFGLGAVGLAAAEGARVSGASKIIGVDLIPARFEAAKKFGVTDFVNPKDHDKPVQEVIVEMTNGGVDRSVECTGNIQAMISAFECVHDGWGVAVLVGVPNKDDAFKTHPMNFLNERTLKGTFFGNYKPRTDIPKVVEKYMNKEMELDKFITHEISFKDINKAFEMMARGEGIRCIIRMDA

SEQ ID NO: 23375 - protein, 359 aa, Oryza sativa Japonica Group
MASVDLTPRQARKAYGGDGGTYYEWSPADLPMLELANIGGAKLSLNAGGLALPSFSDSGKVAYVLQGKGTCGIVLPEASKEKVIAVKEGDSLALPFGVVTWWHNLPESPIELVILFLGDTSKAHKAGQFTNMQLTGATGIFTGFSTEFVGRAWDLAESDAVKLVSSQPASGIVKIKSGQKLPEPSAADREGMALNCLEAPLDVDIKNGGRVVVLNTANLPMVKEVGLGADLVRIDGHSMCSPGFSCDSAYQVTYFIRGSGRVQVVGADGKRVLDTHVEGGNLFIVPRFCVVSKIADASGLQWFSIITTPNPIFSHLAGKTSVWKAISPEVLEASFNATPEMEKLFRSKRIDSEIFFAPN

SEQ ID NO: 23376 - protein, 492 aa, Campylobacter jejuni RM1221
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLQKLLAKCKRVHIIGLYSDGGVHSMDTHFKAMLEICAKNGNEVFAHAITDGRDVSPKSGLNFIKDLKGFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNAAIKAVEAVDTCLGEIIECAKKHDYAFIITSDHGNCEAMQDEKGNLLTNHTTFDVFVFVQAKGVSKIKDNMGLSNIAASVLKILDLEIPKEMNEALF

SEQ ID NO: 23377 - protein, 347 aa, Exiguobacterium sibiricum 255-15
MKAVQVNGYGGVEQLEVVERPVPTPRAGEVLVEVKACGINNTEIWMREGAYGTDDKSGWKPEGVQFPRVPGSDISGRIIEVGSGVDPSRVGQDVVLFPFTSSGADGTEHISEDMSFIGSEYDGGYAEYVVWPATLCYDMPLDDYVKSAVFSVSGLTAWHMNEQLQLQPGQTVLVTGASGGVGSLNVQIASRVFGATVIAVVGDMKIEQELKRLGAKYVVSYRSDQLTEDILAVNSGPVDAVLDVVGDALFKTALVVLKNGGKFCISGSAGGQQTNLDFRMLYLKHLTFYGSVLGTRDEFGRMLEAIADGKLEPVIDRTFPLEEAAAAQSYFKETGKLGKIVLILKAD

SEQ ID NO: 23378 - protein, 481 aa, Campylobacter jejuni subsp. jejuni NCTC 11168
MGNARGFLDFKRMDFKKIAPKERILNYKEFTIPLDKKEQEVQGGRCMDCGVAFCHTGVMSEGKDVGCPLNNLIPEWNDLVYRSLWKEAYERLDLTNPFPEFTGRVCPAPCEDSCVCAINGVSVSIKNNELSIIENAFKENLVRVNKPKQYNGKKIAVIGSGPAGLACANTLNSLGYKVSVFERSDKIGGLLMYGIPDMKLDKSIVQRRVDLLKKSGIEFKVNENIDSKDKVSKLLKEFDALVLCTGASKPIDLDIEGRKLKGVEFALDFLTQNTKTLLKTGKGADMAKGKNVLVIGSGDTSVDCIAVATRQGAKSIVRFERSPKRPLQRSQNNPWPLKADIFTTDYGLEEAIAVYGKDPREYQKMTKKFLGKTHVEGVEANDLKREFKEGKAINVEISNSKKTYKADLVLLAMGFSGCEEAISKNFGVKLDEKNNISTENFQTTHKKIFACGDARKGQSLVVWAIKDGIECALSLHQNLAK

SEQ ID NO: 23379 - protein, 384 aa, Corynebacterium efficiens YS-314
MFSWHRSPISAIIVDISHKSLKEFPMSNTTDDWAGAPQNASPDGEFVRDTNYITDRIVADVPAGSEPVAQEDGAFHWPVEAGRYRLVAARACPWAHRTVITRRLLGLEDVISLGLTGPTHDVRSWTFDLDPNGVDPVLQIPRLQEAYFNRFPDYPRGITVPAIVEESSRKVVTNDYPSITIDFNLEWKQYHREGAPELYPEHLREEMEPVMKRIFTEVNNGVYRTGFAGSQEAHNEAYERLWTALDWLEERLATRRYLMGDHITEADIRLYPTLVRFDAVYYSHFKCSRNKITEMPNLWGYLRDLFQTPGFGDTTDFTEIKQHYFITHAEINPTQIVPVGPDLSGLMSEHGREALGGSPFAEGVTLPGPIPSGEEVKNPEPFQV

SEQ ID NO: 23380 - protein, 395 aa, Bradyrhizobium sp. BTAi1
MTVRAGREFLAIPGPTTMPDEVLQAMHRPALDIYSKQMVELTDGLMADLGRLFATKGKTYIYIANGHGAWEAVLSNVLSRGDKLLVLESGRFAIGWGQAARAMGAEIEVLRGDWRRAVRPAEVEARLRADREHTIKAIVVAQIDTASGVVNDVEAIGRAIKASGHPALYMVDTVASLGCMPFEMDAWGIDVAMSGSQKGLMTPPGLGFVAANARALEVHKRANMRTPYWDWSEREGAEHYRKYGGTAPVHLLFALRQAIDMLFAEGLPHAFRRHQLLGEAVRRAVAKWGEGQVIGFNIADAAERSNTVTTVLVGGGYDPAVLQSYCKEQCGVVLGTGIGDLSGKAFRIAHMGHVNAPMVLGTLGVIEMALVALKIPHGRGGLDAAIQWLGESVSA

SEQ ID NO: 23381 - protein, 400 aa, Vitis vinifera
MVGSGGSDRSKEAVGMMALHDALRSVCLNSDWTYSVFWTIRPRPRVRGGNGCKVGDDNGSLMLMWEDGFCRGRVGECLEEIDGEDPVRKAFSKMSIQLYNYGEGLMGKVASDKCHKWVFKEPSECEPNVSNYWQSSFDALPPEWTDQFESGIQELISLRLCMLRYREDLHFVLRMRHTFESLGYQSGFYLSQLFSSTRNTSSSSSLPSKQSTIPSRPPPPIFNWGQRSLPSATSMLASPNFQNSARLGFPHTKDETHMFLLPHSSETRIEDMMADHENDIKWPNGLSFYNALTGRSDDAKLLFSPEGLGNKPDQNHHPLILEGKNPNPHSDSNPNEFLSLDSHPETVRKMENKFKRSFTLPARMASSSSSTSLDHHQHHPVEYRNSEAGMYPDVMETFLE

SEQ ID NO: 23382 - protein, 240 aa, Aspergillus nidulans FGSC A4
MRTENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 23383 - protein, 318 aa, Paracoccus denitrificans
MKPLDRIHEAAKALDRHIILPEGEDPRVAKAARRLLAGGLARVTLMGGPEIPGAGRIDPAGAPDLAELADHWHRMRAARGMTAERALTEMRDPIRQAAMRVRLGQADGTVGGAVATTADTVRAALQIIGKAPGAGIVSSFFLMLSCGPGAPVRGGMIFADCGLVIQPDARELAAIALSAADSCRRILAEEPRVALLSFSTAGSAEHPSLGRIREALALIRAAAPGLEVDGEMQFDAALDDAIRARKAPESPLTGRPNVFVFPDLAAGNIGYKIAERLAGLTAIGPILQGLAKPANDLSRACSVQDIVNATAITAMQTK

SEQ ID NO: 23384 - protein, 341 aa, Chlamydia trachomatis
MTTWDLAMRIVINGFGRIGRLVLRQILKRNSPIEVVAINDLVAGDLLTYLFKYDSTHGSFAPQATFSDGCLVMGERKIRFLAEKDVQKLPWKDLDVDVVVESTGLFVNRDDAAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSIFDAQAGVALNDRFFKLVAWYDNEIGYATRIVDLLEYVQENSK

SEQ ID NO: 23385 - protein, 161 aa, Brassica napus
MTSSSSPSRKALSKIACNRLQKELSEWQVNPPTGFKHKVTDNLQKWIIEVTGAPGTLYANETYKLQVDFPEHYPMESPQVVFVPPAPLHPHIYSNGHICLDILYDSWSPAMTVSSVCISILSMLSSSPEKQRPADNDRYVKNCKNGRSPKETRWWFHDDKA

SEQ ID NO: 23386 - protein, 810 aa, Aspergillus nidulans FGSC A4
MAPTSTVQHHHRSTTKTTHKPYKSGHASKRALKDQAKGKVERAERGTRKTPHQQLMSKLDRRNQARQKQQNKQQERAQAISIFSGQNGAPRHVAIVPLSIDIDTTAIIKALNESVDVTSDVFPDTISRVRIDRFRQNLQYIPAKYDLMSALDACRMADFVVLAISAHLEVEEQGELLLRSIEGQGVSNVIAVVQGLDKINPPKKRPQVAGSLKSFLNHFYPSIDKVLSIDSRQECSNAIRSLCTATPKGIRWRDDRSWMLIEDVKWPESASPEVDDVVLTGVVRGKGLKADRLVHVPGWGDFQIDSITAAPLPTARSKRDDAMNVDESEAPQLLDSPSADRDDLATVAPEEIEMEDDIESMPDTDRKGVLLDDHHYFSDDDDHIPAKPKRLPKGTSEYQSHWFLDDVSDSGSDVMDDDDEEDMQMDVSGAPEDGVFPDNHDAMTEGGPSEYPQSEMFLDPSPEDEAQQLEEYRASRRNEAKDDLEFPDEIELHPNVLARERLARYRGMKSLKTSPWNTAEDRPHEPEDWRRLLQFGDYKGSKNRILREALVGGVNPGTRVDVHLRAVPALLRNRPQPLSLFSLLRHEHKHTVVNINMHLNAAVEEPIKSKQELIVQYGPRRLIVNPVFSSADNTPNNVHKFDRFLHPGRSAVATWIGPLTWGSVPVLVFKSRKTSADPEILDSADAPESTTAVGFSTSTLELIGTGTVVAPDPTRVVAKRAIITGHPYKIHKRVVTVRYMFFNAEDVNWFKALQLWTRRGRSGFIKESLGTHGYFKCTFDGKINPQDSVGISLYKRVFPRKARALEEVAN

SEQ ID NO: 23387 - protein, 264 aa, Corynebacterium glutamicum ATCC 13032
MGFRSKKKVIAAKTAAELDAMQAAGEIVGKALQAVRAEAKAGMSTWDLDQIAEQVIRDAGAVPTFLGYQGFPASVCASVNEVIVHGIPSKETILEEGDLVSIDCGATFDGWVGDSAWSFGIGELDEDVQGLNLATEWVLMEGMKAMVPGNRLTDVSHALEVATRKAESKFGVALGIVDGYGGHGIGRHMHEEPYLANEGKAGKGPVIQEGSVLAIEPMLTLGTEDSAVLEDDWTVVTLDGSWASHWEHTVAATKGGPRILTPRY

SEQ ID NO: 23388 - protein, 462 aa, Mesorhizobium loti MAFF303099
MISRAEWLRTTLLATSLAFTFTGPVLADSTALPDKTPAEFKVTDFLLDNGMEVVVIPDHRAPIVTHMVWYKIGSADEPPGKSGIAHFFEHLMFKATTNHAAGEFDRAVSDIGGSNNAFTSYDYTAFHETVAPSALEQMMGFEADRMRNLILTDDVIKTERDVILEERRSRIDNNPQAVLDEEVDATLWQNQPYRIPVIGWMQEMEQLNRTDAVAFYDKYYRPNNAVLIVAGDVEPETVKALAEKTYGKVARGPDLPPRIRPVEPEQNTKRTVTLADARVSVPSFSTQWVVPSYHTAKPGEAEALDLLAEILGGGNRSRLYQALVVKQGIASNAGAYFQGTMLDDTNFTVYGAPRGDAKLADVEAAVDAEVARIASGGVTPDELEKAKDRYIRSMVFARDKQDSMAEIYGSTLATGGNVQDVQQWPDRIRKVTADEVKAVAARYLVLARSTSGYLLPQQQAGN

SEQ ID NO: 23389 - protein, 334 aa, Oryza sativa
MGGDWQELAQAAVIGLLFAFLVAKLISTVIAFKEDNLRITRSTPTSPSAADTPAAPAPPPASLDGGHGDTSDGSGSDSDWEGVESTELDEEFSAASAFVAASAASGTSVPEQAQLQLYGLYKIATEGPCTAPQPSALKLKARAKWNAWHKLGAMPTEEAMQKYITVVDELFPNWSMGSSMKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 23390 - protein, 293 aa, Brucella melitensis
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKITFEPVKGGDAETLEADAVLIATGRRPYTDGLGLQEAGVAVDER

SEQ ID NO: 23391 - protein, 411 aa, Oryza sativa
MAASDSDSDADAAASLLPAPIHLLPPDALHNVLLRLPLRDAVVCRPVSRLFHETLSHNFLALLPSLRLLLLRHPRPDGGGCLHAFDPDRRHWLRLPFSAFLPNQSFSPVASSPSLLYLWLESPSPSPPSLPSSSSSTASTAHPPKSLAVCNPFAGTYSFLPPLGSAWARHGTVLAGPGGVVLVLTELAALSYTPSGSGKWMKHPLSLPSKPRSPILASGAAAVFALCDVGTPWRSQWKLFSCPLSMLTGGWAPVERSAWGDVFEILKRPRLLAGAGGRRVLMIGGLRSSFAIDAPCSTVLILRLDLATMEWDEAGRMPPNMYRCFTGLCEAAAQGNAMPTAVAGGNNKVKVFGGDGKVWFAGKRVRGKLAMWEEDELGNSGGKWDWVDGVPGYSDGVYRGFVFDGGFTAMP

SEQ ID NO: 23392 - protein, 278 aa, Azoarcus sp. BH72
MSDSPAELLAPLDEAVAAEADGGRRFGGIARLYDDAALHRLNLAHVCVVGIGGVGSWAAEALARSGVGRLTLIDLDHVAESNINRQAHALDATLGQAKVQAMAERIRGINPRARVDTVEDFVEPDNVAALLREFNLVIDAIDNVRAKVAMAVHCRRARLPLLMAGGAGGKRDPGRIRVADLVATEQDPLLAKVRATLRRDHAFPRAAGKKFGIEVVYSSEPLRYPAASCETGRGPQGLACAGFGSSMAVTASVGLFLAARAIDRLVAKPVAAEAGANA

SEQ ID NO: 23393 - protein, 196 aa, Oryza sativa
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDINKKNENKEVAVDAFLPANTARDAIQYSMDLYAQYILQSLRQ

SEQ ID NO: 23394 - protein, 172 aa, Aspergillus fumigatus
SMSQVFFDVEYAPVGTAETKVGRIVFNLFDKDVPKTAKNFRELCKRPAGEGYRESTFHRIIPNFMIQGGDFTRGNGTGGRSIYGDKFADENFSRKHDKKGILSMANAGPNTNGSQFFITTAVTSWLDGKHVVFGEVADEKSYSVVKEIEALGSSSGSVRSNTRPKIVNCGEL

SEQ ID NO: 23395 - protein, 325 aa, Phalaenopsis hybrid cultivar
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDGEWIDVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 23396 - protein, 290 aa, Corynebacterium diphtheriae NCTC 13129
MVTMKQHENIIPTITLNDGTEMPAIGFGTYKLREQDAYRAVRSAIEVGYRHIDTASLYKNEEEVGRAVADAITAGEVARDELFITTKVWNDMHGDQLTQRSFQESLHRLGLDYIDCCMVHWPWPQKGLYVESFAALAKIQGLGQLQSVAVANFYPEVLREIVAETGIAPVLNQVELHPGFSQAEQRAVDRELGVVTEAWSPLGRGDSLNAEAITLIAQCYEKTPAQVTLRWIHQLGCSVVPKSANPQRQRENLDIFDFELNTEDMNSITSLDEQGGRLFVDPHDFPGEVE

SEQ ID NO: 23397 - protein, 172 aa, Corynebacterium efficiens YS-314
MAPSDITRHTLSVLVQDVDGIISRVSGMFTRRAFSLVSLVSAKTETAGINRITVVVDADELNIEQITKQLNKLIPVLKVVRLDEETTIARAIMLVKVSADSTNRPQIVDAANIFRARVVDVAQDSVVIEATGTPGKLRALLDVMEPFGIRELIESGQIALNRGPKTMAPAKL

SEQ ID NO: 23398 - protein, 445 aa, Phalaenopsis hybrid cultivar
MSKMFGKEVPLSKMAVSKAHGEGSPYFAGWKAYEENRYDAVGNPDGVIQMGLAENQLSFDLLEEYLELHPEAFSWASDSSSFRENALFQDYHGLQTLRQALASFMEKIRGGRSKFDANRIVLTAGATAANEILTFILADRGDALLVPTPYYPGFLRDLQWRTGVTIFPVHCYSSNGFQLTLSSLEKAYAEAKASNFNVRGLLMTNPCNPLGTSASLSLLQDIIHFISDKNIHLISDEIYSGSVFSSTNLFSISDLITDAISEQVHIVYSLSKDLGLPGFRVGALYSYNDRVVKTARRMSSFSLVSSQTQRLLSFMLSDEEFTVRYIEKNRERLRERYELVVNGLKEAGIECLKGEAGLFCWVNMEKLMEEETKEGEAELWKVIIDDLKLNISPGSSCCCAEPGWFRLCFANMSRETLEVALKRLKDFAQKKVAAKKKKMNNVYFC

SEQ ID NO: 23399 - protein, 166 aa, Vibrio fischeri ES114
MAKEQQQATDLNEKLIAVNRVSKTVKGGRIFSFTALTVVGDGNGRVGFGYGKAREVPAAIQKSMEKARRNMFTIALNEGTLHHAVKGRHTGSKVYMQPAAEGTGIIAGGAMRAVLEVVGVRNVLAKAYGSTNPINVVRATIAGLSSVKSPEMVAAKRGLTVESISE

SEQ ID NO: 23400 - protein, 405 aa, Idiomarina loihiensis L2TR
MSLNVAQIREQFPILQRQVNGKPLVYLDNAATTQKPQAVIDALTDYYTQCNANVHRGAHYLSDEATRRYEAARKTVADYIHANRQEEVIWTSGTTEGINLVANGVAQRLKPGEEVLVTEMEHHANLVTWQQACKRSGATLKVVPINEDGSLNTEQFHALLSENTAFVSMPHISNALGTINPIKELTAAAKAKDALVMIDGAQGVAHGAIDVQDIGCDFYAFSGHKLFGPTGIGVLWGCYEVLKDWPIWLVGGEMIATVSYQDATWGELPNRLEAGTPNIAGAIGLAAAINWLQQFNKADILAHETALLARATQLAEQTDGLTIVGHADNKIGVLSFILEGAHPADIGFLLDKQGIAIRTGDHCAQPLMKRLKVPGTARASFTIYNTLDEVDKLFEGINKARLMLA

SEQ ID NO: 23401 - protein, 533 aa, delta proteobacterium MLMS-1
MTPPPRNGGRYVLTDDEILTLARWSCTIEDHYGKAMDIEWAKDGDGKEVGTGELFIVQARPETVHSQTNKEEVETYVLKETGKLLACGQAVGARIGQGKARVIDNVADIHDFKAGEVLVTDMTDPDWEPIMKIAAAIVTNRGGRTCHAAIISRELGIPCVIGTGDGSTAIPDGDEVTVSCVEGETGNIYQGALAFEVERLDLGSIPATRTKIMMNVGIPEKAFSEGQIPNDGVGLAREEFIINSHIGVHPLALYYFDDLKQKAAADPKIAAVVKDIEHRTSAYGEDKKQFFIDKLAEGVGRIGAGFYPKDVIVRLSDFKTNEYANLLGGYLYEPKESNPMIGWRGASRYYDPNYKPAFELECKALLKVRNEMGLNNIKLMVPFCRTAEEGRKVIEVMREYGLVQGENGLEIYVMCEIPSNVIAADAFADVFDGFSIGSNDLTQLTLGLDRDSDLVSHIYDERDESVKTMIKMVIDTAKRRGRKIGICGQAPSDFPEFATFLVECGIDSMSLISDTVIKTRLAVADKEKELGIS

SEQ ID NO: 23402 - protein, 593 aa, Paracoccus pantotrophus
MKMTTEEAFVKTLQLHGIEHAFGIIGSAMMPVSDLFPKAGITFWDCAHETNAGMMADGFTRSTGKMSMAIAQNGPGVTGFVTPVKTAYWNHTPLLLVTPQAANRTIGQGGFQEMEQMRIFADCVCYQEEVRDASRIPEVLNRVIMQAWRNSAPAQINIPRDFWTQVIDVELPQVVGFERPAGGEQAVTEAARLLSEAQFPVILSGAGVVLSGAIPDLVRLAERLDAPVCSNYQHNDSFPGSHPLAMGPLGYNGSKAAMEIIAKADVVLALGTRLNPFSTLPGYGIDYWPKEAKIIQVDINADRIGLTKKVTVGIQGDAAKVARGILAQLAPMAGDAGRAERKALVAQTKSRWAQELSSLDHEEDDPGTVWNADARKRDAGLMSPRQAWRAIMQAVPQEAIVSSDIGNNCAIGNAYPSFEAGRKYLAPGLFGPCGYGFPAILGAKIGNPDVPVIGFAGDGAFGISMNEMTACGRDDWPAITMVIFRNYQWGAEKRNTTLWYDNNFVGTELDRDTSYAKIAEACGLRGVQVKSQDELTAALHDAVERQMKNRETTFIEVLLNQELGEPFRRDAMKKPVVVAGIDPADMRPQQGAA

SEQ ID NO: 23403 - protein, 96 aa, Zea mays
PTTVDFFWVCLQVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 23404 - protein, 168 aa, Glycine max
  misc_feature (19)..(19): Xaa can be any naturally occurring amino acid
  misc_feature (56)..(56): Xaa can be any naturally occurring amino acid
  misc_feature (70)..(70): Xaa can be any naturally occurring amino acid
  misc_feature (98)..(98): Xaa can be any naturally occurring amino acid
  misc_feature (102)..(102): Xaa can be any naturally occurring amino acid
EIAEFKSAWRGLKVRLYPXAMQAMRCYLDPAVQIEFTLLQKYVEEKDNNVKDVLRXALAAVSYTRQINMXKMLKAKCRPQQEDSGEIGDQASEGKMQXIMDXRALQKSPRSQLRRQLSGLQKHMEDLTNDAERSNETVLRPQEHIVEQGLSHTETKTRDYNRRSRRIQ

SEQ ID NO: 23405 - protein, 141 aa, Vitis vinifera
MWFGGGGGGGRGVAAGLFVRYFSRKCAVNVRKINPKVPYQEASSIAQSLYQVIKQNGALSISNTWIQAKEAGISGLNSKTHMKIMLKWMRGRKMLKLFCNHVGSSKKFLHCTLPEDPEVAQLRSSLEHKPQTKKRSTKRKK

SEQ ID NO: 23406 - protein, 125 aa, Glycine max
MAGRLTNAASRILGGNGVVYRSVASSLRLRSGMGLPVGKHYVPDKPLPMNEELLWDNGTAFPEPCIDRIADTVGKYEALAWLCGGLSFFASLGLLAVWNDKASKIPFTPKVYPYDNLRVELGGEP

SEQ ID NO: 23407 - protein, 340 aa, Zea mays
MAPVDLTPRQPRKAYGGDAGAYYEWSPADLPMLGVASIGAAKLSLAAGGLSLPSYSDSSKVAYVLEGTGTCGIVLPEATKEKVLAVKEGDALALPFGVVTWWHNGPAAPTQLTLTGATGIFTGFSTEFVSRAWDLPEADAAALVSSQPASGIVRASSSPLPAPSPRDREGVALNCLEAPLDVDIPGGGRVVVLNTANLPLVKEVGLGADLVRIDAHSMCSPGFSCDSAYQVTYIVRGSGRVQVVGPDGVRVLETRVEGGFLFIVPRFHVVSKIADASGMEWFSIITTPNPIFSHLAGKTSVWKAISAEVLQASFNTTPEMEKLFRSKRLDSEIFFAPPSN

SEQ ID NO: 23408 - protein, 437 aa, Arabidopsis thaliana
  misc_feature (284)..(284): Xaa can be any naturally occurring amino acid
MFNYVIILPLALFLLAYKFFFTSKKQRYYLPPSPSYSLPILGHHLLIKPPVHRLFHRLSNIHGPIFYLRLGSRRAVVISSSSLARECFTGQNDVIVSNRPRFLTSKYIAYNYTTIATTSYGDHWRNLRRICSLEIVSSKRLANFLHIRKEEIQRMLTRLSRDARVGKEVELESILYDLTFNNIVRMVTGKIYYGDDVSDKEEAELFKKLFTFITTNSGARHPGEYLPFMKIFGGSFEKEVKAAAKVIDEMLQRLLDECKSDKDGNTMVNHLLSLQQDDPEYYTXQNVVSETLRLHPAAPVLVPRSTAEDIKIGGYDVPRDTMVMVNAWAIHRDPDLWTEPERFNPERFNGGEGEKDDVRMLIAFGSGRRICPGVGLAHKIVTLALGSLIQCFDWKKVNEKEIDMSEGPGMAMRMMVPLRALCKTRPIMNKLPAYTKV

SEQ ID NO: 23409 - protein, 644 aa, Chlamydophila caviae GPIC
MTSQVSSILSQISSPTDLKKFSLAELSLLAEQMRHKIISVLTNTGGHLASNLGIIELTIALHYVFSSTEDKFIFDVGHQAYPHKLLTGRNTEEFDRIRHDGGLSGFTSPSESIHDLFFSGHAGNALSLALGMAKATEDSRTHILPILGDAAFSCGLTLEALNNISSNLSKFIVVLNDNNMSISQNVGVMSKNLSRWIHHPKFNLFSRKIEKWLTKIPRYGNSISRRSHKLSICLKSLFCPIPIFEQFNLAYMGPVDGHDIKRLISVFQTARDLPFPVLIHVYTTKGKGLEIAQENPEKYHGVTANFNSSKENKFLPTIKPQLTYPDIFGQTVCTLGEAFPNLHIVTPAMSLGSRLEAFKEKFPNRFIDVGIAEGHAVTFSAGIAKAKSPVICSIYSTFLHRALDNVFHDVCLQGLPVILAIDRAGLAYGDGCSHHGIYDLSFLRAMPNMVICQPRSAVVFQQLLQSSLQWNMPVAIRYPNIAATQRDPIATDVHMHRDPGVGEILSQGEDVLILGLGHMCNTALSIKLQLLTHGISATVVDPVFVKPFDNNLFSILLMHHSKVIIIEEHSIRGGLASEFNDFLATYSFKVDVLHFGIPDAFFAHGDKESLLKRVGLDTESMVKRILTHFNFRTKTSPSNKLSIV

SEQ ID NO: 23410 - protein, 412 aa, Populus trichocarpa x Populus deltoides
MSAMVLDPKPAPATEPRSDLVLDPSTIPIEDDDLYSRLKSLQRQLEFIEIQEEYVKDEQKNLKRELLRAQEEVKRIQSVPLVIGQFMEMVDQNNGIVGSTTGSNYYVRILSTINRELLKPSASVALHRHSNALVDVLPPEADSSISLLSQSEKPDVTYNDIGGCDIQKQEIREAVELPLTHHELYKQIGIDPPRGVLLYGPPGTGKTMLAKAVANHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLSDEVDLEDYVSRPDKISAAEIQAICQEAGMHAVRKNRYVILPKDFEKGYRTNVKKPDTDFEFYK

SEQ ID NO: 23411 - protein, 203 aa, Xylella fastidiosa
MSSPLECAKYLLSAHTTHQLPADDGSEVAFAGRSNAGKSSVLNTLTRQNALARVSKTPGRTQQLVYFTVTPQRYLVDLPGYGYAKVPKELQIHWQTFIDSYFHQRQALRGLVVVMDIRHPLKEYDLQMLAYARQRGLPAQALLTKADKLGRGQQAQTLQKVRNELTKHFADHINIQTFSSKSRQGVEQLHTVIETWLGLARLA

SEQ ID NO: 23412 - protein, 173 aa, Zea mays
  misc_feature (158)..(158): Xaa can be any naturally occurring amino acid
MAEKEVPLTAVKVEALVVMKIIKHGSQAFPTTATGSIVGMDVDGTLEITNCFPFPVVEVPAESHFDNAAPNPAAAAPRAKANAAYEAEMIRMMREVNVDANNVGWYTSANMGNFVNMNVIENQFFYQKDMNERTVALVHDVSRSAQGSLSLRAFRLSXKFMAAFKENKFTSEE

SEQ ID NO: 23413 - protein, 473 aa, Dictamnus sp. M.W.Chase-1820K
ALAKKNLGHIVQIIGPVLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVDTRTTSPIHKSAPAFIQLDTSLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALAMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAK

SEQ ID NO: 23414 - protein, 399 aa, Corynebacterium diphtheriae NCTC 13129
MLLDADPLVSFAWIMGAALLAPLLSYATGKRLPAVVLLICFGLVIGPNVLGLASLDGGVGLIKEIGLGMLFLLAGYEIEPETLRGKEGRTGLATWLMCAVLSFLGAMSIVGFHSSSTAIVLAIALTSTAIGTLLPIMKQHDMLDTPVGRSLLIHGAIGEIAPILAMALLLSSRSTWLTTAVLLAFFLVAAVVAIVPRTVKFFLPWMGRAMVDGAGSTNQTVLRLVLLMLAILMSVAAVFELDVVLGAFAAGFILRQMVPEKYRTPLEQRLDIVGYSLFIPVFFVCSGMAINPQAVAEKPWLLVALVPLFYVTRGLPIFLREVFFSTGSEVSGWKESLQLSLYAATALPIIVAVTEVATHSKLLSADNASILVAAGSVTVLLFPLIGNLITQGRRNAARG

SEQ ID NO: 23415 - protein, 548 aa, Zea mays
MATTVLDAGELHLHPYAVAAAAAALVSMYMVWFWALTRGLSGPRMWPLVGSLPSVVLNRARVHDWIVDNLRSTGEAATYQTCILPMPFLARRQGLVTVTCNPRNLEHILRVRFDNYPKGPMWQAAFHDLLGQGIFNSDGETWLLQRKTAALEFTTRTLRQAMARWANRIIKYRLWSILADRCEAAASVDLQDLLLRLTFDNICGLTFGKDPETLSPGLQENPFANAFDSATEATLQRFLFPSFLWRVKKALGVGSERSLRESLATVDQYMTEAIAARKATPSDDLLSRFMKKRDGSGRAFPEDVLQWVALNFVLAGRDTSSVALSWFFWMLMLRRDVERKVVLEIVSVVRETRGDDRRRWTEEPLDFDELDRLVYLKAALAETLRLYPSVPQDSKYVVEDDVLPDGTVVPAGSAVTYSIYSVGRMESIWGKDCAEFRPERWLSADGTRFEPPKDAYRFVAFNGGPRTCLGKDLAYLQMKSIASAVLLRHSVELVPGHKVEQKMSLTLFMKSGLRVHVKPRDLAGYVAAPEDAPQLGAFVIPTTTAAAA

SEQ ID NO: 23416 - protein, 533 aa, Lactobacillus plantarum WCFS1
MALLISTGVLVVAAMVSIVINRRWLPRLSVNYVSMFIGAGIAVIPFLNGLIEKFNSDIFIGLIVAPLLYFEGQNTRLNLVGRHVREIVSLTVGMVILCAVMAGLGTSLLAGVGLPLAFILAAISTPTDATATESVTMGRVLPQREQTSLKLESLFNDASGIILLNMAILWYINGYINYSQTLWDFVYAAGGGIAFGGLVSGLIVYIRQLMLRSKLNFINNTYNNGTPLKVIYLMTPFVLYFGAEALGVSGIIAVVFAGLVHNAEGERSALANPQLASDIYQLIGLLSDILNSVVFIVLGIMLLRTALDHSVSYNGSLIWIVIGVILYVANLLARYGYVRLIHHVPNREAWVFALGGIHGAVTFALAFTVAETQVKTTDFNLVLMSESLLIILSLLVPTIVFRWLLPKIKTDTDGAAKMAVIREQMIEAGVHDLWQMPISQEFKAAVTFDLRSQNGHTTVRQFISEWRRMVQHPEYTADEMRELMVIYRQVFQTERDYLQRQYDATHAISEDLFNRLYHEITMAEMVVLEYGVK

SEQ ID NO: 23417 - protein, 337 aa, Azoarcus sp. BH72
MTVLVTGGAGYIGSHTVLELLNAGEQVVVIDNLSNGSEEALRRVEALAGRRLAGFVNADVRDVQALDALFARYTVSAVIHFAALKAVGESVAKPLAYYDNNVCGLLGLVDAMRRAEVRRLVFSSSATVYGDPASVPIVEDFPTSATNPYGRTKLMCEQILADVAHADPAWRIALLRYFNPVGAHPSGRLGEDPAGIPNNLMPYVSQVAVGRLPALQVFGGDYPTPDGTGVRDYIHVVDLALGHLSALRRLDSLPPVDAINLGTGCGYSVLEVVEAFRKASGRAVPFRIVDRRPGDVAACWADTAKARRVLGWQAERGIAEMCADAWRWQSANPSGYR

SEQ ID NO: 23418 - protein, 173 aa, Oryza sativa Japonica Group
MAAAARSSTKGVRRTKSLISRTLERCKSGLSSGGGGRSAAAPVAGCFSVYVGPERERFVVRTEYANHPLFRRLLDDAEREYGYAAQGPLALPCAVDAFLDVLWQMERDGCGGGGDDDDDLSIGGGGAASPICGLPSCGSKGRAAAAGYRMLSPARMTSILSRSSPMATPSRKR

SEQ ID NO: 23419 - protein, 424 aa, Zea mays
MAARAADENRRPAAGKPAPGVRDMASRRALTDIKNLVGAAPYPYAVAKKPMLQKSKRDEKQPALASSRPMTRKFAASLASKGQPECQPIVADPEPEVCQQKESVGDGTVDIDVELYELVDGSDSDIDMGATENKDIMNEDELLMDIDSADSGNPLAATEYVKELYTFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 23420 - protein, 179 aa, Brassica juncea
LRDYMSKFGDLEDCIVMKDRSTGRSRGFGYVTFASSQDAKEALKGEHFLGNRILEVKVATPKEEMRQPAKKVTRIFVARIPPSVSESDFRRHFEKYGEITDLYMPKDHNSKQHRGIGFITFATSDSVEDLMEDTHDLGGTTVAVDRATPKEDDPPPRPPPAARMQRPPVAVAGGFGAPG

SEQ ID NO: 23421 - protein, 206 aa, Prochlorococcus marinus subsp. pastoris str. CCMP1986
MTDTPTKQENQSKTENPPSSNANEQRRGNRNNDRKRNRRGDSKNERDSEWQERVVQIRRVSKTVKGGKKMSFRAIVVVGNEKGQVGVGVGKAGDVIGAVRKGVSDGKKHLVRVPLTPNNSIPTLSKGRDGAANVLIRPAAPGTGVIAGGSIRTVLELAGIKNVLAKRLGSKTPLNNARAAMVALSQLRTHKSASRERGISLEQLYS

SEQ ID NO: 23422 - protein, 336 aa, Vibrio fischeri ES114
MSEIRTLGEFIVAKQHDFPHASGELSSLIGSIKLAAKIVNREINKAGLVDITGASGEENIQGEQQQKLDVYANDKFKSALEARDQVCGVASEEEDEAVAFNKELNKNAKYVVLMDPLDGSSNIDVNVSVGTIFSIYRRISPIGTPATEEDFLQPGHKQVAAGYIIYGSSTMLVYTTGNGVHGFTYDPSLGVFCLSHENMQIPKDGNIYSINEGNYIRFPEGIKQYLKFCQESKPEDNRPYTSRYIGSLVADFHRNLLKGGIYLYPSTQAYPNGKLRLLYECNPMAMLIEEAGGKATDGEQRILDIKPSELHQRVPFFVGSTNMVNKVHAFLDEWRD

SEQ ID NO: 23423 - protein, 331 aa, Campylobacter jejuni subsp. jejuni NCTC 11168
MKKAKSRIAILGTGGTIAGFIDSTIATTGYAAGAIDIDVLIKAVPQIRDLADISWEQIANIDSSNMCDEIWLRLAKKIAKLFAEGIDGVVITHGTDTMEETAYFLNLTIKSDKPVVLVGAMRPSTAISADGPKNLYNAVALVVNKEAKNKGVMVAINDKILSARGVVKTHSLNVDAFSSPDFGDLGYIVDGKVFFYNNVIKAHTKNAPFDVSKLTSLPKVDILYSYSNDGSGVAAKALFEHGTKGIVVAGSGAGSIHKNQKDVLKELLKKGLKVVVSSRVVAGCVAVSDSDEKLGFISAEDLNPQKARVLLMLALTKTSDPKKIQEYFLKY

SEQ ID NO: 23424 - protein, 203 aa, Arabidopsis thaliana
MYLTCRFEESKSAEKAVVALEESTSGEPKTPTESHEKLRKVRSDQGSSTTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKHLKQIQDQTDSMEMYKNGLQVRYQSRKKLAEQRPRVKGQFVRTVNSDASTKS

SEQ ID NO: 23425 - protein, 593 aa, Paracoccus pantotrophus
  misc_feature (83)..(83): Xaa can be any naturally occurring amino acid
MKMTTEESFVKVLQLHGIEHAFGIIGSAMMPVSDLFPRAGITFWDCAHETNAGMMADGFTRSTGRMSMAIAQNGPGVTGFVTXVKTAYWNHTPLLLVTPQAANRTIGQGGFQEMEQMRIFADCVCYQEEVRDASRIPEVLNRVIMQAWRNSAPAQINIPRDFWTQVIDVELPQVVAFERPAGGEQAVAEAAKLLSGAEFPVILSGAGVVLSGAIPELARLAERLDAPVCSNYQHNDSFPGSHPLAMGPLGYNGSKAAMEIIARADVVLALGTRLNPFSTLPGYGIDYWPKDARIIQVDINADRIGLTKKVTVGIQGDAAKVARGILAQLAPTAGDAGRAERKALVAQTRSRWAQELSSLDHEEDDPGTEWNEDARRRDAGLMSPRQAWRAIMQAVPKEAIVSSDIGNNCAIGNAYPSFEAGRKYLAPGLFGPCGYGFPAILGAKIGNPDVPVIGFAGDGAFGISMNEMTACGREDWPAITMVIFRNYQWGAEKRNTTLWYDNNFVGTELDRDTSYAKIAQACGLVGVQVKSQEELTAALHDAVERQMKNRETTFIEVLLNQELGEPFRRDAMKKPVVVAGIDPADMRPQQGAA

SEQ ID NO: 23426 - protein, 203 aa, Brassica napus
  misc_feature (7)..(7): Xaa can be any naturally occurring amino acid
LNLVYIXECNGLPEVAEYWKQVIKINDYQKTRFVNRIVSSMFNTVSNKKIAVLGFAFKKDTGDTRETPAIDVCKGLLGDKARISIYDPQVTEEQIQRDLTMNKFDWDHPLHLQPMSPTTVKQVSVAWDAYAATKDAHGICILTEWDEFKKLDYEKIFENMQKPAFVFDGRNVVDAEKLRKIGFIVYSIGKPLDQWLKDMPALA

SEQ ID NO: 23427 - protein, 441 aa, Blastocladiella emersonii
MAIKKVLARQIFDSRGNPTVEVDLITDKGLFRAAVPSGASTGVHEALELRDNIKSEYMGKGVKTAVANVNDIIGPHLIALSPPLDVTDQKKADEILLALDGTKNKSKLGANAILGVSLAIAKAGAAEKGLPLYAHIHALAYGKVADKYVLPVPAFNVINGGSHAGNKLAMQEFMILPTGASSFTEAMKMGSEVFHHLKSVVKAKYGQDATNVGDEGGFAPNIQDNKEGLELLKQAIAKAGYTEQIEIGMDVAASEFYKDGKYDLDFKNAESDPSTYLTGEQLAALYESFAAEYPIVSIEDPFDQDDWESWTHLNGKLREKTQIVGDDLTVTNPERIATAIEKKACSALLLKINQIGTITESINAALDARGDGWGVMVSHRSGETEDCFIADLVVGLCAGQIKTGAPCRSERLAKYNQLLRIESELGDRAVYAGKNFRHPKH

SEQ ID NO: 23428 - protein, 348 aa, Corynebacterium efficiens YS-314
MVRKESRKMKLAVIGGDGIGPEVTDEALKVLRALRADIETTDLDLGARRYLRNGELLTDEDLALLREHDAILLGAIGAPGSVPPGVLERGLLLKLRFALDHHVNLRPSKLYEGVESPLKNPGEIDFVVVREGTEGAYTGNGGAIRVGTPHETANETSVNTRYGAERVIRYAFELAQSRRRHLTLVHKTNVLVHGGGLWQRTVDEVAREYPEVTVDYNHIDAATIYLVTDPSRFDVIVTDNLFGDILTDEAGAISGGIGLAASGNIDATGTNPSMFEPVHGSAPDIMGKGIADPTAAILSAAMMLRHLGDEANAVRIEEAVARDVAGRDPEAPISTTEVGDRIAAAVVA

SEQ ID NO: 23429 - protein, 534 aa, Mycobacterium smegmatis str. MC2 155
MSQVQRPPTLSTGAMVSSSHPAASFAGARVLADGGNAIDATLAMAAVTWLTLPGQCGIGGDAFAVVAEPDGRVWTVNGSGFGPDGGTTDFYRDIQGGRSGIPLTGALGVAVPGAPAALAALHSHGARMSLAELWEPAARMAENGLACTAKTVTDVREAFDAIRADDGLAAVYTPDGAVPAVGQRLPQPDLARTIRRLATAPGDFYTGEFAERAVAVLCAAGAPFSGDEWAAGAVVAPEAPLTGGYAGATIHQTPLPTPGWMVLQQAALCDGTLGAAPWLGAEAIDRMARAARLAFQDRFALCGSDGAGVREVLDANRIAEQRRALDASAEQRMSFSVAGGDTTCTVAVDADGRAVSFIHSLGFTFGAKLTVPGTGVVLNNRLGRGAYLIPGHPNEVAPRRKPLNTLNAWIATGADGELLALGSIPGGDGQVQWNMQLLSYLFDHGLDPAEAVSAPRFTVFPGSDADVIGRPDELRVEARIPDDVRSELQDMGHRVVVQPDFGAGGSAQVIRRDARGVLSGAADPRQEGIAIGVE

SEQ ID NO: 23430 - protein, 254 aa, Chlamydophila caviae GPIC
MERKSYVFGNWKMHKTAKEAKDFLSIFCPFVKEISPASLVGIAPAFTTLSACCESIKEMDSSIWLGAQNVHQDSSGAFTGEVSLPMLQEFHVNFVLLGHSECRHIFHEEDATIALKVGAAARSGVVPVLCIGETLEARENGTTKEVLSNQLMLGLAQLPETAPVIIAYEPVWAIGTGKVASTADVQEVHAFCREVLSRIFSKEKSEIISILYGGSVKADNAEGFARCPDVDGLLVGGASLDPQGFANVLRNFNL

SEQ ID NO: 23431 - protein, 214 aa, Vitis vinifera
MGDGQKKTELYDASQRPSSLNERILSSMSRRSVAAHPWHDLEIGPGAPQIVNCVVEITKGSKVKYELDKKTGLIKVDRVLYSSVVYPHNYGFIPRTLCEDNDPLDVLILMQEPVVPGCFLRARAIGLMPMIDQGENDDKIIAVCADDPEYRHYTDIKELPPHRLAEIRRFFEDYKKNENKEVAVNDFLPSSSAHQAVQHSIDLYAEYILQSLRR

SEQ ID NO: 23432 - protein, 321 aa, Burkholderia sp. 383
MSQFPLDPGAARVVALARESGALGPEAGSPEQARVAFRTSRKALASQPVQVSSVRDLEVVHPDGKLGLRCYRGWGTDDGSQLPCLLFFHSGGWVSGDLDTHDNACRAIASTARISVMAVDYRLAPEHPFPAAIEDAQAAYAYILEHASSLNIDATKIAVGGDSAGGNLAAVLTHLLRDAGGHQPIAQVLLYPATDFAANTASLEQFSLGPTLTKASLDWFADQYLPVGEDRLDWKASPLRAPTFATLPAAYVVTCGHDPLCDEGAAYSARLRDAGVSVRHQHYPGQIHGFLTMGGLIPEATVLIGEVAVFLDQVFSRFRGA

SEQ ID NO: 23433 - protein, 122 aa, Oryza sativa
HKAGRRRRALVSFASPLLSPPPSRRFKVQESMEDQTAAAAGLDSRVKASLVLGTESFAISSESGILSEQLAAMKEKSMEILKGYITKHNAPADVPDEPIEGLSDDEGDAPAKNPPKKPKKQK

SEQ ID NO: 23434 - protein, 401 aa, Populus trichocarpa x Populus deltoides
MDYFYGPGRNHLFVPGPVNIPEPVIRAMNRNNEDYRSPAVPAMTKTLLEDVKKIFKTTSGIPFLIPTTGTGAWESALTNTLSPGDRTVSFLIGQFSLLWIDQQQRLGFNVDVVESDWGQGANFDILASKLAEDTAHTIKAVCIVHNETATGVTNNLAKVRKILDDYSHPALFLVDGVSSICALDFRMDEWGVDVALTGSQKALSLPTGMGIVCASPKAIEASKTAKSVRVFFDWKDYLKFYNLGTFWPYTPSIQLLYGLRAALDLLFAEGLENVFERHARPGKATRLAVEAWGLKNCTQKEEWFSDTVTAVVVPPYIDSAEIVRRGWKRYNLSLGLGLNKVAGKVFRIGHLGNLNELQLLGCLAGVEMILKDVGYPVKLGSGVAAACAYLQNNTPLIASRV

SEQ ID NO: 23435 - protein, 247 aa, Oryza sativa Japonica Group
MDTASLCTVEKRGAVHVITLTGAGEHRLGPPLLSALRSAVAAVRAAAAAGAGGALVIAGEGKYFSNGFDLDWARTVPAELHASMGGAFRGLVADLLALPVPTVAAVTGHAAAAGCALALAHDAVVMRASRGFLYMSEVDAGLKIVDFFAELIRQKVPDAVNRRDLVLRGDKMTAADALRRGIVDAAVDGGVDDVVAAAVREAEALAARGWDGEIVAETRKAIWPELWAKVKDHATDEPPPPPPRPLL

SEQ ID NO: 23436 - protein, 452 aa, Pseudomonas syringae pv. phaseolicola 1448A
MRLDRTSFGKRLGSYAESISLPAQPVVEGRLLRMVGLTLEAEGLRAAMGSRCVVINDDSHHPVEVEAEVMGFSGGKVFLMPVGSVAGIAPGARVVPLADTGRLPMGMSMLGRVLDGAGRPLDGRSPIKAEDWVPMDGPTINPLKRDPISQPLDVGIRCINGLLTVGRGQRLGLFAGTGVGKSVLLGMMTRFTEADIIVVGLIGERGREVKEFIEHILGEEGLKRSVVVASPADDAPLMRLRAAMYCTRIAEYFRDKGKNVLLLMDSLTRFAQAQREIALAIGEPPATKGYPPSVFARLPKLVERAGNAEAGGGSITAFYTVLSEGDDQQDPIADSARGVLDGHIVLSRRLAEEGHYPAIDIEASISRVMPAVVSPEHMARAQHFKQLWSRYQQTRDLISVGAYVAGGDRETDMAIALHPVLVRYQRQGLRDNESMQGSGEALASIFAPAPGG

SEQ ID NO: 23437 - protein, 360 aa, uncultured epsilon proteobacterium
MKTLDDCRLAIDKIDSEVLELLNKRMDVVQRVGEIKHDSGTAVYRPEREKAIIERLTELSKDQGGVLNKGAIEAIFLEIFAVARNLELPERIAYLGPEGSFTHQAAESRFGGMSEYLSLSSIHAVFKTLESKRAKFGVVPIENSRDGIVGETLDYLAKSSMKIVAELYMPIHMSFVTKANRLEDIKKIYSKDKGFGQCRDFLLEHGFINVELIPVESTATAAILAAKEPNSAAICSHIAAKLYGVPTLFENIEDDIDNSTRFVILSDFKNSISEDDKTSILVRLEDGVEAGSLVRFLEDFNNEKINLSKIESRPSRDKSGFGYWFFMDFDGHIDDERVKKTISKHQDEVTWLGSYAKGTN

SEQ ID NO: 23438 - protein, 497 aa, Bordetella parapertussis 12822
MTAPAAVPAPQSPPKVKIPIGLIAGIIAMVVVLLLPLPAELPPAGHRMLAILAFAVVVWITEAVSYEASAIMITTLMAFLLGTAPNVKNPDVLYGTSAAISMALTGFSNSALALVTGALFIAAAMTFTGLDKRIALVTLARVGTSTRRILLGAIAVTIVLSLVVPSATARSAAVVPIMLGVIAAFGVDKRSNIAAGIMIIVAQATSIWNVGIQTAAAQNLLTVGFMDKMLGERVAWSDWLIAGVPWSLLMSAVLIFVVLRLLPPESDAIAGGKEAVEASLRELGPMTSAQKRLMLVSIMLLLFWSTKGKLHKFDTTSTTYFGLVLLMLPRFGVMTWKDVQTRIPWGTVIVFGVGISLGTALLTTQAGQWLGAQVVAHTGLDHLGPLGIFAILSAFLILIHLGFASATALTSAMLPILIAVLQTLPGDFNRLGMTMLLGFVVSYGFILPINAPQNMMALGTETFTAKQFAKVGIVLTIVGYLLMLLMSVTYWRWLGWM

SEQ ID NO: 23439 - protein, 223 aa, Pseudomonas syringae pv. phaseolicola 1448A
MTQDQLKQAVAQAAVDFILPKLDDKSIVGVGTGSTANCFIDALAKHKAAFDGAVASSEATAARLKGHGIPVYELNTVSDLEFYVDGADESDEHLNLIKGGGAALTREKIVAAVAKTFICIADGSKLVPVLGAFPLPVEVIPMARSHVARQLVKLGGDPVYREGVLTDNGNIIIDVHNMSITNPVELEAQINAIVGVVTNGLFAARPADLLLLGTTEGVKTLTR

SEQ ID NO: 23440 - protein, 434 aa, Geobacillus stearothermophilus
MAFEFKLPDIGEGIHEGEIVKWFVKPGDEVNEDDVLCEVQNDKAVVEIPSPVKGKVLEILVPEGTVATVGQTLITLDAPGYENMTFKGQEHEEVKKEEKAETVSKKEMVETAAPSAPAAEAEADPNRRVIAMPSVRKYAREKGVDIRLVQGTGKNGRILKEDIDAFLAGGAKAAAEPTPQAAEEKAAPQAPAAKPVVPEGEFPETREKMSGIRRAIAKAMVHSKHTAPHVTLMDEADVTKLVAHRKKFKAIAAEKGIKLTFLPYVVKALVSALREYPVLNTSIDDATEEIIHKHYYNIGIAADTDRGLLVPVIKHADRKPIFALAKEINELAEKAREGKLMPNEMKGASCTITNIGSAGGQWFTPVINHPEVAILGIGRIAEKPIVRDGEIVAAPMLALSLSFDHRMIDGATAQKALNHIKQLLSDPELLLMEA

SEQ ID NO: 23441 - protein, 119 aa, Streptomyces coelicolor A3(2)
MDRVALRGLKARGHHGVFPKEREDGQTFLVDIVLGLDTRPAAADDDLAKTVHYGIVAEEVVAVVEGEPVNLVETLAERIAQVCLKHEGVEEVEVCVHKPDAPITVPFDDVTVTIIRSRV

SEQ ID NO: 23442 - protein, 317 aa, Lilium hybrid cultivar
MASFPVINMENLEGEGRSKVMELLHDACENWGFFELLNHGIPHELLDKVEKLTKDHYKKCMEQRFREFASKTLEDPSKVDPDNLDWESTFYLRHLPTSNMEEIPDLTDEYRETMREFVKRLGELADQLLDLLCENLGLEKGYLKKAFSGTKGLTFGTKVSNYPPSPKPELIKGLRAHTDAGGLILLFQDDKVSGLQLLKDGEWVDVPPMHHSIVINLGDQLEVITNGKYKSVLHRVVSQPDGTRMSIASFYNPGSDAVIYPASALVKETEKESEMYPKFVFEDYMKLYQVQKFQAKEPRFETMKTLEAAITPQLIAT

SEQ ID NO: 23443 - protein, 192 aa, Synechococcus sp. CC9311
MGQQAPDFTATAVVDQEFQEISLSQYRGKYVVLFFYPLDFTFVCPTEITAFSDRYSDFSSKNTEVLGISVDSQFSHLAWIQTARNQGGIGDINYPLVSDLKKEISTAYNVLDDAEGVALRGLFIIDPEGVIMHATINNLPVGRNVDETLRVLQAFQYVQSNPDEVCPANWTPGEKTMKPDPKGSKEFFAAIG

SEQ ID NO: 23444 - protein, 324 aa, Idiomarina baltica OS145
MKRLLPTLRADNAPEGLISVLNTIQIAAKEISFRLHQGALAGVLGSTLDENIQGETQKKLDVVANQLLKTLLLESPRVHAIASEEEDSIVLSPNSGEYLVAFDPLDGSSNIDINGTVGTIFSVLPKPENSANDESMFLQKGRNQVAAGYVLYGPSTMLVMTTGSHVRTYTLDQTVGEFLLTKDTASIPADTQEFAINMSNQRHWGTAVREYVEHLLLGEDGPRQKNFNMRWNAAMVSDVHRLVTRGGLFTYPWDARNPDKPYKLRLMYEAAPMAMIVEKAGGSASNGYVPILDIEPEQIHQRVAVVMGSTNEVQKCVEYHEKHG

SEQ ID NO: 23445 - protein, 565 aa, Glycine max
MQSSISLSSSYAPTISGPRHSFPLSGRTLAPSNLRFCGLRRQAFTSTPLNHHFRLRRRRLPHSAAVSAALSANGTSPKSFDYDLLIIGAGVGGHGAALHAVEKGLKTAIVEGDVLGGTCVNRGCVPSKALLAVSGRMRELRNDHHLKSFGLQVSAAGYDRQGVADHANNLASKIRNNLTNSMKALGVDILTGFGTILGPQKVKVGSSDKIVTAKDIIIATGSVPFVPKGIEIDGKTVITSDHALKLESVPDWIAIVGSGYIGLEFSDVYTALGSEVTFIEALDQLMPGFDPEISKLAQRVLINPRNIDYHTGVFATKITPARDGKPVLIELIDAKTKEPKDTLEVDAALIATGRAPFTQGLGLENIDVVTQRGFVPVDEHMRVIDANGKLVPHLYCIGDANGKMMLAHKTTEGGISVVEQVTGRDLVLNHLSIPAACFTHPEISMVGLTEPQAREKGEKEGFEVSVAKTSFKANTKALAENEGEGLAKLIYRPDNGEILGVHIFGLHAADLIHEASNAIALGTRIQDIKFAVHAHPTLSEVLDELFKSAKVKAQASSPVSEPVAV

SEQ ID NO: 23446 - protein, 476 aa, Burkholderia thailandensis E264
MSKEFDVVVIGAGPGGYIAAIRAAQLGKTVACIEKWKNAAGALKLGGTCLNVGCIPSKALLASSEEFENAQHHLADHGISVDGVKMDVAKMLARKDGIVEKMTGGIEFLFKKNKITWLKGHGKFAGKTDAGVQIEVSGEGETEVVTAKNVIIATGSKARHLPNVPVDNKIVADNEGALTFDSVPKKLAVIGAGVIGLELGSVWRRLGAEVTVLEALPAFLGAADEALAKEAAKLFKKQGLDIHLGVKIGEVKTSANGVSIAYTDKDGNAKTLDADRLIVSVGRVPNTDNLGLEAIGLKVNERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 23447 - protein, 175 aa, Idiomarina baltica OS145
MSLGNVPAGNNLPDEVNVIIEIPANADPIKYEVDKDTGTLWVDRFMATPMFYPCNYGFVNHTLSLDGDPVDVLVPTPYPLQAGSVIKCRPVGVLKMSDESGEDAKVVAVPVSKLTKEYDHVQDIDDLPELLRAQITHFFERYKELEKGKWVKVEGWGNAADAKEEIESSYKRAQK

SEQ ID NO: 23448 - protein, 174 aa, Azoarcus sp. BH72
MAKQQTKRAQASEERDDGLREKMVAINRVTKVVKGGRILGFAALTVVGDGDGGIGMGKGKSREVPVAVQKAMDEARRKMVKVSLKDGTLQHTVVGKHGAASVLMQPAPGGTGIIAGGPMRAVFEVMGVTDIICKCIGSTNPYNVVRATLNGLMAVNTPAEIAAKRGKTIEEILG

SEQ ID NO: 23449 - protein, 172 aa, Bacillus licheniformis ATCC 14580
MIYPYKKTEPVIHETAFIADNAVITGDVTIGERSSIWFSSVIRGDVAPVRIGKGVNIQDLSCLHQSPERPLVIEDGVTVGHQVTLHSSVIRKHALIGMGSIILDEAEIGEGAFIGAGSLVPPGKKIPSGHLAFGRPAKVIRPLTDKDKQEMERIRKEYIEKGQYYKSLQKKD

SEQ ID NO: 23450 - protein, 240 aa, Triticum aestivum
GARALITGSSKGIGYAIVEELAGFGARVHACSRNAAELEECRRRWEEKGLHVTVSVRADREKLMDTVRQTFNGKLDILVNNAGQLLVKPTAECTAEEYSKVMATNLESSFHLCQLARPLLVHAGGGSIINMSSIGGSIGFVGSAIYAITKSAMNQLTRSLAAEWAPNNIRVNGVAPGFITTDMIKDMDTESLEREHSKTPLLRSGKPVEIASAVAFLCMPAASFITGQVICVDGGRTISA

SEQ ID NO: 23451 - protein, 506 aa, Rhodospirillum rubrum ATCC 11170
MLYAAPGTADAIFAFKPRYDNFIDGTWQPPVRGEYFDNVTPITGKVFCKAARSTEEDITLALDAAHAAADRWGRTTAAERALILNRIADRLQDNLETLAYVESIDNGKPIRETLAADIPLAIDHFRYFAACIRAQEGSLSQIDETTIAYHFNEPLGVVGQIIPWNFPILMATWKLAPALAAGNCIVLKPAEQTPISILVLTELIADLLPPGVLNVVNGFGLEAGKPLASSKRIAKIAFTGETATGRLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 23452 - protein, 210 aa, Brassica napus
MATSSPSLSNNGFSAAVTPPKTLRGLNKPKCIQCGNVARSRCPFQSCKGCCSRAENPCPIHVLKGVVTSAEKTAPSTPSSEQKASEGTPGRVSSIRQLSSNFAQFNNLNAVSRQRKPLTIKDAQALNEWRFTKLKEYRNRNIEVENDAFDRYMINVNLLEEAFSLASVPEEEETADSERNNEERTVSELKLRLRSNSATAEAFKMRITET

SEQ ID NO: 23453 - protein, 77 aa, Roseovarius nubinhibens ISM
MSDIADRVKKIVVEHLGVEEDKVTESASFIDDLGADSLDTVELVMAFEEEFGIEIPDDAAENIQTFGDAVKFINEAS

SEQ ID NO: 23454 - protein, 541 aa, Chlamydophila caviae GPIC
MCSKTFFVMLDAMSIVLDKIGKTLGTRVLFDDVSVVFNPGNRYGLTGPNGAGKSTLLKIITGFVEPTRGSISLPKKVGILRQNIDSFGDVSVIDCVIMGNARLWDALQKRDALYLEEFTDAIGIKLGEMEEIVGEENGYRAESEAEELLTGIGIPEELFNNKMSTIPIDLQFRVLLCQSLFGHPEALLLDEPTNHLDIHSINWLGSFLKDYDGTVIVVSHDRHFLNTITTHIADIDYDTVIIYPGNYDAMVEMKTASRDQEKADIKSKEKKIAQLKEFVAKFGAGSRASQVQSRLREIKKLQPQELKKSNIQRPYIRFPLSEKASGKVVFSIESITKGYNNEEPIFQPFSLEIYQGDKLGVIGNNGLGKTTLMKLLAGVETPTQGTIKTGHQVAYSYFPQNHSDVLKDCGDETLFEWLRNRKTGINDQEIRSVLGKMLFGGDDAFKQIKALSGGETARLLMAGMMLENHNVLILDEANNHLDLESVSALAWAINDYKGTSIFVSHDRTLIEECATKLLIFDKGKITFFDGTMADYTSSSKL

SEQ ID NO: 23455 - protein, 491 aa, Pseudomonas putida
MKHYRNYVNGKWTESSRTFDDVSPVDGSLVAIVHEASRELVDEAVKSGHQALSGEWGRTTATQRVALLRRIADEMERRQGDFLAAEMADTGKPHSMASSIDVPRGIANFRTFADILATAPVDSHRLDLADGAYALNYSARKPLGVVGVISPWNLPLLLMTWKVAPALACGNTVVVKPSEDTPGTATLLAEVMEAAGVPPGVFNLVHGFGPNSAGEFISSHPDISAITFTGESRTGTTIMRAAAEGVKPVSFELGGKNAAIIFADCDFDKMLDTMMRALFLNSGQVCLCSERVYVERPLYDRFCAALVERIKGMKIDWPQDPATQMGPLISAKHRDKVLGYFELARTEGATFLAGGGVPHFGDSRDDGAWVQPTVITGLGDDARSVREEIFGPICHVSVFDNEQEVIARANDTRYGLAATIWTSNLGRAHRVSEAMRVGISWVNTWFLRDLRTPFGGAGLSGIGREGGMHSLNFYSELTNVCIRIDEEVADV

SEQ ID NO: 23456 - protein, 582 aa, Cryptococcus neoformans var. neoformans B-3501A
MTMELLKVLHHGASQLFPNCIRSSPVACIVLYSFGGIAILLFTVYLWLWPFQYAKLYFRNLPGPPSDSWFWGVVPTLIKSPPSVPHSMWTDEYGPTVRYRVALGAQRFLTIDPTALNYILSHADLFPKPSRVRKALSDLLGNELLTAEGHTHKKQRKALNPSFSPAAVRGMIPVFYDKAYELKAKLLGIIEGDETEQASPTPCKEEDEVEGGKKIDVMKYLGKTTLDVIGIVGFSYDFKALSEPRNELSEAYSKMFQAGMDANFWDFLRGAIPLVNKLPNKRATEIAARKAVTLRISKKIVEDKKREVMSAHSEGLEKREDIGDDLLSILIKANMASDVKPEQKLSDEEVLDQITTFMLAGNETSSTALTWILYSLTQHPECQKRLREEVLAVPDDRPSLETLNNLPYMDAVIREALRLHAPAPGTMREAKEDTVIPLSMPVIGRDGKQIDSVKINKGTMVFIPIITVNTSPAIWGPDARVFNPDRHFKTSSDSFGGANMHVPGVWGNMLSFLGGARNCIGYKLALAEISTILFVLIRSFEFQELKSKPEVEKKASVVMRPRIKGEESAGLQMPLMVKPLLM

SEQ ID NO: 23457 - protein, 438 aa, Xanthomonas campestris pv. vesicatoria str. 85-10
MSTPQPAPDATGLVRVVSRWQIVGLSINDVIGSGIYLLPAATAALLGPMSLWAVMLAGLAVALLVLCYAQAGSYFDTPGGSYLYTREAFGPFVGFQIGWMIWLTRISSAAALSNGLADAVARFWPTASTDPWARLLVVVGSLGLLTAINVIGVKSAARTGIALVIGKLVPLLLFVAIGLFYVDWSWAFAGTAPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALARDGYGPAFLARVHPRFHTPAAAVLTQGALSLALALSGSFTQLALLSMVTRLFAYIGTAAAVIVLARRYRQRTDTLRLPGGPAIPIAALVLSLGLLASASWQNLAAAGVALLVGWVFYLFPRKQVENG

SEQ ID NO: 23458 - protein, 240 aa, Dichelobacter nodosus
IRVNAADRFLHNKRVTDPEEKTPKLSGRLFIEIFDEESAQKLRTLNGGAGHDYPDVIESLVVKTAKAQVIKSHHNVGGLPEKMNLSLLEPLRMLFKDEVRQLGLALSLPQTMIYRHPFPGPGLGVRILGEVKAEYADLLRQADAIFIQALREYDLYDAVSQAFAVFLPIRSVGVMGDGRRYDFVVALRAVETIDFMTARWAKLPYDFLDEVSRRIINHVSGISRVVYDVSSKPPATIEWE

SEQ ID NO: 23459 - protein, 578 aa, Cryptococcus neoformans var. neoformans B-3501A
MGDQTPTQLIMGSSSRPTSPRPLSANSHSSSGDEKEKKGLMLPPPVPVKTNKGQEDKPVPPRMTRLPSLKQLSEHLHYTPPTPPSQPNLHEQSPGSSSSNPLRISTNPVPLQSSSAASHTSIVMTPTSTGRLKLPASAMMRSLSAGSSGSATGGLAPVTSSPAIAPNLGSVQGQGHSPTSAHSPTPAQQLAKFVPGGLGDFRPESGPEASTSMSRSASHEVRAEHHREIPSLDEIKKKVNVSKGEDQHRLDLPNERVTEKEKSKTSVESTGERISISSAKDGKKEHPLQHSWTLYYDSKTYKPDPSLIASKQGDKILADYEMTLLTVGKFDTVEGFARHFNNVRLPSQLTPSSNYHLFKSGIRPMWEDPANANGGKWVILFRSSPGTLDIAWANLTMALVGEILDPENQVCGIVGSTRPKVDRLQVWTRGKDDVEGLNQLGKRIVEVMALEGRDADSMSMEYQYNTNDSRPPPNKFIHISYANRAPSTPSRSMSSAFQGPPGSLGGMGQARTHSSSGVNLTHPLPLPPHSPAVIKGDHGSGNNATGMKRGLSHGNPLTGPLDLVRQENYGSQEGVTGV

SEQ ID NO: 23460 - protein, 591 aa, Arabidopsis thaliana
MGSYKFCLIFTRKFRMTESGPVEDVRDLFEKYTEGDAHMSPEQLQKLMTEEGGEGETSLEEAERIVDEVLRRKHHIAKFTRRNLTLDDFNYYLFSTDLNPPIADQVHQNMDAPLSHYFIFTGHNSYLTGNQLSSNCSELPIADALRRGVRVVELDLWPRGTDDVCVKHGRTLTKEVKLGKCLESIKANAFAISKYPVIITLEDHLTPKLQFKVAKMITQTFGDMLYYHDSQGCQEFPSPEELKEKILISTKPPKEYLEANDTKEKDNGEKGKDSDEDVWGKEPEDLISTQSDLDKVTSSVNDLNQDDEERGSCESDTSCQLQAPEYKRLIAIHAGKPKGGLRMALKVDPNKIRRLSLSEQLLEKAVASYGADVIRFTQKNFLRIYPKGTRFNSSNYKPQIGWMSGAQMIAFNMQGYGRALWLMEGMFRANGGCGYVKKPDFLMDASPNGQDFYPKDNSSPKKTLKVKVCMGDGWLLDFKKTHFDSYSPPDFFVRVGIAGAPVDEVMEKTKIEYDTWTPIWNKEFTFPLAVPELALLRVEVHEHDVNEKDDFGGQTCLPVSEIRQGIRAVPLFNRKGVKYSSTRLLMRFEFV

SEQ ID NO: 23461 - protein, 1265 aa, Coprinopsis cinerea okayama7#130
MPPQAFSAVDPGSERPRERDRDRERDRDRDRERDRESSSRQGDENTHRRRHRDEHSSSSRPSRSNRILGDYTLSKTLGAGSMGKVKLATHNITGEKLAVKILPRVYPNPPPPGSSGPSAESASRQASKDASKEIRTLREAALSMLLYHPYICGMREMIVHQHHYYMVFEYVNGGQMLDYIISHGRLRERVARKFARQIGSALEYCHLNNVVHRDLKIENILISQTGNIKIIDFGLSNLYNPVSHLSTFCGSLYFAAPELLNAKVYTGPEVDVWSFGVVLYVLVCGKVPFDDQSMPALHAKIKRGLVEYPVWLSAECKHLLSRMLVTNPAARATLNEVMNHPWMIRGFSGPPEIHMVHREPLRVDELDQQVIRGMKGFEFGTEQEIERKLVEILESESYQRAVQNWERKRGSRANLNGNGTFNNGRWGESFSNSSLAISFDSNKSDTPAPKKSRRFSGFEYYRKKLFSPVSSPPGSPMSRSPPNSQHTISTLSDREPGDPTRGFHPLISMYYLAREKMERDKVFGPGQFASSQLSLLDQMSPTAATQPTPHSGNLQQQQHAATNQPHYTAPNVATSRQSTLGARPDYSMPLPRLPPPEASHYSGTSYDNSIAPSPTTPVFSNQPRARDPGLPVPPSPTVASAPPARQHIEISEQQPPTATAPRRGNLPRAPPASTHRRSHSMSQRPSVLSRGWGTMFGSHTAEGVNEHGARIPEPPKTVGPEVTSFNEKELGAISDGERQEHGSGGGGVSPLSSGATLVRKFGSLLVGRGDESRRQQQQQHNQGTIKRGAILNALSPSPRPSAETRSPEEEKHPDNNGVNGSGAAGQGQGLESEEVVVEKPKPIATSVSQPVGSAHRRAATLLDPHGRASRHERRSSTSAAFGSSTVGTGGGGTIGRHRRPSTGYSTTSGRPLADRLFPQRREGDLVEKREDEEGDGELVDSAHPGFDTEEERDDGNATDRDFKPVFLKGLFSVATTSTKPPAAIKLDIRRVLDRMQVQYRETKTGFECIHLPSIDISSIDATSMRQPSHHQSASNDNGRTTPTFNRPSLVKKASKLSFGMKKGKDREPSADKDKEKEKDKTGTGDEAQSRQSTKLTAASGGSSSFFNVGNAEHGASIQDQLNQPPQSNGIASSIISNGDEMPSSASAHQQQGSTISSSSSPQPPRSNSPTATMTSNKAKVLPPIPRDFGASSPTPRARSPSPLPSGEVDREVFEHLGNNSLSVKFEITIVKVPWLPLHGIQFRRASGDGWQYQMLARRVLTELKL

SEQ ID NO: 23462 - protein, 392 aa, Chlamydophila caviae GPIC
MDYYDVLGVSKTASPEEIKKSYRKLAVKYHPDKNPGDAEAEKRFKEVSEAYEVLSDPQKRESYDRYGKNGPFAGAGGFGGMGGMGNMEDALRTFMGAFGGEFGGGGSFFEGLFGGLGEAFGMRGDPAGARQGASKKVHITLTFEEAARGVEKELLVSGYKTCETCLGSGAASEQGIKCCDRCKGSGQIVQSRGFFSMASTCPECGGEGRVITDPCSNCRGQGRIKDKRNVHVQIPAGVDSGMRLKMEGYGDAGQNGAPSGDLYVFIDVEAHPVFERRGDDLILELPIGFVDAALGMKKEIPTLLKEGMCRLTVPEGIQSGTILKVKNQGFPNVHGRGRGDLLVRVSVETPQNLSEEQKELLRKFATTEKAENFPKKRGFLDKIKGFFSDFAV

SEQ ID NO: 23463 - protein, 606 aa, uncultured epsilon proteobacterium
MNIKSYNIKQLENLCKDIRSEILRVVSKNGGHLSSTLGATEIIVAMHKVFDSQNDPFIFDVSHQSYAHKLLTDRWEEFDTLRQFGGMCGYTKPSESKHDYFVAGHSSTSISLGVGAAKAIALKGEQNSRVPVCMIGDGSMTAGMVYEALNELGDRKYPMIIILNDNEMSIAKPIGAISRMLSSAMAGPFYQRFKKHTENFVDNFGEGAHYLAKKLEESLKLITPGIMFEEMGIDYIGPIDGHNLESLIDILQRAKDLKRPVIVHAQTIKGKGYDIAEGHEEKWHGVGPFDLSDGKSSKKSSAKSATQIYTEALMHLAKNNEKIVGATAAMPSGTGLTEPMKVYPTRFWDVAIAEQHAVTSMSALAKEGFKPFCTIYSTFLQRGYDQVIHDTCLMDLPVVFALDRAGIVGEDGETHQGVFDISFLRAIPNMTLFAPRDEKSFHQAMAFASEYQHPCSLRYPRGAFTDTDLPESTHFELAKSQLLLSNNSDILFIGYGNGVGRAYETSKYLDEEVSILDLRFVKPLDEDMLRELSKKYKQWFVFSDSAKMGGVGSAILEFLAKDKILNVEVVSFEYEDEFITHGNTKLVEESLGLLSEQLAQKIKKSL

SEQ ID NO: 23464 - protein, 474 aa, Casimiroa edulis
LANKNLGHIAQIIGPVLDVAFPPGKMPNIYNALVVKGRDTAGQPINVTCEVQQLLGNNRVRAVAMSATDGLTRGMDVIDTGAPLSVPVGGATLGRIFNVLGEPVDNLGPVDTRTMSPIHKSAPAFIQLDTSLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALAMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKAT

SEQ ID NO: 23465 - protein, 505 aa, Pseudomonas syringae pv. phaseolicola 1448A
MSTAKILELMRPYWGDRSVIASYVGGQFIEGHGAPVEVRNAHDDSLLLSFPDADESLVDIADKAAKAAQQQWWALTAQARGRAMYQVGNLIREELENLAQIESLTANKPIRDARVEVLKVAEMFEYYAGWADKLHGEIIPVPTTHLNYVTYEPLGTVLQITPWNAPIFTCGWQIAPAIAAGNAVILKPSELTPLSSLMVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQESIFEKFTNALAVAATQFKVGDPGDPDTQIGPINNAKQYNHVKSMVERALKDGARLVGEQADPIPNKPGYYVNPTVLAGTNELNCAQEEIFGPVVVAIPFKDEEDAIRIANDSRFGLAGGVWTRDVGRAHRVARQVRAGTFWVNGYKTIHVSSPFGGYGESGYGRSSGLDALREYSEVKSVWVETAAKPAASFGYGASLE

SEQ ID NO: 23466 - protein, 567 aa, Shewanella sp. ANA-3
MSITGIIVSSGIAFGQALHLTQAEHHLDYRPIPLSRIPQQQSKFVKALQALQQQLSHSQTKLDPQSENYQLIEADLLLLEDEELIDQVKEAIRTLQLSASVAVERIFAHQANELESLDDPYLANRAQDVRCLGQRLVTAINGRLDQGLAQLTEPTILLAQDLTPAEFALLPKEQLSGIVLKTGGLTSHTAILARAAGIPAILSCQFDAEFIPNGTPLVLDALSGELFVNPAPELQARLTVTLHHEQARRAALQAYRDVPAKTQDGHLVGLMANVGNLNDITHVGDVGADGIGLFRTEFMLMHTSTLPDEKAQYNLYCEALHALGGKTFTIRTLDIGADKELPCLCQEVEDNPALGLRGVRYTLAHPELFKTQLRAILRAANHGPIRLMFPMVNQVEELDQIFALIAECQDALEEEEKGFGELSYGIVVETPAAVMNLASMLPRLDFVSIGTNDLTQYAMAADRTNPQLTRDYPSLSPAILGLIKMTVDQAKAAGVKVSLCGELASSPLMVPLLIGMGLDELSVNLSALLEVKAAVCQGQLTKFSALAHTAMQQNRISELQQCITSYK

SEQ ID NO: 23467 - protein, 163 aa, Streptomyces coelicolor A3(2)
MEFDVTIEIPKGSRNKYEVDHETGRIRLDRRLFTSTAYPTDYGFVENTLGEDGDPLDALVILDEPTFPGCLIRCRAIGMFRMTDEAGGDDKLLCVPSTDPRVEHLRDIHHVSEFDRLEIQHFFEVYKDLEPGKSVEGADWVGRTEAEAEIERSYKRFKDQGGH

SEQ ID NO: 23468 - protein, 270 aa, Streptococcus agalactiae 2603V/R
MTEQFLKDNFSLEGKVALITGASYGIGFSIATAFARAGATIVFNDIKQELVDKGISAYKKLGIKAHGYVCDVTDEDGINEMVDKISQDVGVIDILVNNAGIIKRTPMLEMSAADFRQVIDIDLNAPFIVSKAVLPGMIQKGHGKIINICSMMSELGRETVAAYAAAKGGLKMLTKNIASEYGSANIQCNGIGPGYIATPQTAPLRERQDDGSRHPFDQFIIAKTPAARWGEAEDLGAPAIFLASDASNFINGHILYVDGGILAYIGKQPQ

SEQ ID NO: 23469 - protein, 219 aa, Francisella tularensis
MNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGL

SEQ ID NO: 23470 - protein, 335 aa, Streptococcus agalactiae 2603V/R
MSKILFFGEPLIRITPKENDYFADSISTKLFYGGSEVNTARALQGFGQDTKLLSALPNNPIGNSFLQFLKAQGIDTHSIQWVGERVGLYFLEDSFACRKGEVVYDRDHSSLHDFRINQIDFDQLFEGVSLFHFSGITLSLDESIQEITLLLLKEAKKREITISLDLNFRSKLISPKNAKILFSQFATFADICFGIEPLMVDSQDTTFFNRDEATIEDVKERMISLINHFDFQVIFHTKRLQDEWGRNHYQAYIANRKQEFVTSKEITTAVNQRIGSGDAFVAGALYQLLQHSDSKTVIDFAVASASLKCALEGDNMFETVTAVNKVLNQSKDIIR

SEQ ID NO: 23471 - protein, 569 aa, Candida albicans SC5314
MSITRLSSAKLLLSSTSRKLQVLRLNSTTTKPLTPRQKWPELLDSDFIVNSQGEKQPDYVKLILTSRVYDVVDEAGTPLTNAINLSHRCGANIYLKREDLLPVFSFKLRGAYNMIAHLHSNSPQPISGVIACSAGNHAQGVAFSSSKLNIPATIVMPTPTPSIKYTNVSRLGAQVVLYGDDFDSAKQECERLSTEQNLINIPPFNHPYVIAGQGTIALEIARQLRLDKLNAIFVPVGGGGLIAGVAVYLKHIAPHVKIIGVETYDADALNQSLKNSRSVTLEKVGLFADGTAVKVLGDETWRLAKEYVDEVVLVNTDELCAAIKDIFEDTRSIVEPSGALSVAGLKKYIEEHPEIDHRDKTYVPVLSGANMNFDRLRFVSERAVLGEGKEVSLAVTIPEKPGEFARLQKVINPRAITEFSYRYNGEENADIFVSFNVVDKKKEKSSVIAAMENCGFEVVDISENELAKSHGRYLVGGKSQSTKSSNEKIYQFEFPEKPNALFNFLQALRSDWNISLFNYRNHGHDVGKILCAFTLPEGSEEDFQEFLKNVGYTFVDESDNIFYKKFLRS

SEQ ID NO: 23472 - protein, 438 aa, Pseudomonas syringae pv. phaseolicola 1448A
MATPPETPSLRRAITAPMLTLFILGDVLGAGVYALAGTIAGRVGGAIWAPLLIALCFALLTAASYAELVTKYPRAGGAAVYAEKAFGKPLLSFLVGFSMVAAGVTSAAGLAVAFAGDYFQALVSWPAQWVCVGFLVIVALLNARGIKESLSANLVMTLIELSGLAMVIAAAVWFVSQGNGVPQRVFELDTNSPATAILAASLLAFYSFVGFETSANLAEEIKDVRRIYPRALFGALLIAGVVYMLVGVGAAMVLPVEQLKASQAPLMDVVSASGLGIPAPWFAVIALIAVANGALLTMIMASRLTFGMAREGLLPAVMGSVLPQRRTPGVAIFATTVVAIALSFTSTLTTLAETVVLLLLFVFLSVNIAVLVLKRDKVEAGHFQVHWVIPVLAILSCLLLLTQQGPETWLRAGMMLAVGVALYGLTRLGSSVLVSHPR

SEQ ID NO: 23473 - protein, 363 aa, Bordetella parapertussis 12822
MSSPRTYRIAAIAGDGIGREVMPEGLRVVRAAARRFGLDLDIVTFDWAHCDYYREHGQMMPDDWKAQLAGMDAIYFGAVGWPATVPDHVSLWGSLLKFRREFDQYINLRPVRLFEGVPCPLAGRQPGDIDYLVVRENTEGEYTSAGGVIYEGTEREIVIQESVYSRYGADRVLHYAYALADSRPRRRLTVATKSNGIAISMPWWDKRADAVGQQYPGVAVDKQHIDILSARFVLQPDRFDVVVASNLFGDILSDLGPATTGTIGLAPSANLNPERKFPSLFEPVHGSAPDIYGQNIANPVAMIWSGALMLDFLTEGAGAGRAAHDAIVAAIEQVLAHGPRTRDLGGTASTDAMGEAIAARLAA

SEQ ID NO: 23474 - protein, 585 aa, Shewanella sp. ANA-3
MKFPSLVSLMPGLAQMLQYEKQWLRDDVRAGLSVAAVALPVAIAYAQLTGVNAAVGLYSCVLPMLVYALFGTSRQLIVGPDAATCAVIAAVVTPLAAGDSMKHWQLVMTMTAMTGFWCLIASRFRLGVLADFLSKPILMGLLNGVAITIIVGQFSKIFGFTFDERYLIERLSGAPSYLTRTHWPTLLMGVVTLATYALVKRYRPQWPASMCAMAMAAFLVWAFNLTSLDINVVGEVSAGLPSFQAPVFDIGIARELVVPALNLAMVSFVSMMLTARSFAAKNGYDIDADKEFRALGIANIASALSQGFAVSGADSRTAVNDANGGKSQLVSIIAAVLIALVALFFTAPLKYIPSSALGVVLVIASISLIDLKALWNLRVRDRSAFLLACTTLFSVLFIGVIPGITLAVLLGLFQFLATVMRPTDQVLGLDQKGVIRSVDDSGKAKSVPGVFIYRFNSPLTYFNATYFKRRLLEKFIREPEPVDCIIIDAVPCFTHLDLSVMAMLADLHQLLKKRGIRLVLAGRKRQMLGWFEQAGMQSGEGGILIRPDLYLALKMNQSYKQALAEGQAPVIKKDPEDDVLLHSHL

SEQ ID NO: 23475 - protein, 700 aa, Oryza sativa
MARSGRERRDQEEEEAAVVSVERVFEGRVVPGWKEQVTLRALAVSALLGAMFSVIVMKLNLTTGIIPSLNVSAGLLGFFLLTSWTKFLDKVGVASVRPFTRQENTVVQTCVVACSGIAFSDADLCTGGTGGFGSYIFAMSDRISDQSGEARDEHNIKNPSLGWMIGFLFIVSFLGLFSVVPLRKIMIIDYKLIYPSGTATAHLINSFHTPQGAKLAKMQVKMLGKFFVMSFSWGFFQWFYTGGDGCGFMSFPTLGLEAYRNKFFFDFSATYVGVGMICPYLVNISVLLGGVMSWGIMWPLIEHKKGDWYPADLKPSSLRGIVGYRVFISISLILGDGLYNFLKVMTRTTTALVMQVRAMMSEPTLPVSGGGGGGGGQTPEETFDDKRRTELFLKDQIPNWLALSAYVVIAVVSIATVPRIFHQLRWYHVAVSYVVAPVLAFCNAYGCGLTDWSLATTYGKLAIFTVGAWADASDGGIIAGLAACGVMIGIVSTASDLTQDFKTGYMTLASPRSMFVSQVIGTAMGCVIAPSVFWLFYKAFHDIGMPGSEYPSPNALVYRNMAILGVQGLGSLPKHCLDLCIGFFVAAIAVNLARDLAAPKVARFLPLPMAMAIPFYLGPYFGIDMCIGSLIRFVWDRLDGARAKAFAPPVASGLICGDGIWTLPQSVLALAGVKPPICMKFLSRTTNIKVDAFIAKLPSS

SEQ ID NO: 23476 - protein, 222 aa, Desulfitobacterium hafniense DCB-2
MFGQIKQDIKVIFERDPAAKTIVEVILCYPGLHALIAHRLAHCLYKKNMVLIPRLISQTSRFFTGIEIHPGAKIGQGLFIDHGMGVVIGETAEVGDNVTIYQGVTLGGTGKEKGKRHPTVGNNVFIGSGAKILGSIKIGDNVKIGAGSVVTKPVPSNTTVVGVPGKVVSRHGMPLKELHVVTKSVCNKEIRAEEMPDPVQETLQILMERINYLEKKLGEKES

SEQ ID NO: 23477 - protein, 341 aa, Bordetella parapertussis 12822
MLHLAKFPRIKLGHFPTPLEFMPNLTRHLGGPNLYIKRDDCTGLATGGNKTRKLEFLVAQAVAQGADTLITQGAVQSNHARQTAAAAARVGMKCKILLEERVPHPDDDYSHSGNVMLDGLMDGEIVARLPAGTDMQQAMEDLARELAGRGSKPYVIAGGGSTPVGALGYVACAQELLHQSFETGLRIDHVVHATGSAGTQAGLVVGLRAGNSGIPVYGISVRAPKPRQEENVWKLVQSTVDYMGLPASAVERADVVANSDYVGEGYGISTDAMIEAVHMTAALEAILLDPVYSGKGMAGLIGLIRSGHFKQGENVVFVHTGGAVGLFGYRRAFEGLPPLAA

SEQ ID NO: 23478 - protein, 78 aa, Zea mays
TPFRDTLGRTLGLTLGRTLGRTLGAILTEGTKLITVNPNTKVLQAMQLITKNRLKNIPVINGPGILGMVSIGNFFPPL

SEQ ID NO: 23479 - protein, 314 aa, Dendrobium hybrid cultivar
MELLEGSQRSDAMAVLRDACENWGFFELLNHGISHDLMNRVETVNKEHYRRFREQRFKEFAAKTLDSGENVVADNLDWESTFFLRHLPTSNISQIPDLDEDCRTTMKEFALELEKLAERLLDLLCEDLGLEKGYLKRVFCGGSDGLPTFGTKVSNYPPCPKPELIKGLRAHTDAGGIILLFQDDKVSGPQLLKDGEWVDVPPMRHSIVVNIGDQLEVITNGRYKSVMHRVVAQTNGNRMSIASFYNPGSDAVIFPAPELVEKEAEEKKKEVYPKFVFEDYMKLYVRQKFEAKEPRFEAMKTMDTVISSQPIPTA

SEQ ID NO: 23480 - protein, 630 aa, Magnaporthe grisea 70-15
MSTINESPPPTYTKEAPQQTATEERHVQSDEESAVVKTQDGVKAMEAVSMTWSKWGLIVAYLGAFATSSFQSHSLLSTVTVVQSVVLAVMKPIMSKVSDVTGRLEAFTLSIVLFVLGFIQQAASTSIDSYASAQIFYSAGSTGVQILQQIFIADTSNLLWRALFSSLPDIPFLVTVWVGPEISARMLEQGSWRWRWGYGMWAIILPVAFLPFAISLFLNQRKAKKLGVLDDRGDWISAIKRQGPATTFIKMVQSVDLFGILLLSAGFALLLIPLTIATRQTGGWGNGSIIAMLIIGAISLIAFCFWECASARINPHPLIPLYLFKSKTFCAGCGIAFFYFMVFYLSVFPYYNSYLLVVHRMDIATAGRITQVFSFSSTVMSVLVSLAIRYTKHYKYFITAGSLLYLLGIALMINYRSENAGMPALIGTQVCIGVGGGMLNVPTQLGVQATAKHQNLAIATAVWLTVLELGGAVGSAISGAIWTKVVPATLTELLPEASRANATMIFNNVNTAMALEWGSPERMAINAAYQAGMRQMLIVAVCMCVPIVLLSLLMRNMKLDEVDQGVKGYVIGGRVDGDSKKDANTAVASSSGVAAGPQHHQQEQDQPVQEATKSDQVVDRSTATSPEIRG

SEQ ID NO: 23481 - protein, 195 aa, Synechococcus sp. CC9311
MANLDQAPSRSMPNLLHVLPAFADEADLRLNTIVELNSNTINKYELITETGHLKLDRVGYSSLAYPFAYGCIPRTWDEDGDPLDIEIVNVTEPLIPGSIVEARIIGIMTFDDGGEVDDKVIAVLADDKRVDHIKSFEDLGEQWKKETTYYWEHYKDLKKPGTCTVNGFFGTEKAVEIIKSCEARYMADIDPKLVD

SEQ ID NO: 23482 - protein, 358 aa, Medicago truncatula
MMSSLTTTLKLLFFYVIFILPILVSCDSCKCETEQTKENSEKNEALHYKLGSIASVLVCGALGVSLPLLSKRIPILSPKNDIFFMIKAFAAGVILATGFIHILPDAFESLNSPCLKEKPWGDFPLAGLVAMLSSIATLMVDSFASSYYQKRHFNPSKQVPADEEKGDEHVGHVHVHTHATHGHAHGSATSSQDSISPELIRQRIISQVLELGIVVHSVIIGISLGTAQSIDTIKPLLVALSFHQFFEGMGLGGCISQAKFESRSTAIMATFFSLTTPIGIAIGMGVSSVYKDNSPTSLIVEGVFNSASAGILIYMALVDLLAADFMSPRMQNNFKIQIGANISLLLGSGCMSLLAKWA

SEQ ID NO: 23483 - protein, 306 aa, Burkholderia sp. 383
MSTSPARQWGLEEIVAGLRESREELHRTRHPRGIRELPSRDAICKIVTGLRASMFPTHYGAPDLTDESVDFYVGHTLESTLRILSEQIRRALPFLPEHVDTPFAELDERAFEIAREFGRQLPAVRALLVSDIQAAYAGDPAAQHITEILLCYPGVLAMMHHRLAHALHRLGVPLLARFINEIAHSATGIDIHPGAHIGPSFFIDHGTGVVIGETAIIGERVRVYQAVTLGAKSFPADGEGALVKGNARHPIVEDDVVIYAGATILGRVTIGRGSVIGGNVWLTHSVPPGTSVAQGKVREGGSADKP

SEQ ID NO: 23484 - protein, 88 aa, Triticum aestivum
  misc_feature (38)..(38): Xaa can be any naturally occurring amino acid
  misc_feature (47)..(47): Xaa can be any naturally occurring amino acid
  misc_feature (62)..(62): Xaa can be any naturally occurring amino acid
MDSFSSSPSSSGPGANPDVVMEQIKTQLAQAYAQEFLXETVGNKCFXKCVTKPGSSLSGKRXAAAYTCVDRYIEALGIVSRALFTSQR

SEQ ID NO: 23485 - protein, 294 aa, Coprinopsis cinerea okayama7#130
MAGTYGVVYKARDTSTNTIVALKKIRLEAEDEGVPSTAIREISLLKELKDDNIVKLLDIVHADQKLYLVFEFLDVDLKRFIETGNQNRSPITPALVKVGSRPSDTGREPKFTHQLNSGLLYCHSHRILHRDLKPQNLLIDKHNNLKLADFGLARAFGIPMRTYTHEVVTLWYRAPEVLLGSRHYSTAIDMWSVGCIFAEMAMQGAPLFPGDSEIDQIFKIFRLLGTPNEDIWPGVSTLPDYKPTFPNWSRQDLAKAVPTLDEAGIDMLKRTLTYDSAKRLSGMLVSIFAICGCG

SEQ ID NO: 23486 - protein, 487 aa, Helianthus tuberosus
MDKRCVGGYSKRSSAEIIPFLKTWVNLPMAIGFMVLYTKLSNVLSKKALFYTVILPFIAFFGAFGFLLYPLSNYVHPTALADKLLALLGPRFLGPLAIMRIWSFCLFYVMAELWGSVVVSVLFWGFANQITTVEEAKKFYPLFGLGANVALIFSGRTVKYFSNMRKHLGPGVDGWAISLKYMMSIVVVMGLAICGLYWWVNTYVPLPTRSKKKKEKPNMTTMESLKFLASSPYIRDLATLVVAYGISINLVEVTWKSKLKAQFPSPNEYSSFMGDFSTATGIATFTMMLLSQWIFNKYGWGVAAKITPTVLLLSGVGFFSLILFGDPLAPGLMKFGITPLLAAVYVGAMQNIFSKSAKYSLFDPCKEMAYIPLDEDTKVKGKAAIDVVCNPLGKSGGALIQQFMILTFGSLANSTPYLGGVLLVIVGAWLGAARSLDKQFTALRQEEELEKEMERAAVKIPIVSTNGSLESDSSTNTSTETSSPQNV

SEQ ID NO: 23487 - protein, 180 aa, Zea mays
MAAPPDSKSDKSPEELLCAAAEAGNDDAIAEIISSGADPTYFDASGMTPLMRAASGGHAAAARLLLDAGAPWNALSPEGLSAGDLTSDPATYDLLLDHALRSELILGTVARRQAASANSSDGVPAETYLDSRISFSEDRVMDAESKAVMMEWERPLMEAHARAVCAAGGGKVLNVGFGMG

SEQ ID NO: 23488 - protein, 117 aa, Populus trichocarpa x Populus deltoides
MAGVQDQLEIKFRLADGSDIGPKTFPAATSVATLKENILAHWPKEKENGPRTLKDVKLISAGKILENNRTVGECQSPLCDIPGGVTTMHVVVHPSSVEKEKKAANQPRQSKCVCVIL

SEQ ID NO: 23489 - protein, 479 aa, Sphingomonas sp. tfd44
MTYPDTRLFIGGRWQDAADGRSLAVQNPATGLEIGRVAHCGRADLDRALDAAQRGFEIWRDLTPAERSKIMRRAAGLMRERADEIARLLTQEQGKPLHEAKIEAMAAGDIIEWFAEEGFRLYGRLVPHRTDIAIRQMVIKDAVGPVAAFTPWNFPINQVVRKISAALAAGCSMIVKAPEETPASPAELIRAFQDAGLPDGVLNLVFGDPAEISNYLISSPIIRKITFTGSTPVGKLLASLAGKHMKRVSMELGGHAPAIVCEDADIGLAVKSLSASKFRNAGQVCIAPTRFLVHSSIKHAFADALAAAARDLRVGDGFADGTQIGPLANSRRLAAMAEFQQDAIEKGATLLTGGNRVGDVGNFWAPTVLSDVPLEARLFNDEPFGPVAGIRSFDRLEEAILEANRLSFGLAGYAFTKSLATADILARRVEVGMLWVNSPATPTAELPFGGIKDSGYGTEGGPEALDNYINPRAVVVANV

SEQ ID NO: 23490 - protein, 398 aa, Burkholderia xenovorans LB400
MNSVTEPLVRLAARVDAIQPFYVMELAKEAALLERDGRDIIHMGIGEPDFTAPEPVIEAAASALRRGVTQYTNALGLHALREAISAHYADFYGVSVDPARIVVTAGASAALLLACAALVDRDDEVLMPDPCYPCNRHFVIAAEGKPVMVPSGPAERFQLTAADVERLWNERTRGVLLASPSNPTGTSIEPAELERIVKAVRARGGFTIVDEIYQGLSYDAKPISALSFGDDVITVNSFSKYFNMTGWRLGWLVVPPGMVSAFEKLAQNLFICASALAQHAALACFEPDTIAIYEARRLEFKRRRDFIAPALQSLGFSVPLMPDGAFYVYADCRTVAHPAAGDSAALTRAMLHDAGVVLVPGMDFGTHAPKDYIRLSYATAYPKLEEAVGRLAKLFGKD

SEQ ID NO: 23491 - protein, 315 aa, Escherichia coli
MRKFIRGSEMDIAVIGSNMVDLITYTNQMPKEGETLEAPAFKIGCGGKGANQAVAAAKLNSKVLMLTKVGDDIFADNTIRNLESWGINTTYVEKVPCTSSGVAPIFVNANSSNSILIIKGANKFLSPEDIDRAAEDLKKCKLIVLQLEVQLETVYHAIEFGKKNGIEVLLNPAPALRELDMSYACKCDFFIPNETELEILTGMSVDTYDHIRLAARSLVDKGLNNIIVTMSEKGALWMTRDQEVHVPAFKVNAVDTSGAGDAFIGCFSHYYVQSGDVEAALKKAALFAAFSVTGKGTQSSYPSIEQFNEFLTLNE

SEQ ID NO: 23492 - protein, 345 aa, Yersinia pseudotuberculosis IP 32953
MKYIKLTVLAGIFVGISSPVFALPNITLLATGGTIAGGGDSATKSNYTAGKLGVDALVEAVPAIKDIANIQGEQVVNIGSQDMNDDVWLTLAKKINKDCTKTDGFVITHGTDTLEETAYFLDLTVNCDKPVVIVGAMRPATALGADGPLNLYNAVVVASEADSAKRGVLVAMNDMVFTGRDVVKTNTTSVQTFQSPNTGPLGYIYDGKVNYLHQPAARQPAFDISKLNTLPKVGIIYNYANASDIPAKALIADGYQGIVSAGVGNGNLYHTVFDTLATAASHGVAVVRSSRVPSGSTTEGAEIDDAKYGFVAAGALNPQKARVLLQLALTQTQKPQEIQKLFHTY

SEQ ID NO: 23493 - protein, 249 aa, Brassica napus
MEEKLKYLSLVGAGALMGSVSTVALLKLLSRSSVKQQHDETPLTKLLEKNPTTTTVTAAIGQDLLADEIVSEHLTRNIQFFDLEAQRKVTGSYVVVIGLGGVGSHAASMLLRSGVGKLLLVDFDQVSLSSLNRHAVATRADVGIPKAVCLKKHFSAIFPECHVEAKVLLYDSSSEEEILSGNPDFVLDCIDNIDTKVGLLAACVKRGLKVLSATGAGARADPPRIRVADLRESTIDPLSRSVRHRLRRE

SEQ ID NO: 23494 - protein, 158 aa, Glycine max
  misc_feature (114)..(114): Xaa can be any naturally occurring amino acid
  misc_feature (145)..(145): Xaa can be any naturally occurring amino acid
ALSMIASITDTTVNLAGAGLDATSTGLKPMVGCPTMKTNNDITYIANNGGRAQCMQVWTPFGSKKYETLSYLPDLDEAQSAKEVEYLIKKGWITCLEYKLDHSFLYRELKMPPXYFEGLSWSLWKVPMFGSTDTSHVLNELQYAXTAYPDSQIRIIGF

SEQ ID NO: 23495 - protein, 512 aa, Glomerella cingulata
MKRKNVKGLALTPAAPKPPPTAETSRHGYDPRDKDGGEQSAQLEIGIEYKLDLRPEDLEILKELGSGNGGTVSKVKHVLTGTVMARKVIHVEAKKEMRKRIVRELQIMHGCSSEYIVNFYGAFLNPHNDVIMCMEYMDVGSLDRVSKVFGPVRVDVLGKIAVATLGGLTYLYSKHHIMHRDIKPSNILVNSRGSIKLCDFGVSGELINSVADTFVGTSTYMAPERIQGEKYTVKSDVWSFGLSIMELAIGKFPFNASEQLSDGECAPAAFGSVTADCTEPGPKLPKSDAFPSILEDMIQKCLFKNPDERPTPQELFDRDPFVQAAKRTPVDLREWAVGLMERDNRKSHLAPQLSPATRDLLNSSDSPTYQGGSTNDRSLDTPTSGEIPIAGAGIISPREPATHSNRSPTRNGINAISSRQQAAGHPGMGQRIVTTNSIPKVGEYPNSAGPVSANAASFSLPVRPAPGGPLPPAPPRKGTPDETRRENRRQATFGMPPAPRSYASDVYNGTSN

SEQ ID NO: 23496 - protein, 475 aa, Saccharomyces cerevisiae
ARTDNFKLSSLANGLKVATSNTPGHFSALGLYIDAGSRFEGRNLKGCTHILDRLAFKSTEHVEGRAMAETLELLGGNYQCTSSRENLMYQASVFNQDVGKMLQLMSETVRFPKITEQELQEQKLSAEYEIDEVWMKPELVLPELLHTAAYSGETLGSPLICPRGLIPSISKYYLLDYRNKFYTPENTVAAFVGVPHEKALELTGKYLGDWQSTHPPITKKVAQYTGGESCIPPAPVFGNLPELFHIQIGFEGLPIDHPDIYALATLQTLLGGGGSFSAGGPGKGMYSRLYTHVLNQYYFVENCVAFNHSYSDSGIFGISLSCIPQAAPQAVEVIAQQMYNTFANKDLRLTEDEVSRAKNQLKSSLLMNLESKLVELEDMGRQVLMHGRKIPVNEMISKIEDLKPDDISRVAEMIFTGNVNNAGNGKGRATVVMQGDRGSFGDVENVLKAYGLGNSSSSKNDSPKKKGWFHHHHHH

SEQ ID NO: 23497 - protein, 165 aa, Rhizobium etli
MNPMQANAQQLIQDLKQRLLQEVVSEQDCHIGIAPISIALLSVKAQLDDASVEIATVARDVSRMAGTGAYTGEVSADLLVDSGIQFVLIGHSERREIFGDNPQILSDKIHYALNANMTIIYCVGESLEQRESGQAEQIVLQQICDVASVVKAEQWHNIIIAYEPI

SEQ ID NO: 23498 - protein, 272 aa, Oryza sativa Japonica Group
MAHLATVVLLLVAAARQAPLAAGDHSANPRLPTCAAAPDVAAPQEHGDGGGVGGGRRILDITHAVRAELPVLGSCDGVGALVRLKKSMANGSRSNLSELRMSVHTGTHVDAPGHMWQPHFDAGLDVDTLDLGLLNGPALLVDVPRHSNVTAEVMESLNIPRGVRRVLFRTMNTDKRLMWQKESDLSFVGFTEDGAQWLVGYTDIKLVGVDYLSVASYEHMIPAHVVFLKSKEIVIVEALKLDDVEPGMYMLHCLPLRLAGAEGSPVRCILIK

SEQ ID NO: 23499 - protein, 165 aa, Rhizobium etli
MNPLQTDAQTLLRGVKDLLESTPISAEKCHLGVAPVAIALTQVQAELASAVRPVYTVAQDVSRIAGMGAYTGEVSAELLADSGIGYVLVGHSERREIFGESREILNTKIKNALNAGLTVIYCVGESLEQREAGQAEAVVLQQICDIAAVVEAEQWKNIVIAYEPI

SEQ ID NO: 23500 - protein, 475 aa, Streptomyces coelicolor A3(2)
MSLHQGPRPSRDSDRDRRRLAVNPFHAAANPLGGMTEAPPAHRLPDSPLPPESAYRLVHDELMLDGNARLNLATFVTTWMEPQAGVLMSECRDKNMIDKDEYPRTAELERRCVAMLADLWHAPDPSTAVGCSTTGSSEACMLAGMALKRRWALRNADRYPAKDVRPNLVMGVNVQVCWDKFCNFWEVEARQVPMEGDRFHLDPQAAAELCDENTIGVVGILGSTFDGSYEPVADLCAALDALQERTGLDVPVHVDGASGAMVAPFLDEDLVWDFRLPRVASINTSGHKYGLVYPGVGWALWRDAEALPEELVFRVNYLGGDMPTFALNFSRPGAQVVAQYYNFLRLGREGYRAVQQSARDIAGSLAERVAALGDFRLLTRGDQLPVFAFTTADDVTAYDVFDVSRRLREGGWLVPAYTFPPHREDLSVLRVVCRNGFSADMADLLLADLERLLPELRRQPGPLTRDKGAATGFHH

SEQ ID NO: 23501 - protein, 366 aa, Cryptococcus neoformans var. neoformans JEC21
MTIDQSQINFNVPSTYKLEEIVGEGAYGLVVAGTHLPSGTQVAIKRITPFDHTMFCQRTLREIKLLRHFHHENIISILDLIQPESYEVFNEVYLVQELMETDLHRVIRSQELSDDHCQYFVYQTLRGLKALHSADVLHRDLKPSNLLLNANCDLKICDFGLARSSAKPPPGTSDGGQGFMTEYVATRWYRAPEVMLSFQEYTKAIDLWSVGCILAEMINGKPLFPGRDYHHQLSLILQVLGTPTMDDFNEITSQRSKDYLRALEFTRRQDFSAICPKAKPAAVDLLKQTLTFSPSKRITVEEALMHSYVEAYHDPHDEPNAEPLKPGFFDFEFHQEKLSRDQWKRMIYDEVQDPVPTILSQWTESH

SEQ ID NO: 23502 - protein, 269 aa, Triticum aestivum
MYDNYRNPHPPGMQMPPPNPQPGPYDNPLYGASSGLIKTGLGVYGEKFFGSSSEFMQSNISRYFSNPQYYFHVNDQYVRNKLKVILFPFLHRGHWTRISEPVGGRLSYKPPMYDINAPDLYIPFMAFGTFIILAGFTLGFMGKFTPEAINLQFTRGLIGWGLQIVFLKGLLYSMGGGEVPLLDLVAYSGYLFAGLSLAIVARLLWAYSYYVMMPWMSLCMGIFLVRTMKRVIFTEMRGSERHSTRQHYFLLFMAIVQFPLFFWLGSIGA

SEQ ID NO: 23503 - protein, 486 aa, Streptomyces coelicolor A3(2)
MSSYFTDLAQQYIDGEWRPGTGSWDIIDFNPYDNEKLASITIATVDEVDAAYRAAERAQRQWAATNPYARRAVFEKALRLVEEREAEIGEAIVAELGGTRLKAAFELHLAKEFLREAVHLALAPEGRIIPSPVDGKENRVYRVPVGVVGVISPFNFPFLLSLKSVAPALALGNAVVLKPHQNTPIVGGTLVAKILEDAGLPGGLLNVVVTDIAEIGDAFIEHPVPKVISFTGSDKVGRHVATVCAANFKRSVLELGGNSALVVLDDADVDYAVDAAVFSRFVHQGQVCMAANRVLVDRAVADEFTEKFVAKVSGLKVGDPRDPSTVIGPVINSSQADALSGVVEQALAEGATALVRGSVTDNLVEPSVLTGLPADSALLRQEVFGPVAFLVPFDGEEEAVRLVNDTPYGLSGAVHTGDVERGVNFAKRIDTGMFHVNDGTVHDEPIVPFGGEKHSGLGRLNGDTMLDAFTTQKWISVQHGRSGFPF

SEQ ID NO: 23504 - protein, 297 aa, Magnaporthe grisea 70-15
MASSGSAVSAVEQAQLIEMAKKAAAFTAVKDHLDPRYTHVGIGSGSTVVYVVEAIKELHPEASKDMTFYPTGDQSKGLIKAGGLRAAPIEDRPQGSLLDVYFDGADEADADLNLIKGGGGCLWQEKIVAVASRTFVCIGDFRKLSRNLGTQWKQGIPIEVLPKAADHVLAELERLGAHSPRLRSGSGKAGSVVTDNGMHIIDAPFTPLLLAGDEGGTGENGIWSVDRLAAKLKSLVGVCEIGLFYGRSGLDAKDEGGAQKPVAAYFGMADGSVQILNQGSPPVTLTTSSTGGSDGSK

SEQ ID NO: 23505 - protein, 143 aa, Shewanella sp. ANA-3
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAESIDENAAHGSDALESAAREIAYFFSAEELCPRTR

SEQ ID NO: 23506 - protein, 230 aa, Lactobacillus plantarum WCFS1
MAKLVLIRHGQSEWNLSNQFTGWVDVDLSEKGVEEAKAAGQKVKEAGLEFDYAFTSVLTRAIKTLHYVLEESDQLWIPETKTWRLNERHYGALQGLNKKETAEKYGDDQVHIWRRSYDVLPPLLSADDEGSAVNDRRYADLDPNIVPGGENLKVTLERVMPFWEDQIAPKLLDGKNVIIAAHGNSLRALSKYIEQISDDDIMDLEMATGEPVVYDFDEKLKVLGKEKLGK

SEQ ID NO: 23507 - protein, 387 aa, Streptococcus agalactiae 2603V/R
MSENLGQLAINQARENGGKLEVISKVKVEDKRDLSIAYTPGVASVSSAIAEDVELAYELTTKKNTVAVVSDGSAVLGLGDIGPEAAMPVMEGKAALFKRFANVDAVPIVLKTNDTEEIISIVKAISPTFGGINLEDISAPRCFEIEQRLIEECDIPVFHDDQHGTAIVVLAALFNSLKLVKKDIEDIRVVVNGGGSAGLSITRKLLSAGAKHVTVVDRFGIINDKDRESLAPHHKAIAKLTNREFQSGSLEDALENADVFIGVSAPEALHAEWISKMADKPIVFAMANPIPEIYPDQALKAGAYIVGTGRSDFPNQINNVLAFPGIFRGALDARAKTITVEMQIAAARGIASLIPEEELSTTHIIPNAFQNDVADVVAKSVSNAVQK

SEQ ID NO: 23508 - protein, 792 aa, Oryza sativa
NRAPSSRARTVVQQLAVLLLLLGGVGGGGGALLAAAASTTDTILPGESITGNQTLVSKNGEFELGFFNPGVGIHYFLGVRLRKLAAYSPTFWIGDRVYVVDLPRAALELFGDSLYIKEDGASLWWSSPSSSSSSSGGGRGGGAAVAVLLDTGDLVVRDQRNSSLVLWRSFDYPGDALLPGGRLGLDVATGENVSLTFEGFTHNGSLRADASRRNGFVLTTDGRDTRGAFPDWMVTTQDNGGSLVLNHPDATNSTEFLQLKVGQVSLVRWSGADAGWVPRWTFPSGCKSGGGFFCGDFGVCTTATGGECRCVDGFAPSDTKEWGLGYFVTGCSRSLPLSCDANGQTEHGDSFAILDNLQGLPYNAQDEPATTDEDCREACLNKCYCVAYSTETGCKLWYYDLYNLSSADKPPYSKIYVRLGSKLKSKRGLATRWMVLLVVGSVAVASAMLAVLLLCRYRRDLFGSSKFVVEGSLVVYSYAQIKKATENFSDKLGEGGFGSVFRGTLPGSTTVVAVKNLKGLGYAEKQFRAEVQTVGMIRHTNLVRLLGFCVKGNRKLLVYEYMPNGSLDAHIFSQKSSPLSWQVRYQIAIGIARGLAYLHEECEHCIIHCDIKPENILLDEEFRPKIADFGMAKLLGREFNAALTTIRGTRGYLAPEWLYGQPITKKADVYSFGIVLFEMISGIRSTVTMKFGSHRYYPSYAAAQMHEGDVLCLLDSRLEGNANVEELDITCRVACWCIQDREGDRPSMGHVVRMLEGVVDTEMPPIPASFQNLVDGDDSDIYEENWRLRTQD

SEQ ID NO: 23509 - protein, 207 aa, Brassica napus
MAIHKSLFASLLICLLFQISHGATKERLFSDLEKGALEVTAKPSRESVLDAGIDKLSITWKLSSTATKEAEFTTIKVKLCYAPVSQVDRPWRKTENELFKDKSCPHKIITRAYDKSPQSFEYTLERDIPTGTYFVRAYAVDAKDHEVAFGQSTNEAKSTNLFSVQAISGRHKSLDIASICFSVFSVLALLVFFVNEKRKAPRGRKWP

SEQ ID NO: 23510 - protein, 484 aa, Oryza sativa Japonica Group
MASSGSSTVVGEMESSLERVRRQLSSTSSRHLLQGPLLKRSDTLRKWNERWVILDPATGKMEYKIRRSDAAVRGIIVFDSTSTVTLSPMNFHGLPKYDGCCFYIGTPQKKEYFLCAETPSAARAWVSTLHASQLVLQAHKEAVNSLGGNGPTKLGKVATVVAVANATAIEASKEVEAAMKVSLRAALGSTTNKLSKGQLDDLTIMMETLRVKDDELHQLLQDIRARDATIREITDKLQETAEAAETAASAAHSIDEQRRFLSSELERLKQDQEKQIEFSLLRLRESEEKAKLLSEEREHLLKERDSALQEAQMWRSELGKARGNAVILEAAVVRAEEKARVSAADADMRINDAASRLDSATKEKEELVALVDALQLQIRSQDTSTKQVCEERSELCSTSSKHVDMEDDNVDKACLSDTDPIPITENIVDLDDDGVDIPTIGVTEWNNPHSSEVSDVREVTTEPEDNSLDIPVDSQPVSENAFHG

SEQ ID NO: 23511 - protein, 212 aa, Populus trichocarpa x Populus deltoides
MANDGEVTGKRAGWPPVLNERILSSMSRRSIAAHPWHDLEIGPGAPSVFNCVIEISKGSKVKYELDKASGLIKVDRVLYSSVVYPHNYGFIPRTLCEDSDPMDVLVLMQEPVLPGSFLRARAIGLMPMIDQGEKDDKIIAVCADDPEFVHYKDIKELPPHRLAEIRRFFEDYKKNENKKVDVEDFLPAASAIDAIKYSMDLYASYIVEGLRQ

SEQ ID NO: 23512 - protein, 373 aa, Burkholderia sp. 383
MRALQWHGPRDVRLVEIDTPRVGPGDVRIAVAYCGICGSDLHEYADGPHAIPVDTPHPLSRRTAPLTLGHEFCGTVVEVGEGVTALRAGDRVAVEPEYRCSQCAYCRSGSYNLCVSMGFAGLMGDGGMADFAVVPAYMLHRLPDGVSLEQAAVMEPAAVALHALRRGELRLGETCAVFGLGPIGLLLIMLAKLQGATTIVAVDVSPERLAAATRFGATHTFDARALGASALQDAIRAATGGLGVDASFEAAGLQTTFESAMHALRKGGRIVMVGLMPHAGFDAFRAVNDELTFTASVGYRHAYEDLLRIVASGALDLTSIVTRTVSLEDAVADGFDALLADRAQIKILVSPAQRPPRRAHTIGSIEHESSVGV

SEQ ID NO: 23513 - protein, 498 aa, Platanus occidentalis
MRINPTTSGPGVSALEEKNLGRIAQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESKLKK

SEQ ID NO: 23514 - protein, 240 aa, Burkholderia sp. 383
MSRQWAFEGQSVVVTGGTSGIGARTAMRFAQAGASVVALGLDAAGPHAPVHAGIRCVELDVTDSDALTRTIAALPRLDVLVNGVGISRHADEYRMDQFELVLNVNLTSVMRASDAARPALSAHGGSIVNVASMYTYFGSKDRPAYSASKGGIAQLTRSLAQAWADRGIRVNAVAPGWIDTPLSSGLKADMQASRRILERTPLGRWGTADEVADVILFLCSPGASFVTGAVVPVDGGYSTV

SEQ ID NO: 23515 - protein, 338 aa, Zea mays
MGASGGEKLGTLVCVLAHVSLLLVLVLAPCVCKATGGDYGGLSNDHYTESCPELETIVKKSLAPIFAVDITSPAALLRLLFHDCQVHGCDGSILLNSDERRHITSELGSRKNLGIRHVGTVGLVKAAVEAACPGRVSCADIVVLAAREAVAHTGGPRVASVPLGRRDATTTSTQAADAQLPSCFLGIDGALDIFTSRGMTVEETVAILGSHTLGGGHCVNIDTGRARRDKAFEALLHLQCPKTMPPLITEAVVFVPSDLTPTWFDTHYYRGAAAGRGLFNVDDEASTYARTAGYVRRFAEDREGFFGVFASAFVKLSGFGVLTGEQGEIRKKCDVVNY

SEQ ID NO: 23516 - protein, 578 aa, Oryza sativa Indica Group
MPLATLLGHLAAGRFGRVQALTGAATAAAAHRLLHLLLRTAPPPPLPDLVSLARWSRAHFRAPLPLRLHGLLLARLASKGLYPLLRSELHVLAAARLHSPASILRALPSPSASASASTPLIADMLVLALARASQPLRAYDAFLLAGESHPRHRPSTSSVNALLAGLVGAKRVDLAEKAFRSALRRRVSPDIYTFNTVISGLCRIGQLRKAGDVAKDIKAWGLAPSVATYNSLIDGYCKKGGAGNMYHVDMLLKEMVEAGISPTAVTFGVLINGYCKNSNTAAAVRVFEEMKQQGIAASVVTYNSLISGLCSEGKVEEGVKLMEEMEDLGLSPNEITFGCVLKGFCKKGMMADANDWIDGMTERNVEPDVVIYTILIDGYRRLGKMEDAMAVKEAMAKKGISPNVTTYNCLITGFSRSGDWRSASGLLDEMKEKGIEADVVTYNVLIGALCCKGEVRKAVKLLDEMSEVGLEPNHLTYNTIIQGFCDKGNIKSAYEIRTRMEKCRKRANVVTYNVFIKYFCQIGKMDEANDLLNEMLDKCLVPNGITYETIKEGMMEKGYTPDIRGCTVSQASENPASS

SEQ ID NO: 23517 - protein, 331 aa, Streptococcus agalactiae 2603V/R
MAVLILGGAGYIGSHMVDQLITQGKEKVIVVDNLVTGHRQAVHSDAIFYEGDLSDKTFMRQVFRENPDVDAVIHFAAFSLVAESMENPLKYFDNNTAGMIKLLEVMNECDIKNIVFSSTAATYGIPEQVPILETAPQNPINPYGESKLMMETIMKWADQAYGIKFVALRYFNVAGDKPDGSIGEDHKPETHLLPIILQVAQGVRDKIMIFGDDYNTPDGTNVRDYVHPFDLADAHILAVDYLRQGNESNVFNLGSSTGFSNLQMLEAARRITGKEIPAQKAARRPGDPDTLIASSEKARQILGWEPKFDNIDKIISSAWAWHSSHPNGYED

SEQ ID NO: 23518 - protein, 310 aa, Picea sitchensis
MTTSEREIIELEAGWEFMQKGITKLKNILEGISEEQFNSEEYMRFYETVYKMCTQKPPHDYSQQLYDRYRESFEEYITSMVLPALREKHDEFMLRELVKRWGNHKIMVRWLSRFFNFLDRYFIPRRSLPALNEVGLMCFRDLVYQEIKNNVRDAVITLIDREREGEQIDRVLLKSVLGIFVEIGMGNMDAYEIDFESAMLEDTASYYSRKAASWILEDSCPDYMLKIEECLKQERERVAHYLHSSSEQKLLEKVQNELLEKEHSGCHALLRDDKHVTGEGTSLVKHAEDAASNKKAEKKDVVGAQEQVFL

SEQ ID NO: 23519 - protein, 90 aa, Triticum aestivum
LLSPLFFTVLYASQPYGLLENPSDLPLARYLAEKTNTTKPVLEKCDGECQLKSTLLEGVFVGVVLLIILISGLCCMMGIDTPSRFEAPQD

SEQ ID NO: 23520 - protein, 343 aa, Oryza sativa Japonica Group
MANLGGGAMPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 23521 - protein, 135 aa, Brassica napus
MGGGGRVMATAAKVAGIGVAKGGFRGGLGVPAAANDQFNVRSTSAAKPVSASLSSAIHPSAEADAMVLQRASWEDDWEFAEVETTTIPRVVFSKPPSLQEAKEATDDLKDAINLVYTEGSYEAGSVSRMLSSFHL

SEQ ID NO: 23522 - protein, 445 aa, Silicibacter pomeroyi DSS-3
MTAPDPLALKAEFDSLSLVRHVGRVTGVAGGVIQIQGLARQAQIGDRVELKRNFGPSLGGEVLQVEGSTINMLPDSAPEGVSLGNRVVLHPIPGFAPGRHWLGRVVDPFGRPLDGRPLMRGSKARDLMRAPPPAVQRKPLGQRMATGLAALNTLLPIVRGQRVGLFAGSGVGKSSLLATLAKSMQADAVVVALIGERGREVNEFVAKALGPEGLARSVIVAATSDQSALVRRRCAWAAMTVAESLRDEGLNVLYLADSITRFAEAHREISAAMGEAPALRGYPPSVTPLITGLCERAGPGTEKQGDITGVFSVLVAGSDMDEPVADILRGVLDGHIVLNREIAERGRFPAIDISRSVSRSLPDAATPEQNALIGEARRLIGAYEQSEVMIKAGLYSEGADPLLDQAVRVWPELDAFLARLDPQGIEHSFSRLQLVLRRSKSGPRH

SEQ ID NO: 23523 - protein, 433 aa, Corynebacterium efficiens YS-314
MTNARDHHTPLTTDPPVATSPTRETPGAYRVLTMATLGFTLMFAAWMMFGVLGIPIQEEFGLTDVQLSLISSVAILNGSLWRLPAGIIADRLGGRIVMTVLLVASAVFSYMVSLADSYSMLLGLAFAVGLAGNSFSVGNTWVAAWFSKRRNGLAMGVFGAGNVGASVTKFIGPVIIAATAGSLYFGGLVEGGWRLVPVIYAVALLATAVMLWFITPAQDKKPGQGRKLSEMLAPLKQGRVWRFSLYYVAVFGAYVALSSWMPKYYIDMYGVSTSTAALLTALFIFPASLMRPVGGSLSDRFGARQTTIFALLIMLTASGILALPLTINIVLFTLLLFTLGVGMGIGKASVFKYIPDYFPGNVGSVGGLVGMFGGLGGAFLPPLFAGVKTATGLEQATFLVIFVLVAFCLAWLLRAISLMKRTSPDPLWRRFGI

SEQ ID NO: 23524 - protein, 268 aa, Haemophilus influenzae R2866
MAIPIRTEKEIVKLREACKLASDVLVMIEPYVKAGVTTGELDRICHEYMVNEQKVIPACLNYHGFPKATCISINEVVCHGIPSDDKVLKNGDIVNIDVTVIKDGYFGDNSKMYIVGGETNIRSKKLVEAAQEALYVGIRTVKPDIRLNEIGKAVQKYTESQTFSVVREYCGHGVGTEFHCEPQVLHYYADDGGVILKPGMVFTIEPMINAGKKEVRVMGDGWTVKTKDRSHSAQYEHQLVVTETGCEVMTIRDEEIAEGRISRIMVNV

SEQ ID NO: 23525 - protein, 504 aa, Zea mays
MTIARRLLRSNASAQAISLLKHVTGTASLQGHAHSPLDASVRHFSSAPSAQSDTTEENGFKGHGMLAPFTAGWQSNDLHPLIIERSEGSYVYDINGNKYLDSLAGLWCTALGGSEPRLVKAATEQLNNLPFYHSFWNRTTKPSLDLAQEILSMFTAREMGKVFFTNSGSEANDSQVKLVWYYNNALGRPDKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFDKVITAFGRLGTMFGCDYYNIKPDLVSLAKALSNAYVPIGATLVSPEISEVIHSQSNKLGSFAHGFTYSGHPVACAVAIEALKLYPGMLHFFERDIPGHVKQIAPKFQDGIRALADSPIIGEIRGLGMIMGTEFTNNKSPADLFPAEWGVGAIFGEECQKRGMLVRVAGDAIMMSPTLIMTPGEVDELVSIYGEALRATEERVSDLKMKSEKN

SEQ ID NO: 23526 - protein, 343 aa, Corynebacterium efficiens YS-314
MAEAPTVVHPVPPHVTSIMRKLACMNGTTGLKAPGLTIADTIGNTPLVRLDRLTRDRDFTLWAKLEYFNPGGSAKDRTAQAMVTAGTLKPGDMVVESSSGNLGIALAREAVLGDWTFHCVVDPRANRSTVKHMQALGAVVHQITEPDEETGDWLVARRKRVAQLLQEIPEAICLDQYSNTEAFRAHQEGTMAEIVQQLGHAPDHLLVAVSTTGTIGGCLRHIEAHHLPTQVTAVDAMGSVLFDGNPGPRHLPGFGAGMVPELSRQITPHRVLRVADRESVEGARTLVRKETILPGASGGAVIAAVDKLKDVFESGSDVVVILHDSGTRYMDTIYNDDWVEETL

SEQ ID NO: 23527 - protein, 544 aa, Schizosaccharomyces pombe
MGSDGSSLSPKVSQPGHTEIVDHVSEKVITNGKNVNKKVNSEVDGKSMVEKVKTHEENAEDYHYGGYHPVYIGEEFHHRRYVVERKLGWGHFSTVWLAYDRAAKRRVALKVVRSAEHYRETSIDEIRILQKIREGDEKHLGKKHIISLLDYFVHRGPNGAHVCMVFEVLGENLLSLIQSYGHRGVPVGIVKQIAYQLLIALDYLHRECGIIHTDLKPENVLICIDQDALQHIEAPATTSSPTSNTSSSKTRNNTGYTAKAPIIKRGQSVDNSAQERKTFAKNPTKNSKPAGQVIPSSPFTSTLSRFPSLEGAVSEISLRDSQKHNSHPNSPFSSGDNSLILDGVNGSQEPVPKITVKIADLGNACWTRKHFTNDVQTRQYRSPEVILGCRWGASADCWSFACIIFELLTGDYLFDPRNGNSYSKEDDHIAQIIELLVNYPKQMALSGKHSRDLFNRRGELRNIHKLKFWPLKDVLEQKYHFSAELAQQISDFLSPMLCFDPAKRTNAGYMSNSPWLREVADPTFKIETTGATGEDVPGWATEIR

SEQ ID NO: 23528 - protein, 380 aa, Corynebacterium efficiens YS-314
MSSWWSAVHGHGHPRLVAAATAQAHRMSHVMFGGLTHEPAARLTRALLELVDAPLDTVFYSDSGSVAVEVAVKMALQYSRGIGHPERTRLLTWRSGYHGDTFAAMSVCDPDGGMHSLWSGVLAQQLFAPAPPVRGSDPQELERYLDELESLVDDTVAAIIIEPVVQGAGGMRFHDHRLVAGVREICNRRGILMIADEIATGFGRTGSLFATSAAGVTPDILCVGKALTGGFMTLAATLCTTAVADAITSPRGGGALMHGPTFMANPLACAVAAESLAIIAEGGWRSAVLGIDTELRAGLDPLRREPGVADVRVLGAIGVVEMTTPVDMINATRAAIAEGVWLRPFGRLIYVMPPYVCTTEDIATICRGVAAAVRAAGSRP

SEQ ID NO: 23529 - protein, 322 aa, Synechococcus sp. RS9917
MPIADDITALVGRTPLVRLNRLPAACGCQAEILAKLESFNPTASVKDRIAGAMVQAAEASGTIQPGRTVLVEPTSGNTGIALAMVAAARGYRLILTMPDTMSTERRSMLRAYGAELQLTPGVEGMQGAIALARQLVAEIPGAYLLQQFDNPANPAVHAATTAEEIWADTGRALDAFVAGVGTGGTLTGCAQVLKRRCPGLQVVAVEPAASQVLAGGAPGPHRIQGIGAGFVPPVLEAGLIDEILAISDEEAMAMGRRLAREEGLLSGVSSGAAVAAALRIGQRPAMAGRRIVVILASFGERYLSTPMFSSAPAPPARGDGQL

SEQ ID NO: 23530 - protein, 387 aa, Cryptococcus neoformans var. neoformans JEC21
MTSMAAALAASLPAAVSTQATPQPAAQQPSKVPQRLEGVVDVEAAREVENVSLSSLVFLKMMKHSTDSLPAPPASVLQQDRNPPPSTELSSHVDALGVLLGLDLDGVMEVEDCYALPGGETSLGPNSYSAKLLSRLGTVSTPDSPVGIYLSTHNGGFATRVSIELLSAVEKAAGRGKAILVVHDASRSNGGDVSVKAYRLADGAREAAKLGRWDGQVLIEQGITASTLLTSIPITVTSPSLVNAFISTLNTPSPSETSAPSLTNPSVPLPPSFAPLINPLPGSLTAYLQNTLDALTLHSHEANNIAFLTRQIAREKTKHEQAIRDREEENARRRKMGLSEFPSIPQEIRGGTKEPSRLEMVCLGGTVEGIAKGMAAEAGKGLVRAYL

SEQ ID NO: 23531 - protein, 313 aa, Triticum aestivum
TIEQVCTKKQAGTGPEFPGYRRPTRPAIRYAVVDAFATEPFKGNPAAVCLLEDDNAADERWMQSVATEFNLSETAFLVRDFSRRASAAPLFHLRWFTPVTEVDLCGHATLASAHFLFTAVLPEHGMIEFMTKSGILTAKKVPPPGGAGEAHGKLFIELNFPMIDFLGCNEMPSIPETLNGAPVVSVHKSAADGDLIVELSSAQEVADILPNIDEIKKLSCGGIMVTGPAPAGSGYDFFTRLFCPKFGMDEDPVTGSIHCVLGPFWGRKLGKQKLTAFQASPRGGTLYLELDDANRRVKIQGETVTVMSGTLLV

SEQ ID NO: 23532 - protein, 133 aa, Solanum melongena
KFTAIAVYLEESAIPFLAAKWKGKSSEELTDSVEFFKDIVTGPFEKFTQVTMILPLTGKQYSEKVAENCVANWKAIGTYSDAESQAIEKFLNVFQSETFPHGASILFTQSPLGSLTISFSKDDSVPSIGNAVI

SEQ ID NO: 23533 - protein, 240 aa, Cryptococcus neoformans var. neoformans JEC21
MSRPSQVSNPPTAPPTPFQFDPVPDAIEAIRRGEFVVVMDDESRENEGDVVCAASAVTTEGMAWMIKWTSGYICLSLPPSRLKALQLPPSLPPSGVSQDPKGTAYHLTVDSAPGRHPVSTGISAHDRAYTARLLADPKSDESDFTRPGHMVTLRYAVGGVRKRRGHTECATDLCYLAGLPPAGLLCELVNPYDPAGSMARRDDCWRFAKEWGLKIISVEGLAEYVLKEGKQLVPEEEAKA

SEQ ID NO: 23534 - protein, 615 aa, Populus trichocarpa x Populus deltoides
MATLSSSAEQTSDLLQKLSIDSQTKTLDMPEPTNKIQPSDRSVTPVLSNFMDPTVCYLPNGYPSYYYGGYNGTGEWDDYSKYLNTEGVDMTSGNGSAMYPHGYWYGPYGPYSPAASPVPTMGNDGQLYGPQHYQYPTPYFQPLTPTSEPFIPSHVAPSQGDLSITTAADQKSLPVETGKENSNGIANGGDVKGANGAVPYKPKYQNSYGRGSYTKGIPASGYKDLRSCFDRLQPDIPLLDSSVLSDGLYRNTDISSSFSKASNAPSSRNQNFHQNSHFMGWQHPGLASGMGSTHGYMNRMYSNKLYGQYGNGFKSGVGFGSGGYNAGINGQGWLPIDSKYKPKGQGNGYFGFRNENIDGLNELNRGPRAKGYFKNQKGFVPSTVAVKGQSVPSSDANAEEKDKTTEVPDREQYNKADFPVEYVDAKFFIIKSYSEDDVHKCIKYNVWASTPNGNKKLDAAYQEAGQKSGGCPVFLLFSVNTSGQFVGLAEMTGRVDFDKSVEYWQQDKWTGYFPVKWHFVKDVPNSLLKHITLENNENKPVTNSRDTQEVKLEQGLEMIKIFKEHSSKTCILDDFGFYEDREKMIQEKKAKQQQLKKQVWDGKPSDEKKELVNGS

SEQ ID NO: 23535 - protein, 157 aa, Picea sitchensis
MASAIMSSAAAMAAVAAPLKTSNGNGSSSSGNVVSAFTGLKSTAQFPSSMKTNNAGAEWERKTTSNGGRVRCMQVWPPYNNPKFETLSYLPRLTQEQLLKDVEIANVRLHRGIAGVERGERVCEGIPESLHSRHRLRQRPPSPVHLLHRPQARIQLS

SEQ ID NO: 23536 - protein, 408 aa, Idiomarina baltica OS145
MKLSQFGPGALVAAAFIGPGTVVTASLAGAEFGYALLWALMLSTVICAVLQEMASRIGVITGKGLGENIRSQMTSPWLRILFFTLIIAAIVVGNSVYQGGNLSGATLGAQEVLGQVPLLSDWFAQGGPLVFGVLAAAILWQGKAKFIEYALITLVLLMSLAFIGTFLLTDPNWLGVADSLLRWRWPSDSIITVIALVGTTVVPYNLFLHSASVANKWSGDDGVKQARIDTFISIPLGGLISMAILATAASAFFAQGIVIESAGDLAVALAPLFGDSAKYLMALGLCAAGISSATTAPLASAYALCGIMGWKQSLTGFAFRAIWATILVLGVVISSLDLSPIKVIWFAQVANGILLPVIVGFIWWLCNQSTMGRMKNSVVGNAFAAIIMLTSILLSWKSLHHVWLSITS

SEQ ID NO: 23537 - protein, 495 aa, Acinetobacter baumannii
MFSNVREQWFSNIRGDVLSGIVVALALIPEAIAFSIIAGVDPKVGLYASFCIAVVISFVGGRPGMISAATGAMALLMVTLVKEHGLEYLLAATILTGVIQIVAGFLKLGALMRFVSKSVVIGFVNALAILIFMAQLPELTNVTWHVYAMTAVGLGIIYLFPLIPKIGSLIPSPLVTIVVLTIAAITLGLDIRTVGDMGQLPDTLPVFLLPDIPLNLETLTIIFPYAAALAAVGLLESMMTATIVDDLTDTSSDKNRECKGQGVANIASGFMGGMAGCAMIGQSIINVKSGGRTRLSTFCAGIFLLIMVVFISDWLKVIPMAALVAVMIMVSIGTFNWDSLRNIRQYPLSSNIVMIATVVVVVATHNLAYGVLIGVLLSALFFANKIERYMAVQSVLDDAENTRTYIVKGQVFFSSADKFTAAFDFKEAISKVVIDVSQAHFWDVSAVAAVDKVVIKFKREGTEVELIGMNEASQTMVEKFGIHDKPDALDRLSNH

SEQ ID NO: 23538 - protein, 454 aa, Streptomyces coelicolor A3(2)
MVQEIDVVVIGMGVGGEHVAERLAEEGLDVVGVEAELVGGECPYWVCIPSKMMIRGGNLLAEARRIPGMAGQAQVTPDFAPVASRIREEATDDWNDQVAVDRFTGKGGQFVRGRARLAGPKRVEIDGREFTARRGVVIATGSRPQIPPVPGLDAVPYWTNREAIAVKDSPRSLMVLGGGAVGVELAQAFARFGTAVTVVEAAERLLPAEEPETSALLADVLGAEGITVRTGAQANRARHDGDTFTLTLEGGEELTAERLLVATGRRAGLAGLGLGTVGLDPDARALHVDEQLRAAPGLWGVGDVTGRGAFTHVAMYQAEIAVRAILGQPGPGADYRALPRVTFTDPEVGSVGLTEARAREKGLRVRTGTAQVPSSARGWIHKAGNEGLIKLVEDVDRGVLVGATSAGPMGGEVLYGLVVAVQGEVPVDRLRHMMYAYPTFHRAVEDALRALRSS

SEQ ID NO: 23539 - protein, 2505 aa, Oryza sativa
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMWASGSPPTSPVSGVRRGACRRAPRKPLPPIAAHVPPFPAPTSTAIAMGKPKQQVLSRFFSPKPRPSAPATADDPPPPPRPPAEPPVAAVVSFSPAKRARALSVSPKTTAKRAKPSPPPSDYVRRRLLEPPRPPPPAALNPSGKGYTPLEQQVVDLKARHPDVLLMVEVGYRFRFFGEDAAVAASVLGIIAHPDHSFLTASIPTFRLGFHVRRLVAAGHKVGVVRQTETAAIKAAHGGGAAGTPFARGLSAVYTRATIEAAAGELEGGGAPDEGSRYLVCVVDKEVDAMGTEGFEVKIGVVAIEVSTGEVVHGEFMDGVSRNGLEAVLLGLAPVEVILGTPISSATEKLMVAYAGPTSNVRVERTSRLCFSEGGALAELLSLFEKSGVDAPTVENGRHLMEMNEENNNPRGIEVPLSSSELTVIAPYDWVSICSLGIMAMPELVIHALALSVRYLKGFGMDRIICFGSSFQPFTANTEMSLSANTLQQLELTHPLCDRNQICTRHDAVSEISESIGSQQYSTNNLQDEVDMSCSSSVRSDLSTILSSVLRMLAGTLDIQRGITRIFHCKATAKEGTSNDTPFGLIILVVLDKDEFVGVVQAILTAGKQLQKLVLEDTDTMSSQHRTVHSPLLRRLINTASSCTVLANAATLVSCLNKDAADQGDMLNLFIASVDQFPEVAEGHATVEMAKQKLELLITEYRKQLGLPVDRKVPSSWMKVNSTKKTIRYHTPEVSKNLENLLLAKEKLAVICRTTWNNFLMDFGRYYAQFQATVKSLATLDCLYSLATLAKQNKYVRPNFVRENEASQIHIKDGRHPVLESLLGVNFVPNDTELHANSEYCQIVTGPNMGGKSCYIRQVALITLMAQVGSFVPASSATLHAVDGIYTRMGASDSIQHGTSTFYEELSEASNILHNCSSRSLVIIDELGRGTSTHDGVAIAYATLHYLLKEKKCMVIFVTHYPKILNILREFEGSVGAYHVSYLATRKLLEVADRQMVINNTETKDLGEITFLYKLVAGASDRSFGLNVALLAQLPSSCIERASVMAAKLQQELSEREKNKFCRLMDVPRESSPKELCAQPYQGLAEACHRILFNVTSAQSNDELTDTLSSLREAREIALKAIKGWGRVGMGLSRFTAPRPGLQIGAAGNGFRACSLRRLRHRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLIVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEVTTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLEDISAYHFLPAAFCGKAKLNEEVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTIFFLVQHRGFYYLLWNDDKSLILPVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 23540 - protein, 366 aa, Lactobacillus plantarum WCFS1
MALTAGIVGLPNVGKSTLFNAITKAGAEMANYPFATIDPNVGMVEVPDKRLDRIQEIIPAKKVVPTTFEFTDIAGIVKGASKGEGLGNKFLENIRQVDAIVHVVRAFDDDNITHVTGKVDPQDDIETINLELSLADLEAVDKRLAKVQRAAKGSDKEAKAELAVLQKIKPALEAGKPVRSLEFNEDDQQIVKGLFLLTSKPVLYVANIAEDDMADPENSKYFQVVADYAKQEGAQAIGVAAETEEEIAELDDDDKADFLAAEGVEEPGLNKLIRASYKLLGLETFFTAGGKETRAWTFKRGTKAPQAAGIIHSDFERGFIRAEVMSYDALDEAGSEAKVKENGKLRLEGKDYVMQDGDIVEFRFNV

SEQ ID NO: 23541 - protein, 454 aa, Saccharum officinarum
MCSSSASAPAAGRAAALSSEELMRMERDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKQIPKNEALLASCCGCFHGRTLGVISMSCDNDATRGFGPLVPGHLKVDFGDIDGLKKIFEEHGDRICGFLFEPIQGEAGVVIPPDVYLKGVRDLCSKHNILMIADEIQTGIARTGKMLACDWENIRPDMVILGKALGAGVVPVSAVLADKDVMLCIRPGEHGSTFGGNPLASAVAVASLKVVRDEGLVERAAKLGQEFRDQLQKVQQKFPQIIREVRGRGLLNAVDLNNDALSPASAYDICIKLKERGILAKPTHDTIIRLAPPLSISPEELAEASKALSDVLEHDLPQMQKQIKRPESEAEKPVCDRCGRDLYG

SEQ ID NO: 23542 - protein, 379 aa, Bacillus licheniformis ATCC 14580
MKEQCVAMLLAGGKGSRLNALTKNLAKPAVPFGGKYRIIDFALSNCANSGIHHVGVLTQYQPLLLNSYIGIGEPWDLDRNDGGVSILSPYAEASEVKWYKGTASAIYENRHFLKELQPEHVLILSGDHIYKMDYGKMLEYHAEKQADATIAVIEVSWAEAGRFGILHTNDKMEITSFEEKPKYPKSNLASMGVYVFKWSVLEDALERDEKNSASSHDFGKDVIPALLEENKRLNAYPFKGYWKDVGTVRSLWEANMDLLGDHPPLDLFERNWRIYSVSPNLPPQFVADLAEIKESLVSEGCTVYGSVTRSVIFQRVAIGRHSAIKRSVVMHDVSIGEYVEIENAIVSAGIRIPDGFCAKPEDGEVLLITEEYVKKHKVV

SEQ ID NO: 23543 - protein, 359 aa, Medicago truncatula
MGLKNNNKVFVFSILIFLIIPTLIAAECTCDEEDLDRDKPKALRYKIAALVSILVASGIGVCIPLLGKVIPALSPEKDIFFIIKAFAAGVILATGFIHVLPDAFENLTSPRLKKHPWGDFPFTGFVAMCTAMGTLMVDTYATAYFQNHYSKKAPAQVENEVSPDVEKDHEGHMDVHTHASHGHAHPHMSSVSSGPSTELLRHRVITQVLELGIIVHSVIIGISLGASESPKTIRPLVAALTFHQFFEGMGLGSCITQANFKSLSITIMGLFFALTTPVGIAIGIGISSGYDENSPTALIVEGIFNAASSGILIYMALVDLLAADFMNPRMQKNGILRLGCNISLLLLGSGLMSLIAKWA

SEQ ID NO: 23544 - protein, 203 aa, Roseovarius nubinhibens ISM
MNTLVPMVVEQTSRGERAYDIFSRLLKERIIFLNGPVHDGMSSLVVAQLLHLEAENPSKEISMYINSPGGVVTSGLSIYDTMQYIRPAVSTLVIGQAASMGSLLLTAGAKGMRYSLPNSRIMVHQPSGGYQGQATDIMIHAEETLKLKRRLNEIYVKHTGQTLKKVEEALERDNFMSPEEAKSWGLIDEIVESRGKADEDDKA

SEQ ID NO: 23545 - protein, 264 aa, Thermus thermophilus HB8
MRLAGKVVVVTGAGSGLGQALALELLRRGARVAAVDLRSEGLQETMAKAGSLGEGLSLHPLDITDKEKVAALPEEVERVHGQVDGLINNAGIIQPFKRLLDLDEAAMERVMRVNFWGTLHMTRAFLPRLLKRPEAHLVNVSSMGAFVPVPGQALYGASKAAVMLLTEALWAELQGTPVRVTLVLPGAMRTGIAEHSGVEAPRAEGAKVPVLEPEVAAKRLLDAVERDAFRVLLGRDAQTMDLLYRLSPALAARIVQRRMAHLLT

SEQ ID NO: 23546 - protein, 336 aa, Herminiimonas arsenicoxydans
MTIRVAINGYGRIGRNILRAHYEGGKKNDIQIVAINDLGDAKSNAHLTRYDTAHGKFPGTVEVDGDYMIVNGDKIRVFAQRDPAQIGWGELNVDVVLECTGFFTTKEKASAHIRGGAKKVIISAPGGKDVDATIVFGVNNNVLKATDTVISNASCTTNCLAPLVKPLNDKIGLVNGLMTTVHAYTNDQVLTDVMHEDLRRARSATQSMIPTKTGAAVAVGLVLPELNGKLDGYAIRVPTINVSIVDLSFIAARDTTVEEINAIMKEASEGALKGILTYQTEPLVSVDFNHNPASSNFDSTLTKVSGRLVKVSSWYDNEWGFSNRMLDTTVALMTAK

SEQ ID NO: 23547 - protein, 339 aa, Corynebacterium efficiens YS-314
MIERVWQLVSVAVMGAGSWGTTLAKVFADAGNTVQLWARRESLAETIRTSRENPDYLPGITLPDSVIVTSDAQAALDGCSIVVLGIPSQALRTTLVEWRDLISPDATLVSLAKGIEKDTHLRMSQVIAEVTGADPSRIAVLSGPNLAREIAEGQPAATVIACEDENRAKLVQAAVAAPYFRPYTNTDVIGTELGGACKNVIALACGIAHGFGLGENSNASLITRGLAEIARLGEAMGADPRTFAGLAGMGDLVATCSSPLSRNRTFGDRLGRGESLEQAREATHGQVAEGVISSQSIHDLAVGLGVEMPITQAVYAVCHQGMAVREMVDALMGRSKKAE

SEQ ID NO: 23548 - protein, 453 aa, Oryza sativa Japonica Group
MDAVMSAADDAGAASGREDPPPAVVLVSAGASHSVALLAGNVLCSWGRGEDGQLGHGDAEDRLVPTVLSGFDAAAPGITSVICGADHTTAYSEDEQQVYSWGWGDFGRLGHGNSSDVFTPQPVKALQGIKIKQIACGDSHCLAVTMAGEVQSWGRNQNGQLGLGTTEDSLLPQKIQSFEGVCVKMIAAGAEHTAAVTEDGDLYGWGWGRYGNLGLGDRNDRLVPEKVSSVEGEKMVLIACGWRHTITVSSSGSLYTYGWSKYGQLGHGDFEDHLVPHKLEALKDSSISQISGGWRHTMALTSDGKLYGWGWNKFGQVGVGDTDDHCFPVQVKFPEDQKVAQVACGWRHTLAFTEKKNVFSWGRGTSGQLGHGEIVDRNKPVMIDALSPDGPGCKKLEPSTAVPFAAKVWVSPSERYAIVPDEKVPNSGEGTARGNGADANVPENDVKRMRVHS

SEQ ID NO: 23549 - protein, 321 aa, Xanthomonas campestris pv. vesicatoria str. 85-10
MTILVTGAAGFIGAYTCRALAARGETVVGLDNYNSYYDPQLKHDRVAALCPGIDIRTLDLTDREGLAALFDEIQPTRVVHLAAQAGVRYSLENPHAYVDSNLVGFVNMLELCRHRGVQHLVYASSSSVYGDSATPPFSEDQRVDQPRSLYAATKAANELMGYTYAQLYGLRATGLRFFTVYGPWGRPDMAPLIFSRAVLAGRPIEVFNHGKMQRDFTFVDDIVAGVLGALDTPSTAPVPHRVFNLGNHTPVELETFIDVIAQAAGRAAEKVYRPMQPGDMIRTMADTQRAQAAFGFDPATPVERGLPQVVEWCRQYFGERT

SEQ ID NO: 23550 - protein, 479 aa, Cryptococcus neoformans var. neoformans JEC21
MPPINKAQAEQVGEYDYFVIGGGSGGLASARRAGSYGAKVGLVEVSPRLGGTCVNVGCVPKKIMWYTADVAENLRKSAQYGFGKEGEGYKLAADFNWTELKHKRDAYIHRLNGIYESNLEKDHVDHHQGWASFVDANTVAIEPPNGDKYTVKAKNIVIAVGGRPTVPSEKDIPGASYGITSDEFFELETQPKRVAVIGAGYIAVELAGVFNTLGSETHLVIRHNQLLRTFDPMMSEVLVPCMEKAGMKIHKKTHVKKVEKTSSGSLLVHLDSSSEPIEVDCLLWAIGRHADTAKLGLDKAGVKYDKKGDVIVDDYQNTNVPGIYAVGDVGGRMLLTPVAIAAGRRLSNRLFGPEKYKNDKLSYDNIPSVVFSHPTIGSIGLSEPEAREKFGDDNIKIYKTSFRAMSFAMLDEDHKQPTAYKLICTGPDEKVVGLHIIGEGSDEMLQGFGVAIKMGATKEDFDACVAIHPTSSEELVTLR

SEQ ID NO: 23551 - protein, 500 aa, Arabidopsis thaliana
MVLSKTASKSDDSIHSTFASRYVRNSISRFEIPKNSIPKEAAYQIINDELKFDGNPRLNLASFVTTWMEPECDKLMMESINKNNVEMDQYPVTTDLQNRCVNMIARLFNAPLGDGEAAIGVGTVGSSEAVMLAGLAFKRQWQNKRKALGLPYDRPNIVTGANIQVCLEKFARYFEVELKEVKLREGYYVMDPDKAVEMVDENTICVVAILGSTLTGEFEDVKLLNDLLVEKNKKTGWDTPIHVDAASGGFIAPFLYPDLEWDFRLPLVKSINVSGHKYGLVYAGIGWVVWRTKTDLPDELIFHINYLGADQPTFTLNFSKGSSQVIAQYYQLIRLGFEGYRNVMDNCRENMMVLRQGLEKTGRFNIVSKENGVPLVAFSLKDSSRHNEFEVAEMLRRFGWIVPAYTMPADAQHVTVLRVVIREDFSRTLAERLVADFEKVLHELDTLPARVHAKMASGKVNGVKKTPEETQREVTAYWKKFVDTKTDKNGVPLVASITNQ

SEQ ID NO: 23552 - protein, 370 aa, Yersinia pseudotuberculosis IP 32953
MVITLSRLYVHPVKSMRGLQLSHAQVSRSGLAFDRVFMITEPDGMFITARQYPKMVMFTPALMADGLYLTAPDGESASIRFNDFLANPAPTEIWGNHFTALIAPEAINSWLSGYFQRDVQLRWVGTELTRRVKPLPEVPLSFADGFPYLLINEASFKDLQQRCPASIKLEQFRPNLVITGTTAFAEDCWQVIRIGDITFDLVKPCSRCVLTTVSVERGQKHPAGEPLRTLQTFRTAENGDVDFGQNMVARNSGIIRVGDEVEVLITKPPRPYGAGAVVESLSAPQDQSKTVSIEYNGIRFNGNNQQILLEQLEQQNIRIPYSCRAGICGSCRVTLLTGDVAALKKSAVGNDGTILCCSCIPKGDISLSGK

SEQ ID NO: 23553 - protein, 158 aa, Cichorium intybus
  misc_feature (128)..(128): Xaa can be any naturally occurring amino acid
ESDSGLVLNFYKDSCPQAEDIIKEQVMLLYKRHKNTAFSWLRNIFHDCGVESCDASLLLDSTRRTLSEKETDRSFGLRNFRYLETIKEAVERECPGVVSCADILVLSGRDGIVALGGPYIPLKTGRRXGRKSRADILEQYLPDHNESMTVVLERFKNI

SEQ ID NO: 23554 - protein, 290 aa, Populus trichocarpa x Populus deltoides
MDRYTRVEKPKPESPINENEIRITSGGPLRNYISYGTSLIQEKHVKEIVLKAMGQAISKTVSVAEGIKRRNPRLHQDTAISSVSITDVWEPLEEGLVPVEQTRQVSMITITLSFRELNKMSPGYQAPHSMKQPKQQDQQQQQQHQHQHQHQHQQQQQPRQARGSYNAVPEDSYGRGDSYGRGRGRGRGRNWGRGGYGYGNNQGNYYQGSYRGNYHGNYQGNYQDNGGYSNQGRGGGRGRNWGYRGTGYERGRGGGGRGYGQGRGRMANRSRGGGGGGSGGGNGNGNGNEA

SEQ ID NO: 23555 - protein, 461 aa, Burkholderia xenovorans LB400
MNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQGGARVVGR

SEQ ID NO: 23556 - protein, 359 aa, Oryza sativa Indica Group
MDAEGTRLLNLTVLQRLDPAVEDILITAAHVTLYDFNIELNQWSRKDVEGSLFVVKRNKQPRFQFIVMNRRNTDNLVEDLLSDFEFELQPPYLLYRNAAQEVNGIWFYNQQDCDAVAGVFGRILNAYAKVPPKPKVPSTKSEFEELEAVPTSAAIDGPLEPSSSSTVLVSNAPDESLTDYFSGAVNVGNVSITPMVGRTHQPIESVASSHVPLIIPSAAPTHQMGVPSGAASAPPLPVIDTNVHSSHSTNLVTPAFFAPPSSSSASLVAPASSFMPTASPFHPTSADAHRPAYGHGTPLLQPLPPPTPPASLTPVHNDEPVISRDKVKDALLRLVQLWLLFISDVREEIVQLCLDALLM

SEQ ID NO: 23557 - protein, 298 aa, Idiomarina baltica OS145
MSSKHPIIAVTGSSGSGTTTTGQALRHIFRSLDVSAAFVEGDSFHRYSRPEMDVAIRKAQEQGRHISYFGPEANDFERLESLFEEYGRTGNGQIRRYLHTFDDAVPYNQMPGTFTPWEDMPENTDALFYEGLHGGVCGDGYDVAKHVDLLIGMVPIVNLEWIQKLVRDTQDRGHSREAVTTSIIRSMEDYIYHIVPQFSRTHINFQRVPTVDTSNPFSAKEIPSHDESFVVIRFRGMKNVDFPYYLQMIDGSFMSRTNTLVVPGGKQALAMELILTPLIEQIIERKTQLRTQVDWLDN

SEQ ID NO: 23558 - protein, 865 aa, Thermus thermophilus HB8
MAKRVYLLSEARGLSRDLLGGKGHGLAEMAAAGLPVPPAFIVTTEACRQYLKAGEVPGLWGEVRAGMAALEGLTGKRFGRGEGKAPPLLVSVRSGAPVSMPGMMDTVLNLGLTLEGVEALARATGNPRFAWDSLRRLLAMYGEVVLGEGPEVFEGMLSALKAERGVGTDAALGPEDLEELAYRYLRHLEARGTPFPLDPWAQLQGAIEAVFRSWQNPRARTYRRIYGIPEDLGTAVVVQAMVFGNLGEDSGTGVGFTRNPATGEKGLYGEYLRNAQGEDVVAGVRTPEPLERLKGYAPGLYEELLQVAERLERHFRDMQDFEFTVERGRLFLLQTRAGKRTAQAAVRIAVEMAEEGLISREEAVMRVEANALPGLLRPSVDRDQAPRPLLKGLPASPGAAVGHAAFTNEAVERFHAQGLPAVLVRPETTPEDITGMYLAKGILTARGGLTSHAAVVARGLGVPAVVGAEALRVFPGEGRALAEGVEIREGDLLTLDGGTGEVYLGAVPLVEAGGEALLEKLLSWAEPHRRLGVRANADTPEDAQRARAFGAEGIGLCRTEHMFFREDRLPWVRRLILAETPEEEALALERLFHFQKEDFKEILRAMDGLPVTVRLLDPPLHEFLPPLEALARRAEEGDEEAGRLLRRAEALKEANPMLGFRGARLLLLRPGVFRMQLRALLEAARELKEAGHDPRPEVMVPLVADPKEVERARALAEELFREYGPIPFGTMVETPRAALLAAEIAPLVDFFSFGTNDLTQMAFGLSRDDAGKFLPRYVEEGLFPFDPTERLDEKGVGRLLRMAAEEGRKANPRLKLGLCGEHGGEAGSVRFVADLLDYTSASPFRVLTARLAAAQAGLSRALKPA

SEQ ID NO: 23559 - protein, 453 aa, Arabidopsis thaliana
MTSCIIMHNMIIEDERDIDAPIEERVEVPIEEVEMTVLWLEMPLEEILSRLPLKSTRAVRSTCKKWDSLFKNRSFISKAAAAREGESQMVVLMDHNLHLVSFFFGSDTSVEIKGKRICLNDDSDSEQVKISQVFHCEGLLLCILKDDNFSLVVWNPYWGQTRWIKPRCSFEIPQGCDMYRYAIGYDNKRRNHKILRFIDYEFHYPRDNVVLWYEIYDFESDLWTTLDVTTPHWLINCGNRGVTLKGNTYWCAKKRNSDLFLNADHIICFDFTSERFGPLLLLPFSDLDGVVTLACVREEKLAALVCHEDVVEVWITIKIEANEVLWSKFLTVNVDLGDEIPSSLTYGSFFIDEEKKVAMIFDKTLDRGDTVHIMGEAGYGGQVDLGEPVNKRRCPLVCSYVPSLVQIKKPAGFQRKQQSKLEKRQYVRNISKLRALKTQSSWTLSMSLECHQQ

SEQ ID NO: 23560 - protein, 572 aa, Staphylococcus epidermidis ATCC 12228
MSKLIKGIAASDGVAIAKAYLIVEPDLSYDSNEKVTDIESEVEKFNDAIEASKIELTKIRNNAEAQLGADKAAIFDAHLLVLDDPELIQPIQDKIRNDKVNAATGLDEVTTQFISIFESMDNEYMKERAADIRDVSKRVLAHILGVDLPNPSLINESAVIVGNDLTPSDTAQLNKEFVQGFVTNIGGRTSHSAIMSRSLEIAAVVGTKSITEEVKQGDMIIVDGMSGDVIIDPTEDELIAYQNKRERFFEDKKELQKLRDADTVTVDGVHAELAANIGTPDDLSGVIDNGAQGIGLYRTEFLYMGRDQMPTEEEQFEAYKKVLETMDGKRVVVRTLDIGGDKELPYLDLPKEMNPFLGYRAIRLCLAQPEIFRPQLRALLRASVYGKLNIMFPMVATIKEFRDAKSMLLEEKENLLREGYEVSDDIELGIMVEIPATAALADVFAKEVDFFSIGTNDLIQYTLAADRMSERVSYLYQPYNPSILRLVKQVIEASHKEGKWTGMCGEMAGDQTAVPLLLGLGLDEFSMSATSILKARRQINGLSKNEMAELANRAVECSTQEEVVDLVNQLAK

SEQ ID NO: 23561 - protein, 453 aa, Trichophyton rubrum
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALTGLNMGGGKGGADFDPKGKSDNEIRRFCQAFMAELHKHIGADTDVPAGDIGVGGREIGYIFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWVHVGKVDVVLPCATQNEVSGEEAKVLVANGARFVAEGSNMGCTLDAIELFEAHRNEHKRDQGAVWYAPGKAANAGGVAVSGLEMAQNSQRLTWSAEEVDGKLQAIMKECFETGLRTANEYTEVEDDKLPSLVAGSNIAGFIKVSEAMRDHGDWF

SEQ ID NO: 23562 - protein, 352 aa, Borrelia burgdorferi
VKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINIARQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAINFLKTWAKN

SEQ ID NO: 23563 - protein, 462 aa, Oryza sativa
MKEKGSRAAVDERYAQWKSLIPVLYDWFANHNLVWPSLSCRWGPQFEKATYKNRQRLYLSEQTDGTVPNTLVIANCEVVKPRVAAAEHISQFNEEARSPFVKKYKTIIHPGEVNRIRELPQNSKIIATHTDSPDVLIWDVEAQPNRQAQLAQMESRPDLVPPDSRPDLILRGHKDIAEFALAMCPAEPYVLSGGKDKSVVWWSIQDHISALGDSSKTESSPGASGSKGKTANDKDSPKVDPRGIFLGHDSTVEDVQFCPSSAQEFCSVGDDSCLILWDARSGTGPAVKVEKAHGGDVHCVDWNLHDVNYILTGSADNSVRMWDRRNLGSGGAGIPVHKFEGHKAAVLCVQWSPDKASVFGSSAEDGFLNVWDHEKVGNKKNPNAPAGLFFQHAGHRDKIVDFHWNSSDPWTIVSVSDDGESTGGGGTLQIWRMSDLIYRPEDEVLAELENFKTHLASCAPRS

SEQ ID NO: 23564 - protein, 477 aa, Aspergillus oryzae
MADNVPAQTPSTLPPPPQTSAAPGQQYDGAQGNGQANPSHMPPPPRPPVVIPQNTNPIPTAITSPMSGNMMSPTSAGGYVRRAAPEPNKRALYVGGLDQRVTEDILKQIFETTGHVVSVKIIPDKNKFNSKGYNYGFVEFDDPGAAERAMQTLNGRRIHQSEIRVNWAYQSNSTNKEDTSNHFHIFVGDLSNEVNDEILQQAFSAFGSVSEARVMWDMKTGRSRGYGFVAFRDRADADKALGSMDGEWLGSRAIRCNWANQKGQPSISQQQAMAAMGMTPTTAFGHHHFPTHGIQSYDMVVQQTPQWQTTCYVGNLTPYTTQNDLVPLFQNFGYVLETRLQADRGFAFIKMDSHENAAMAICQLNGYNVNGRPLKCSWGKDRPPTGQFDNFSGQQGNSPFNNSPAPYFPQYGGPGGPMTPQGPNPAGRGWDQSGMGGQNYGQVPGNAGYGRGQAAPASGWNQANNANFGNGFGGYQA

SEQ ID NO: 23565 - protein, 387 aa, Zea mays
MAMATAKLNSPATSLLAGGRTRRSAPARCTTVIRAAAGSYSDELISTAKSVASPGRGILAIDESNATCGKRLSSIGLDNTEVNRQAYRQLLLTTAGLGEYISGAILFEETLYQSTTDGKKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHGIEGALEVAEKVWSEVFFYLAENNVLFEGILLKPSMVTPGAEHKEKASPEAIAKYTLTMLRRRVPPAVPGIMFLSGGQSEVEATLNLNAMNQSLNPWHVSFSYARALQNSVLKTWQGRPENVEAAQKALLVRAKANSLAQLGRYTGEGESDDAKKGMFQKGYTY

SEQ ID NO: 23566 - protein, 240 aa, Zea mays
MCTLEKRGNLFLLTLTGDNEHRFNPDAIATILSLLAQAKSQAKRGSVLITTGHGKFFSNGFDLAWAQASGSLTGAAERLHQMVESFKPVVAALLDLPMPTIAALNGHAAAAGLMLALSHDYVFMRKDRGVLYMSEVDIGLSMPDYFAAMVRSKIGTSAARREVLLSGKKIRGEEAVALGIVDSAAHDSAEGVVPPPVGLAEKLAAKKWNGDVYASIRKSLYPELCEILGLKATIFATPKL

SEQ ID NO: 23567 - protein, 494 aa, Ostreococcus tauri
MNAAAAPPRMNTTVRCAPHRATRSTVGDRHRPRAMSPLPRVFLDVAIGRAPIGRITIELRSDVCPKTCENFRALCTGERGRSTLSNAPLTFRASTFHRVIPNFMLQGESVYGETFEDENFTLRHRGAGTVSMANAGPNTNGSQFFICTADTPWLDGKHCVFGFVVEGMDVVRKIESRGSKSGKTREPIKIVDCGEIPQELIDAKELTEDARALLKREVDERALADKEAREVGGENADVASARRLRESAEEAEREAKRASESRGAVDVDANAGNPTAGMSAKQRKLFELRLKLNEGRKKNQAAVVDEKKRVDAPEEYEKAQKRRALEASKKSQQDNLVKQGIDPKAVHLTATIEQANRKKAKKQQNDPNDAALYSAARQHATYERERGFLNPTLTQEEYERQKETVPDFYRSADSIYHTSNKPTQEAIDRLAQNVQESQRKKLEARSKREAKAISKLDGINIRNERHNAMLAKSYDKYSKEIKANLERGTALPEN

SEQ ID NO: 23568 - protein, 339 aa, Bacteroides thetaiotaomicron VPI-5482
MLNLINQIVARAKADRQRIVLPEGTEERTLKAANQILTDEVADLILLGKPAEINELAVKWGLGNISKATIIDPETSPKHEEYAQLLCELRKKKGMTIEEARQLTNDPLFYGCLMIKSGDADGQLAGARNTTGNVLRPALQIIKTAPGITCVSGAMLLLTHAPEYGKNGILVMGDVAVTPVPDPNQLAQIAVCTAQTAKAVAGIENPKVAMLSFSTKGSAKHEVVDKVVEATKIAKEMAPTLDLDGEMQADAALVPEVGASKAPGSPVAGEANVLIVPSLEVGNISYKLVQRLGHADAIGPILQGIARPVNDLSRGCSIEDVYRMIAITANQAIAAKNNK

SEQ ID NO: 23569 - protein, 200 aa, Ostreococcus tauri
MGKNRLKTKQFAATKRMINPKEIAKTRKGAEKSGESEKRKNRDALTLKRVETQSAGMFGRYNSTLKPPYNVLVDTNFINFSIKNKIDLVKGMMDCLYAECVPHITDCVVAELEKLGQKYRVALRISKDPRIERLPCDHKGTYADDCICERVKAHRCYIVATCDTDLKRRIRKIPGVPIMYVGNHKYAIERLPESTQIGNS

SEQ ID NO: 23570 - protein, 505 aa, Streptomyces coelicolor A3(2)
MEAGKGRNRLRQRVPLPSHARAPAIPRRRTDREFRAMKRYDLVVIGGGSAGLTAARTAGRLGARTLLVERDRLGGDCLWTGCVPSKALLHVAADVQAARRATAYGLPPVTGPADLTAALAEVKRAIGAIEPHDSAEALAPYGVDVTHGAASFTGPGTLTAGEREVSFRYALIATGSSPALVPIPGLVESGPLTSDTVWELSELPHLLVVLGGGPIGCELGQAFARLGSQVTLVEAMDRLVPREEPRASQVLRERLQSEGVTVLTDYRAERVDADAVHGPGGPLPYDALLAVTGRRSHTHGLGLEAAGVELTDAGHIRTDGRLRTTNHRIYAAGDVTGRSAFTHLGGTQGGAAAVDALLGVRRPIDYRAAPRVTYTDPEIAGVGLTLDEAHAKYGDRARVHTLENDRVDRAVADGRTEGFTTLVLGPRGKIVGATVVSPRAGETVAHLAAAVRLGWTPSDYARTVHPYPTYADGPWHTALTDVYARLARGSGPIGALLKLRRGVIR

SEQ ID NO: 23571 - protein, 399 aa, Triticum aestivum
  misc_feature (117)..(117): Xaa can be any naturally occurring amino acid
  misc_feature (194)..(194): Xaa can be any naturally occurring amino acid
  misc_feature (387)..(387): Xaa can be any naturally occurring amino acid
MAKLLAVLALVAAAAPFLGVAGQEGEGGSELLPFAVGAAPEGCDVGQGEWVYDEAAAPAYEEAACPYIPAELTCQAHGRPDKSYQHWRWQPRGCSLPSFNATVMLEMADGKCGSLFXVGNSPNPGQVRLAVWPCAHRPIRGGSSSFEAVDALSIFRAKAYDATIEFYWAPLLAESNADDGVEHQLNDRVIRGAXPMDRHSRFWKGADVLVFNSYLWWMTGDKIQILRGADNDMSKDIVEMGAEEAYRLVLHQVVRWLDGNVDPKRSRVFFVTASPTHATGQLWGDEAEGSNCHGQTKPIADASYWGSTSRAMLRVTGEVLAASARVPVGVVNVTQMSEYRRDAHTQVYREQWAPPTKEQLADPKSYADCTHWCLPGVPDAWNELLYXWKLFFPANDQAL

SEQ ID NO: 23572 - protein, 188 aa, Taiwanofungus camphoratus
MVAIVQKPAPGFKATAVVDGQFQDISLSDYFGQWVVLFFYPLDFTFVCPTEILAFNDALPQFKELNTTVLSVSTDSHYAHLAWATQDRKQGGLGPNLKLPMIADKNTQISRDYGVLIEEEGVALRGLFLIDPKGTLRQITINDLPVGRSVDETIRLIKAFQFTVCRSTVISIDINTGSHTDRLKGRTW

SEQ ID NO: 23573 - protein, 333 aa, Ralstonia metallidurans CH34
MSVLLPRIVVLATGGTIAGSSANPASSAHYQAATVPVSQLVQAVPALADVARVEAEQVAQVDSKDMMFDLWRMLAARIGYWSAQDDVAGIVITHGTDTLEETAMFLHLTQACPLPVVMTAAMRPSTSLSADGPLNLLDAVRVAASPVAVGKGALVVLNQQIHAARDVVKAHTSAVDAFHSPVAGPLGFVQDTYVHFSRTPGPDQAPRLPVPAAWPLVEIVASYAQPGRVGIDAMVAAGVLGFVVAAAGNGSVHETLTAALVDAAACGVAVARSSRTGAGHVAIPAPPRPAGGVFVSAGDLNPYKARVLLLLALAGDPSLGRDAARLQALFERY

SEQ ID NO: 23574 - protein, 248 aa, Synechococcus sp. CC9311
MLDQIRADFAIIRERDPAARGPLEILLCYPGFQAISLHRLSHRLWRSRLPLKLPARLLSQLGRGITGVEIHPGATIGQGVFIDHGMGVVIGETSEIGDRCLLYQGVTLGGTGKDSGKRHPTLANNVVVGAGAKVLGAIEVGANTRIGAGSVVVRSVEQNCTVVGIPGRVIHQSGVRINPLAHSALPDAEANVIRNLMERIDQLENQVSELQSCLSAVAAGGTGETIREISMGKSQNLKDREILEFLGD

SEQ ID NO: 23575 - protein, 407 aa, Idiomarina baltica OS145
MTDNSAKMAVTREMFSDVMVPNYNPAQMVPVKGEGSRVWDQAGKEYIDFAGGIAVNCLGHCHPAMVNALHEQSQKLWHLSNVFTNEPAIRLAKKLTDATFADRVYYANSGAEANEAALKLARRWAIDVHGEQKQKIIAFNKGFHGRTFFTVTVGGQPAYSDGFGPKPGAIEHVPYNDADALAKLIDDETCAVMMEPLQGEGGVVPPEQDFVKQVRELCDKHNALLIFDEVQTGFGRTGTLYAYEQLGVTPDILTSAKSLGGGFPIGAMLTTAAIAEHLKPGTHGSTYGGNPLACAVSEAVLEVVNTETVLEGVKQRETMIKEHLAAINDKYNVFKEVRGMGCLIGAELTEQFEGRARDFLLAGQEHGVMVLVAGASVIRFTPSLIIPEEDIKEGLKRFEHAVAQVVG

SEQ ID NO: 23576 - protein, 436 aa, Saccharomyces cerevisiae
AVSKVYARSVYDSRGNPTVEVELTTEKGVFRSIVPSGAATGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 23577 - protein, 367 aa, Silicibacter pomeroyi DSS-3
MSNPSLLILPGDGIGPEVMAEVRKIIGWFGDKRGLNFDVSEDLVGGAAYDVHGVPLADETMAKAQEADAVLLGAVGGPKYDDLDFSVKPERGLLRLRKEMDLFSNLRPAQCFDALADFSSLKKDIVAGLDIMIVRELTSGVYFGEPRGIFEEGNERVGINTQRYTESEIERVARSAFELAMRRSKKLCSMEKANVMESGILWREVVTRVAKDYPEVELSHMYADNGAMQLVRAPKQFDVILTDNLFGDILSDCAAMLTGSLGMLPSASLGAPMANGRPKALYEPVHGSAPDIAGQGKANPIACILSFAMALRYSFDQGAEADRLEAAVEQVLADGVRTADLLGTEGVTPVSTTEMGAAILAKLDASL

SEQ ID NO: 23578 - protein, 312 aa, Saccharophagus degradans 2-40
MTSTLIIGESMVELTHHTDDLLRKSFAGDTHSAAVYLKRLAGDSEDVSLLSAVGLDGLSNELIEALNKEGVSTHTVLQHPTRTIGLYMVHTDSQGERSFQYWRSQSAARATMALLEQQPALLADLAPTRVFFSGITLAIFDSTARAQLRELLEQLKMRGTQVIFDPNYRPALWQNKEETKAEYQWAFAVSDVVLPGLDDLNKLYGTSSMQSAVALVKTLCSGEAIIKNGEHGVTYLNADTQFSVEVAPVAKPVDTTAAGDSFNAALMAARSKGLPPQQAIEFAASVAAIVIQHKGAIIPRTELQHAINQLNT

SEQ ID NO: 23579 - protein, 585 aa, Thermus thermophilus HB8
MAGLVDRVSGARLDPAAEAEIRYLEAMIARLEAGEEDPEDFRVFRLKNGIYGIRGRPEHHMIRIKLPVGRITPEGLRVLADVAERYAENRLAHVTTRQAVQLHHVHRRDVPKVLRAVNAVGLTTREACGHSIRAITCCPYAGVSPEEPFDVTPYAEAAYRYFLRHPVGQNLPRKFKIAFEGCAADHARTPIHDIGVVAALEGGKRGFRVYVGGGLGAAPMSAELLEAFTPEEDLLPTMLAIVRLFDRYGNRKVLTQARLKFLVKKWGIAAFREAVREERRLVKLTASGEDLEAWAPPPEPEPPRLPSPPKKPFSFAPGFDAWRRTNLFKQKQEGFYTVTVRLPLGDITPEGLRALAAIAETYAAEVRSAISQNLLLRFVPEEALGGLYEALLEAGLALPEAHTLLDITRCPGADTCNLAITRSRGLAQALEAHLATLPLAQDPGAKAIGVKISGCPNSCGQHHIADIGFYGSSRKVGEREVPHYVLLLGGRTREGEARFGQVVGRLPARRVPEAVERILKRYLEERQNGESFQAYLDRVGAASFKPLLQELQEVPPYEEAPEFYQDLGAEGEAFSVQLGRGECAV

SEQ ID NO: 23580 - protein, 221 aa, Idiomarina baltica OS145
MQPLIAPSILSADFARLGEEVNNVLAAGADVIHFDVMDNHYVPNLTIGPMVCKALRDYGVTAPIDVHLMVKPVDRIVPDFAAAGASIISFHPEASEHVDRTIQTIKEHGCQAGLVFNPATPLHYLDYVMDKIDLILLMSVNPGFGGQKFIPGTLDKLRQVRERIDASGRDIRLEVDGGVNCDNIGEIAQAGADMFVAGSAIFNADDYAEVIRTMKQAINAN

SEQ ID NO: 23581 - protein, 372 aa, Medicago truncatula
MAGSILWYTHVTMKNMNIYQYPIEKLRVQPVGLIVAFAVMATLAAECTCDEEDEERDRSKALRYKIAALVSILVASAIGVCLPLLGKVIPALSPEKDIFFIIKAFAAGVILSTGFIHVLPDAFENLTSPCLNEHPWGDFPFTGFVAMCTAMGTLMVDTYATAYFQNHYSKRAPAQVESQTTPDVENEEHTHVHAHASHSHAHGHISFDQSSELLRHRVISQVLELGIIGHSVIIGISLGASESPKTIRPLVAALTFHQFFEGMGLGSCITQANFKSLSITIMGLFFALTTPVGIGIGLGISNVYDENSPTAFIFEGIFNAASAGILIYMALVDLLAADFMNPRMQKNGRLQLGSNISLLLGAGCMSLIAKWA

SEQ ID NO: 23582 - protein, 465 aa, Campylobacter jejuni subsp. jejuni NCTC 11168
MQGFISQVLGPVVDVDFNDYLPQINEAIVVNFESEGKKHKLVLEVAAHLGDNRVRTIAMDMTDGLVRGLKAEALGAPISVPVGEKVLGRIFNVTGDLIDEGEEISFDKKWAIHRDPPAFEDQSTKSEIFETGIKVVDLLAPYAKGGKVGLFGGAGVGKTVIIMELIHNVAFKHSGYSVFAGVGERTREGNDLYNEMKESNVLDKVALCYGQMNEPPGARNRIALTGLTMAEYFRDEMGLDVLMFIDNIFRFSQSGSEMSALLGRIPSAVGYQPTLASEMGKFQERITSTKKGSITSVQAVYVPADDLTDPAPATVFAHLDATTVLNRAIAEKGIYPAVDPLDSTSRMLDPNIIGEEHYKVARGVQSVLQKYKDLQDIIAILGMDELSEEDKLVVERARKIEKFLSQPFFVAEVFTGSPGKYISLEDTIAGFKGILEGKYDHLPENAFYMVGNIDEAIAKADKLKG

SEQ ID NO: 23583 - protein, 146 aa, Triticum aestivum
  misc_feature (129)..(129): Xaa can be any naturally occurring amino acid
MERSRGWRSLVRDRVPKVSEEAGRHSSDGAPAPPAAPAPAPAPAPATKPSPPTRSGIPPRYDLDAKWDACLDLSIRRVAYSSLAGAFGGLLLFRSPTTRWASVALGAGVGIGAAFTECSYIFNGSPPKXGRPKASTGPAHSEGGDN

SEQ ID NO: 23584 - protein, 174 aa, Triticum aestivum
MAAAGDAGEKKMITLKSSDGEEFEVEEAVAMESQTIRHMIEDDCADNGIPLPNVNSKILSKVIEYCNKHVQAKPADGAAAAAGASDAAAPTAPAEDLKNWDAEFVKVDQATLFDLILAANYLNIKGLLDLTCQTVADMIKGKTPEEIRKTFNIKNDFTPEEEEEIRRENQWAFE

SEQ ID NO: 23585 - protein, 503 aa, Triticum aestivum
PGRSARVDPRLPAKAPATAKKIEESSESSDSESSDSEKPATEVKNSAVATAQKKNQDGSDSDSDESSDEDMVTKKPAVAVKKGKESSDSSDSDSDSDSEEDTTAKTVSVKKEESSGSSDSDSDSDSDEPAKSTIPAKRPLTTEKKSEHSKDDSDDSSDESDEEEPPQKKPKDSSSGAAKPVSKAAKKESSDDDDSSEESSDSDEEKSKSVSVAKSKQNEPKTPASSGQATTGSKTLFVGNLSYNVETEQVKQFFGEAGEVMDIRFATADDGSFKGFAHVEFATTEAAQKAYELNGENLAGRPVRLDFARERGAITPGSGRDNSSFKKPGQSNTAFVRGFDASLGEEEIRSSLQDHFSSCGDIRRVSIPKDYDTGASKGIAYIEFDDSSSLPKALELNGSNIGEGLSLFVDEAKPRADNRDGADSGNRSAGRFDGAGGRRGRFDGGGGRRGGRFDGGSGRRGGGRFGRGDRGGRSDRGRGRGGAPPRQSAGTPSAGKKITFGDD

SEQ ID NO: 23586 - protein, 433 aa, Staphylococcus epidermidis ATCC 12228
MAFEFRLPDIGEGIHEGEIVKWFIKAGDTIEEDDVLAEVQNDKSVVEIPSPVSGTVEEVLVDEGTVAVVGDVIVKIDAPDAEEMQFKGHGDDEDSKKEEKEQESPVQEEASSTQSQEKTEVDESKTVKAMPSVRKYARENGVNIKAVNGSGKNGRITKEDIDAYLNGGSSEEGSNTSVASESTSSDVVNASATQALPEGDFPETTEKIPAMRKAIAKAMVNSKHTAPHVTLMDEIDVQELWDHRKKFKEIAAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 23587 - protein, 468 aa, Staphylococcus epidermidis ATCC 12228
MVVGDFPIETDTIVIGAGPGGYVAAIRAAQLGQKVTIVEKGNLGGVCLNVGCIPSKALLHASHRFVEAQNSENLGVIAESVSLNYQKVQEFKTSVVNKLTGGVEGLLKGNKVEIVRGEAYFVDNNSLRVMDEKSAQTYNFKHAIIATGSRPIEIPNFEFGKRVIDSTGALNLQEVPNKLVVVGGGYIGSELGTAFANFGSEVTILEGAKDILGGFEKQMTQPVKKGMKEKGIEIVTEAMAKSAEETENGVKVTYEAKGEEQTIEADYVLVTVGRRPNTDELGLEELGLKFADRGLLEVDKQSRTSIENIFAIGDIVPGLPLAHKASYEGKVAAEAIDGQAAEVDYIGMPAVCFTEPELAQVGYTEAQAKEEGLSIKASKFPYAANGRALSLDDTNGFVKLITLKEDDTLIGAQVVGTGASDIISELGLAIESGMNAEDIALTVHAHPTLGEMTMEAAEKAIGYPIHTM

SEQ ID NO: 23588 - protein, 507 aa, Arabidopsis thaliana
MINVEFQNCFIFMLLCLFSLLCYSLLFRKPSSRQNSYDCDLPPSPPSMPIIGHLHLILSSLVHKSFQKISSKYGPLLHLRIFNVPIVLVSSASVAYDIFRVHDVNVSSRGPPPFEESLLFGSSSFISYWKFMKKLMVTKLLGPHALERSRKIRADELYRLYTNLLDKAMKKESVEIGKETMKLTNNTICKMIMGRSCSEENGEAKIVRGLIAESFTLSKKFFLAATLRRLLEKLGISLFQKEIMGVSRGFDELLERILREHEEKPDEHHDTDMMDALLAAYNDEKAEYKITRNQIKAFIVDMFIAGTDISALTTQGTMAEIINNPNVLVRIREKIDSVVGKSRLIQETDLPKLPYSQAVVKEGLRLHPPTPLMVREFQEGCKVKGFYIPASTTLVVNGYAVMRDPNVWEEPEEFKPERFLASSRLREEEEIREQALKYIAFGSGRRGCPGTNIAYIFVGTAIGMMVQCFDWKIKGDKVDMKEAIGGLNLTLAHPLKCTPVARSPKPF

SEQ ID NO: 23589 - protein, 337 aa, Aspergillus nidulans FGSC A4
MPDIESDWIAKLYSSALQTRKMADTAGWSTIESDEGVFTSLVENLGVKGVQFEELISLDPDTIRSLGTVYGVIFLFKYLRQTPDINTSSSADGTPTDPSTLPPSFFFANQTIQNACGTQAILSVLLNHDTPSPENNNDPITLGPELSSFKDFTTGFPSDLRGEALSNSEAIRTAHNAFARASPFVDETVRPRDEDEEGDVYHFIAYTPVNGTLYELDGLQASPISHGPCDASIFPEKVIEVLQKRIARYPETETRFNLMAVVKDLRIRAAEMGDQEALNTEERKRAGWAWENSLRRSNFVGFIGEVLKGVTKVKEEEGSVEEWVKRAEAETARRLRR

SEQ ID NO: 23590 - protein, 430 aa, Triticum aestivum
MPRSWRPVLASATKCCSSEDAVVAGNGLTSCRPARSEFSRRLASFRRLSSMTNSPATPRDGKDDEAAGGMGMGPMQLHSFSLNELRGVTHDFSSGYLLGEGGFGTVHKGFVDAGMRPGLEPQPVAVKQLDIAGHQGHREWLAEVIFLGQFRDQHLVKLLGYCCEDEERLLVYEFMPRGSLENHLFKRISATLPWGTRLKVAIGAAKGLAFLHGAKQPVIYRDFKASNILLDSEFTAKLSDFGLAKMGPEGEDTHVTTRVMGTHGYAAPEYVQTGHLTMKSDVYSFGVVLLELLTGRRAMEHIRGRGAHAKQTIKLVEWTRPYLASSRRLRCIMDPKLAGHYSVKGARGLAHLAVQCTSAQPRDRPSMVAVVEALERLQGLKDMAVSIGLWPTTPVAGRNALSAKFRAEMEGAGTGSGAVLRRRSASAKLP

SEQ ID NO: 23591 - protein, 461 aa, Triticum aestivum
MVKAPLHSSSSAAAAAATFSLVAKKARLSPFILLSLLFMLLFSFLYGEELAALVGRPAGRHSAAHLDVSVNREHQQPDDGSGVEDGWQRKKKRWQGRLAFAVNDEDEDEECDVFSGSWVRDEEAHPLYREEECPYIQPQLTCQAQGRPDRGYQSWRWQPHDCTLPAFNPTQMLETLRNKRMMFVGDSLNRGQFTSMVCLLQSAIPSPDAKSFEMSADQQHTVFTAREYNATVEFYWAPFLLQSNADDAVVHKISDRMVRNGSIAHHGRHWEGADVLVFNTYLWWCTGLRFRVVNGPIADAREEDAAWVSTEEAYGMAFRDMLQWVRENMDFNTTRVFFTSMSPTHGKSQDWGGAAGGNCYNETAMIEDAGYWGTDGRRSVMRVIREILDGDGADVPLTFLNVTQLSMYRKDAHTSVYKKQWSPLTPEQVADPRTYADCVHWCLPGLQDTWNELLYPKLFYP

SEQ ID NO: 23592 - protein, 216 aa, Triticum aestivum
NKFVQKSRLVPVRNSRDIVDPRVRDLLLGNTGPFSSGDWILPDLTIQGSLKINSTIKTFPNTFYFSYATKRTRKLFGITVPSSVLGVHPMLFLRVLQMCMWRHPQNAPLPYKGYRDEDWEDNDGALNTISMTHPRIPIEHPNRLVVDDSDCNPLQPGIWYHKIIEGDHILFIVNRERAGVQFDLLYDGIFERCRKHAFRKTPPTMPKRSKSIERLN

SEQ ID NO: 23593 - protein, 399 aa, Pseudomonas fluorescens PfO-1
MSGNRGVVYLGAGKVEVQKIDYPKMQDPRGRKIEHGVILRVVSTNICGSDQHMVRGRTTAQVGLVLGHEITGEVIEKGSDVESLKIGDLVSVPFNVACGRCRSCKEQHTGVCLTVNPARAGGAYGYVDMGDWTGGQAEYVLVPYADFNLLKLPDRDKAMEKIRDLTCLSDILPTGYHGAVTAGVGPGSTVYIAGAGPVGLAAAASARLLGAAVVIVGDVNTIRLAHAKAQGFEIVDLSKDTPLHEQIAALLGEPEVDCAVDCVGFEARGHGHDGVKSEAPATVLNSLMGVVRVAGKIGIPGLYVTEDPGAVDAAAKMGSLSIRFGLGWAKSHSFHTGQTPVMKYNRQLMQAIMWDRINIAEVVGVQVISLDQAPEGYGEFDAGVPKKFVIDPHKLFSAA

SEQ ID NO: 23594 - protein, 341 aa, Burkholderia xenovorans LB400
MKATRNFRRPRVLIVGCGDVGMRCVPLLQPRAHVFALTSHAGRSAGLRAAGVTPLVGDLDVRRSLKRLAGLAPTVLHLAPPQKTGDDDRRTRALLATLGTRRASALRAAHGTVAAVGRLRRVRASWAESETAGIVPDGVRRTAGSRASVRLVYASTTGVYGDCGGAWIDETRVTQPANARARRRASAERQLRRATARGSVAASIARIPGIYAGNRLPLARLEKGTPALTDADDVYTNHIHADDLAAILVRLATHGRPGRVVHASDDSALKMGEYFDEVADAFGLPRAPRITRVEAERQIEPTLLSFMRESRRLLNRRLKQELSVRLRYPSVEDFLRESVKA

SEQ ID NO: 23595 - protein, 232 aa, Triticum aestivum
CAISQASLADSFLADLDELSDNEAYPEEDNAEAVGVDEDGDDDMPDLESLNRDDLDSVSKLHKTQRYIDIMQKVEGALEKGTDLSNQGFILEEDPEYQLIVDCNALSVDIENELIIVHNFIRDKYRLKFPELESLVHHPIDYAHVVKKIANEMDSTLVDLEGLLPSAVIMVVSVTALTTSGKPLSEENLVKTIEACYRALNLDAAKKKVLDFVEGRMGYIAPNLSGIVGSAV

SEQ ID NO: 23596 - protein, 1265 aa, Arabidopsis thaliana
MTTRTSNHKRSRSDPVPRKSLKNKKSSEALYNIHMREIEQLKSLLKSRKLHPGGRRVSSDEIDLLLQEDEVLVRREMKTVLGRKLFLEDSKNEDSSIPKEAKKLVEEIAGLELQVMYLETYLLLLYRRFFNNKITSKLESEEKERSEDLLECTKLIDSPKKGVCSPQKLVEDSGIFRSHSSLSHCSGYSFRMSPHAMDSSYHRSLPFSMLEQSDIDELIGTYVSENVHKSPNSLSEEMVKCISELCRQLVDPGSLDNDLESSSPFRGKEPLKIISRPYDKLLMVKSISRDSEKLNAVEPALKHFRSLVNKLEGVNPRKLNHEEKLAFWINIHNSLVMHSILVYGNPKNSMKRVSGLLKAAYNVGGRSLNLDTIQTSILGCRDWQVFRFLFASRSKGRAGDLGRDYAITHRESLLHFALCSGSLSDPSVRIYTPKNVMMELECGREEYVRSNLGISKDNKILLPKLVEIYAKDTELCNVGVLDMIGKCLPCEARDRIQKCRNKKHGRFSIDWIAHDFRFGNDYRIFPSSFNLHGTSPSVEFKSELIDPHSKNSAAPFEISRVFHCDGLLLCTSHFDASRVLVWNPLTGEPEARSFDLGYCQVDNNCCNKSYKILSSHQRSEYFDIYDFNSDSWRFVEDMIPPGVSFGYSELSVSLKGNTYWLAIVVTETPRTISLLKFDFSIEKSVLVPLPYHSLQSRRFEASSLSVVREEKLSVLLQRDISSKTEIWVTSKIDDTTKVVSWSKILALDLSPHLQIWNDASFLIGEEKKVIMCERLVDVHTSKVMVYIVGENNVVTQVEFGVVEMDGCWAVIFNYVPSLIQIEQAGGNRNIVFFFTQDTSFTTINHRPIHLASSTTKPSMFGITKLSKLATLRSQKRSMKTIQEQLPNDLVEEILCRVPATSLRRLRSTCKAWNRLFKGDRILASKHFEKSAKQFRSLSLRNDYRIFPISFNLHGNSPSLELKSELIDPHSKNSAAPFEISRVIHCEGLLLCSSQLDESRVVVWNPLTGETRWIRTGDFRQKGRSFDVGYYYQKDKRSWIKSYKLLCYYRGTKYFEIYDFDSDSWRILDDIIAPRGSIGYSELSVSLKGNTYWFAKGVTEERPRTISLLKFDFYTEKSVPVLLPYQSRRLFQASSLSVVREDKLSVLLQLDQSSKTEIWVTNVIDETTKGAVSWTKVLALDLSPHLQIGNDGSFFLGEDKKVVMFCEKLIDENKVKDMVYIVGEDNVVTEVGFGVDEMDGCRAVILNYVPSLVQIERAGGNRKRGH

SEQ ID NO: 23597 - protein, 617 aa, Bacteroides thetaiotaomicron VPI-5482
MKRNLLFIILLLLLPGLHQVFATSTIKKVAPTFWWAGMKNPELQILLYGDRISSADVSLSADNITLQEVVKQENPNYLVLYLDLSKAAPQNFDIILKQGKKQTKIPYELKQRRPNASAVEGFDSSDVLYLIMPDRFANGNPSNDIIPGMLEGNVDRNEPFARHGGDLKGIENHLDYIADLGVTSIWLNPIQENDMKEGSYHGYAITDYYQVDRRFGSNEEFRKLTQEANAKGLKVVMDMIFNHCGSDNYLFKDMPSKDWFNFEGNYVQTSFKTATQMDPYASDYEKKIAIDGWFTLTMPDFNQRNRHVATYLIQSSIWWIEYAGINGIRQDTHPYADFDMMARWCKAVNEEYPKFNIVGETWLGNNVLISYWQKDSRLAYPKNSNLPTVMDFPLMEEMNKAFDEETTEWNGGLFRLYEYLSQDIVYSHPMSLLTFLDNHDTSRFYRSEADTKNLDRYKQALTFLLTTRGIPQIYYGTEILMAADKANGDGLLRCDFPGGWPNDTKNCFDAANRTPQQNEAFSFMQKLLQWRKGNEVIAKGQLKHFAPNKGVYVYERKYGDKSVVVFLNGNDREQTIDLVPYQEILPASSAFDLLTEKKVELRNELTLPSREIYLLSF

SEQ ID NO: 23598 - protein, 351 aa, Ralstonia metallidurans CH34
MEQTSSTPQTESRGGSQGNIRPRRISVAPMMDWTDRHCRTFHRALSQHTWLYTEMVTTGALLHGDVARHLDFSAAEQPVALQLGGSEPVDLAQAAKLGEQWGYKEINLNCGCPSERVQRGAFGACLMAEPQLVADCVRAMRDVVSVPVTVKHRIGIDTIEHYGFVRDFVGTIAEAGCDIFIVHARNAILKGLSPKENREIPPLRYEVAYELKREFPHLEILINGGVVSYGEIDEHLRHVDGVMIGRQAYHDPYFLSEMDARFYGGTAPIVTREMAELTMQAYIGDLVEKGGYMGAATRHMLGLHRGIYGGRGWRRVLSDARRMNAARSRADVDALFEEARSHLRPGLQEAA

SEQ ID NO: 23599 - protein, 450 aa, Idiomarina baltica OS145
MSRHYDYLAIGAGSGGIASANRAAIRGAKAAVIEANAVGGTCVNVGCVPKKVMWYGAHIAEAVKYSSAYGFDLDQKGFDWATMVKNREAYIERIHGGYHRGFQGNGVEFIEGFAKFVDHRTVEVNGEKITADHITIATGGRPMIPDVPGAEHGIDSDGFFALKEQPKKAAVVGAGYIAVEIAGVFQALGTDTHLLVRRDRPLRSFDRYITDGLLERMEQDGPTLHTETVVKEVVKEQNGTLTLHFENGETMKDVDCLVWAIGRVPATDKINLETTGVELDAQGFIKVDKFQNTSVQGIYAVGDNTGATALTPVAIKAGRQLAERLFNDMPNAHMDYENIPTVVFSHPTIGTVGLSEEDAIVKYGKSNIKVYTSSFAAMYNAVTPHRALSYFKIVCYGKEERVVGIHGIGEGMDEILQGFATAMKMGATKADLDSTVALHPTSAEEFVTMR

SEQ ID NO: 23600 - protein, 339 aa, Synechococcus elongatus PCC 7942
MAQSTTSETHTRDLDRDCTTLSRHVLEQFQSFSPEAQDLAALMQRIGLAAKLIARRLSHAGLVDDALGFTGEINVQGEASKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFCSGPKVSPVHPGNASPRRLQRRYSGALVADFHRILMQGGVFLYPETVKNPTGKLRLLYEAPPMAFLAEQAGGKASDGQKPILLRQPQALHRRCPLIIGSAADVDFVDSLLG

SEQ ID NO: 23601 - protein, 333 aa, Streptomyces coelicolor A3(2)
MTRPVVEGGPAVVCLGETMAQIVPIDGLRLHEASACAFGVAGAESNVAISLSRLGTAAFWAGFVGDDPMGLRVLGELRRHGVVTKLARTMPGRRTGVYFKDPAPEGSDIYYYRSGSAATLMDGEYAERIAAVRPRWIHLTGVTPALSENCREAVISLIELAGDTGASVSFDVNYRPSLWPARDAAAQSLMAIADRCNVVFVGLDEAQTLWKSCTAGAVRDHLPSPDVVVVKDGGREAVAFRGGRRTAVPALPVDVVEPVGAGDAFAAGWIHGALVGLDEAGCLRLGHLLAGAAMTSLSDVADLPTAPAALVARAKHGNEWPGHGSPAEASPHP

SEQ ID NO: 23602 - protein, 450 aa, Idiomarina baltica OS145
MSYVKETIDMLKRTSPAQNEFYQAVEEVLESIEPLLEEHPKYRQQAIIERLVEPERQIMFRVPWQDDKGQVHVNKGYRIEFNSALGPYKGGLRFHPSVNAGIIKFLGFEQIFKNALTGLPIGGGKGGSNFDPKGKSDAEIMRFCQSFMTELHRHIGPHTDVPAGDIGVGTREIGYLFGQYKRLKNRFEGVLTGKSLRWGGSHARKQATGYGAVYFAQCLLGDRGEKLSDKRCLVSGSGNVAIYAMEKLYELGATPVTCSDSNGMVYHKSGIDLDLVKQIKEENHERLKTYLDTHDDAEYIAREDYPEDGHSVWRYEGDIAFPCATQNELTEQDAQALAENGCLAVLEGANMPSTQAAVDFFVEQKIGYGPGKAANAGGVATSQLEMAQNAGMQQWSFDEVDRKLQEIMKTIYSDCKRTAEQFGSPNNLVLGANIAGFKKVADAMIEQGVV

SEQ ID NO: 23603 - protein, 670 aa, Shewanella sp. ANA-3
MVEKITGMLALIGVLSLFCQWVGWKLRLPAILPLLLCGLMLGPAFGVLNPDEIFGDLLFPIISLGVAVILFEGALTLNFKEIKDHGRMVTHLVSIGMVITWGCISVATFYLLNFSWEVALLFGALVVVTGPTVIVPMLRSVRPKSQLASILRWEGIVIDPIGALLAVLVFEYITVSGDPTSHVLYALGSMLTLGLGLGAASGYLIGQVIRRNLLPHYLRNTAVLTLMLGIFVGSNLLQEESGLLTVTVMGIWLANMRGVDIAEILEFKETLTVLLISALFILLAARLDSNAMMDLGWGGVGVLAVTMLVARPLSIWVSGIGTSLSKADKWFLCWIAPRGIVAAAVSSLFAIKLEATNVQGADAIVPLVFLIIIGTVVIQSLTAGRWAKYLGVTSGSAQGLLIFGASKFSRELAKILKAKDIKVLLADSNWDNIRLARMDNIPVYFGNPASEHAETYMDLTGIGRVLIMSPYKQLNPLVTFYFQDVLGSKKVFGLNNAEQGSARHQLSETYKQRLCLFGDAVSYAKIASQMAKGAQLKVTNLTENFTFEHFRKRYGETALPLVYLTKEGKVVIVSGNDTQFPNGIELISLLPVEALEEAKIQQAIAEQEVIAAQAKAAEEAALAKAKAEEEAEAERQRLEQQAKTKADEPSQPEADVQDNINTSDETLAKG

SEQ ID NO: 23604 - protein, 109 aa, Zea mays
  misc_feature (55)..(55): Xaa can be any naturally occurring amino acid
MWTYRDEDPRLHDIKTKIRVVPNFPKPGIEARGFIFGSPIALAIRAKFVPLRKPXKKLPGKVISQEYILEYGRDCLEMHVGAVEPGERALVGDDLIATGGTLCADMDLL

SEQ ID NO: 23605 - protein, 392 aa, Oryza sativa Japonica Group
MPRAAGLAVAVTVDCIPPPSLLAQSCGHGAATAAAYPRVRGERGRLFPKQGPTDLSLLLVGAAAAVVAAATPRTAHAASGGVMGGRDTSPSPSSYSSSSSSSSSSSPSVRHYHYYPPSPTRSSSPPTPAAHTTSCPICPYVLLAAAVGITIIFLCTLASNQKTTVVKLQVALQALAKTMQKDLNTIAAKVDTTKTASLQIHVNGDDMFLEPSERLLVLFSLIVDEIDSWEEHFDKISIEERSKTDEETLFNVEGIKISKKYSKNPESCRKEYIVLTIILAAEGKLKFPQIRSADDLRLVLGMLNGIHASEIKGVQILWTPQEEDDALSEERLLKDYPYLRPLKQVLIGESKQLLLGESKFKQILFGESEEKQLLLGEPKEPSVQEDPNNTKG

SEQ ID NO: 23606 - protein, 453 aa, Staphylococcus epidermidis ATCC 12228
MGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPHIIDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 23607 - protein, 423 aa, Oryza sativa Japonica Group
MAIAARLLSTAPCRSPSSWPLPPSKPYLRFPSAPLLLLLRSPAAASVIHLSPPPVTPLAVACDDRHALPDSDEPRNRNPPDHPAPLLAAAAAAAAAVASPHAALALSGGSMGGCSDTSSSYSSSFSSSSSSDSFSSWSSSSDSWRSSSSSSSSPPKKKKVVVVESADLETHESVGTAASPPPPPPVALTPWEKFWISVAVVLGVGGLVFGLIFLIKRSIPPPRTISVVKLQIALGGVAAAKSFQKDLNRIAERVQGSSRRWYKFILSDLFKKYYYQVIAFFAEINLFVHRTQFSIKVMVDIKDSDSWNGHFKKISLEERGKFDEETLSNLEGVKRNKEYSTKMDGSKNEYIVLTILVATDGTMDFPKLITNAADLKVALTKLYSTPETGLEGIHVLWAPQDKDDILSKERMQKDYPYLKPLSV

SEQ ID NO: 23608 - protein, 393 aa, Pichia jadinii
MLRIGKLNLSTMSSAQQRLAQVGSHLTAQKQSLAPQRPYKITVIGSGNWGTTIAKVLAENAGLRPHLFQHQVDMWVFEEKINGVNLTEIINTQHENVKYLPGIKLPKNLHAEPSIVKAAEGADLLVFNIPHQFLPGICKQLSKATLKPHVRAISCLKGLEVTPNGCKLLSTYITEHLGVHCGALSGANLAPEVAKEKWSETTVAYRLPNDFQGHGKDIDRYVLRAAFHRPYFHVRVIEDVAGVSLAGALKNVVALGVGFVHGLNWGDNAASAIQRFGLNETIKFAEVFFPGETNQDTFTKESAGVADLITTCSGGRNVRVAKAMAITGKSAVEVERELLNGQSAQGIITSKEVHELLAAKNLTKEFPLFEAIYQIVYGTESIERLPELIEEDE

SEQ ID NO: 23609 - protein, 651 aa, Aspergillus nidulans FGSC A4
MSAEHDFAAENPPVSPHSDGDSAPVTLEDEVSSPNTKTIPVLRSTSDKVSGITPSSTHIGQVNAARYGGGGGGINTRPQASIGSASQDILAKMKAFQLSRQGVPPNLNQSVSTGAISQGGQQSTPSVSGPLSGNNSPSAMNGPLAPTASGRLPPTHRPGPPKNWASAPTVGGGSPVSGSPKGGLAAKRMKPGLKLSDATGPSNPAAGGQSPAGGPIGGGESAFSKYSEYIDTKSGTLKFKNKAVLHGGGIEFSSGQSFSISLDEVDRMDELGKGNYGTVYKVRHSRPHMRKPGQGLSGIVSRPQGSDGSDTELKPQDSLTGAVMAMKEIRLELDESKFAQIIMELDILHRCVSPFIIDFYGAFFQEGAVYICVEFMDGGSVDKLYGDGIPENILRKVALSTVMGLKSLKDDHNIIHRDVKPTNILVNTRGQVKICDFGVSGNLVASIAKTNIGCQSYMAPERIAGGGVQQSGASGGTYSVQSDIWSLGLSIIECAIGRYPYPPETFNNIFSQLHAIVHGEAPNLPESEYSEDAHSFVRACLDKNPQKRPTYNMLIRHPWLSSLMQPPDSDNPDVPSVSLADGASGDVTPPVTDDQEVADWVKDRLEKRLNGLLKDETKPALHAVPLDAVPGSPLLDDPPIANLSLASSMPE

SEQ ID NO: 23610 - protein, 273 aa, Staphylococcus epidermidis ATCC 12228
MPLYDFAKGLILEAGNKSRLMMQEELDIKTKSNPNDLVTNVDKATENYLYETILHNYPDHQVIGEEGHGHNLEYLKGVIWVIDPIDGTLNFVHQKENFAISIGIYHDGKPYAGFVYDVMKDVLYHAKVGQGAFENTHKLEMIQNTELKRSIIGINPNWLSKPILSDIFSSIVNEARSARAYGSAALEIISVAKGQLAAYLTPRLQPWDFAGGLLILNEVGGIGTNLLGDKLDFNQPNSILIANPSLHREILNHHLNQQRDTLITLHEKRFGKR

SEQ ID NO: 23611 - protein, 472 aa, Aspergillus nidulans FGSC A4
MPPVETKQYDYIVLGGGSGGSGSGRRAAGWYGAKTLIVESGRAGGTCVNVGCVPKKMTWNFASITESIEAGRHYGYDLPHNIDVNYTHFKKLRDSTIERLNGVYEKNWGNEGIDLVHGRARFVEKKTIEVTNQDGSRTRYTAPHILIATGGRPSLPDIKGSEHGISSDGFFEIEELPPKLAVVGAGYIAVELAGVMGTVGVDTHMFIRGETFLRKFDPMIQKTMTERYEAVGIHVHKKHPGIKEVQLLRDGKGKDKLLKLIMNDGSEMEVNELLWAIGRVPEVEDLHLEIPGVELNKSGHVVVDEYQNTNVEGIYAIGDVTGQAELTPVAIAAGRQLGNRLFGGPQFKNAKLSYDNIPTVVFSHPEVGTVGLTEPQARERFGDENVKVYHTRFPAMFYSVFPPEEKAKNPTEFKMVVAGPEEKVVGLHLLGLGVGEMTQGFGVAVKMGATKKDFDSCVAIHPTSAEELVTLR

SEQ ID NO: 23612 - protein, 361 aa, Glycine max
MTGCCFPVTFHRSGSRRVSFRLVRSSSSGSSKHRGRESHKGPLVVCFGEMMINLVPTVARVSLADATAYKKFPSGATANVAVGICRLGGSAAFIGKVGNDEFGHLLSDILKQNGVDNSGLLFDDHARTALGFYALKSNGEPEFMFYRNPSSDVLLRPDEIDMDLIKKATIFHYGSVSLIKEPCRSAHLAAMNAAKVSGCFLSYAPNLALPLWPSKEAARQGIMSVWNYADIIKVSVDEIRLLTEGDDPYDDTVIMKKLHHYNLKLLIVTEGARGCRYYTKDFKGWVAGFEVEAIDTTGAADSFVGGLLSIVAAHNHIYKDEKRLREALDFANACAAFTVTGRGAIPSLPTKDAVLRIMFSY

SEQ ID NO: 23613 - protein, 288 aa, Oenococcus oeni PSU-1
MFNLTKAFLKEVPTNAEVTDFHEVHGGDINKAYSLTDAQGGRYFLKVQPNSVLAFFQHEADGLKLLGQAARVPKVIALGHVGQDQWLLLEYLNATNYGNQYSLGQDLAKIHSITSPNGQFGFDKDFKAGKTSKINTWQSSWYEFFVKQRLNVLRELLINEGKWNDDQNYKKAIEIFQSLMEKHDSRPSLLHGDFWSGNFMFDADSGQPIFIDPDVYYGDPEFDIGITTVFGGFNQDFYVGYQSTKPFQSGAERRLMFYQLYYLMVHAHLFAGSYIQAYRGKLAQIIQQ

SEQ ID NO: 23614 - protein, 416 aa, Bacillus halodurans C-125
MQPLKALHVPARTIMTPGPVEVDPRVLQAMSRSILGQFDPAFTAIMNDTMEGLRRVLQTQNQWAYPIDGTSRAGIEAMLCSIIEPGDRVLIPSFGRFGGLLAEITERCGGEVHMIHTEWGTVFAPDTIIAAIKETEPKVVAMVHGDTSTGRIQPLQEIGYACREHDCLFIVDAVATVGGTDVKTDDWMIDGLITGTQKCLSVPSGMAPLTYNHRIEEILMERKSIEQGLVTGEQEELNHQRRIRSNYFDLSQLQEYWSPARLNHHTEATAALYGLYEGLRLILEEGLEQRFERHRTNERALVAGIEAMGLTLFGDPGCKLPTVTCVEIPEGINGETVRAMLLEDFAIEVASSFGPLHGKIWRIGTMGYSCQKKNVLQTLAALEAVLLRLQVKIPAGEAVQAALDVYKQVEYEKVSH

SEQ ID NO: 23615 - protein, 524 aa, Corynebacterium ammoniagenes
MTQPATTPRPVLVVDFGAQYAQLIARRVREASIYSEVVPHSATVKEIKAKNPAALILSGGPSSVYADGAPQLKPELLELGVPVFGICYGFQAMNHALGGNVAQTGDREYGRTEITHTGGVLHDGLEENHKVWMSHGDAVDKAPEGFTVTASSAGAPVAAMECVAKQMAGVQYHPEVMHSPHGQEVLVRFLTEVAGLEQTWTSANIAQQLIDDVRAQIGPEGRAICGLSGGVDSAVAAALVQRAIGDRLTCVFVDHGLLRAGEREQVEKDFVASTGAKLITAHEADAFLSKLAGVTDPEAKRKAIGAEFIRSFERAVAQALEESPEDSTVDFLVQGTLYPDVVESGGGDGTANIKSHHNVGGLPDDVEFELVEPLRLLFKDEVRAVGRELGLPEEIVARQPFPGPGLGIRIIGEVTEERLEILRQADLIARTELTNAGLDGDIWQCPVVLLADVRSVGVQGDGRTYGHPIVLRPVSSEDAMTADWTRVPYDVLEKISTRITNEVNDVNRVVVDITSKPPGTIEWE

SEQ ID NO: 23616 - protein, 583 aa, Aspergillus oryzae
MRRSVLRAVESAKPLARAPRSVSRSFATVNEAGSKDPVELDQITTLPNGIRVATESLPGPFSGVGVYVDAGSRYEDESLRGVSHIMDRLAFKSTKKRSSDEMLEVLEGLGGNIQCASSRESLMYQSASFNSAVPTTLGLLAETIRDPLITEEEVLQQLGTAEYEIGEIWAKPELILPELVHMAAYKDNTLGNPLLCPEERLGEINKAVVDKYREVFFNPDRMVVAFAGVPHDVAVKLTEQYFGDMQGKKSSNGPVLSGTGIETTLSNSQSAVEEGQVPTIPQFTPSSTTSTTPASPKSESSLLSKLPFLKSLSGSQKGSVSPLDPSLVEPSTFNLTRPSHYTGGFLALPPIRPPANPMLPRLSHIHLAFEALPISNPDIYALATLQTLLGGGGSFSAGGPGKGMYSRLYTNVLNQHGWVESCIAFNHSYTDSGIFGISASCSPTRTPEMLEVMCRELQALTLDNGYSALQAQEVNRAKNQLRSSLLMNLESRMVELEDLGRQVQVHGRKVGVKEMCDHIDALTVEDLRRVARQVFGGNVQNKGQGTGKPTVVLQEGELEGYKLRSFPWEEIQERIARWKLGRR

SEQ ID NO: 23617 - protein, 243 aa, Picea sitchensis
MRFDPVARTALAFVTLKADGEREFMFFRNPSADMLLTESELEVDLIQQAKIFHYGSISLITEPCRSAHLAAMRIAKDTGTLLSYYPNLRLPLWSSASAAREGILSIWDEADVIKVSDEEVEFLTEGADPYDDTVARNLFHPNLKLLLVTEGDQGCRYYTKDFSGRVNGVAVQAVDTTGAGDAFVSGILSELAKDLNLLQEEKGLREALKFANACGAITVTERGAIPALPTREAVLAALTKVLA

SEQ ID NO: 23618 - protein, 536 aa, Ostreococcus tauri
MNYVFYATLKAVVSSMSNFQHRVYAVKANPKFQKLHVMARGLPKSISQRVLPKFFVKKLAGLTPPRPSQLDLLPEAESVDGLAKVVRKIKTDLGVEYVYCWHALLGYWGGIHPDEENVAKYGSVMKYPRHTPGCLTVEPSQAWDPLTVGGVGVPSPDALQHFYVVMHDYLSESGVDGVKVDAQAVIGALGYKNGGGPAFAKRVHAALEESVRAHFPDNGIINCMCHSTENIYNFKWSALARASDDFYPGNEASHTVHISSVVYNSVFLGEIVLPDWDMFQSQHVAGGLHAATRAIGGCPVYVSDHPGKHDFNVLRQLVFPSGKVLRCRQPGRPTRDCLFRDVNRDGRTALKVWNRNLVNSVIGVFNVQGAYWSRQTNQFASLSKPISPVTAELRPRDVEGIAERSAPDASFVVRSHRRGEIRVLGLKEYTTIMLAHKDWEIFTVAEILRAGDVAFAPIGLSAMYNGGGAIMSADVATDSANVCAYGVGELVCYASRTPKMVDINGQSSGFTFDPRTGTVGIDLGPSEGFHELKIKW

SEQ ID NO: 23619 - protein, 169 aa, Bacillus cereus ATCC 14579
MKRIVTATVRNQSGVLNRITGVMTRRHFNIESISVGHTESSDISRMTIVVHVESEQQVEQLIKQLHKQIDVLKVSDITEEAMIARELALIKVATSVARAELYSLIEPFRAAVIDVGKDSIVVQVTGTQDKVEALIELLRPYGLKEIARTGVTAFTRSMKKQDKQVMLIQ

SEQ ID NO: 23620 - protein, 165 aa, Thermotoga maritima MSB8
MESDPMFIGFGYDRHPLVEGRRLVLAGVEIDAPLGSLGHSDGDVLSHAIIDALLGAGCLGDIGTWFPETKEYKDANSLDLLKETVKILEERGFSVVNVDATVVASIVKLSPYREKIVENLKSALETSRVNVKFKSGNTLGFEGEERGISAYAVCLVEEKGCTKST

SEQ ID NO: 23621 - protein, 360 aa, Mycobacterium avium subsp. paratuberculosis K-10
MSAQRTAVHQPWPGLIEAYRDRLPVGDDWTPVTLLEGGTPLIPARRLSEKTGCTVHLKVEGLNPTGSFKDRGMTMAVTDALARGQQAVLCASTGNTSASAAAYAARAGITCAVLIPQGKIAMGKLAQAVMHGAKIIQIDGNFDDCLELARKMAADFPTISLVNSVNPVRIEGQKTAAFEIVDVLGAAPDVHALPVGNAGNITAYWKGYTEYHHEGLIEKLPRMLGTQAAGAAPLVHGEPVKNPETIATAIRIGAPASWTAAVDAQQQSHGRFLAATDDEILAAYHLVAESEGVFVEPASAASIAGLLKAVEDGWVARGSTVVCTVTGNGLKDPDTALRDMPAVTPLPVDPVLVVEKLGLA

SEQ ID NO: 23622 - protein, 469 aa, Glycine max
MDKVNRVCAKDEERPLRITRARARALRGITPYSRPSLKNEQKNVLRANSKRAASSGNKTFAVVPAVVQQKGRAVLSDISNMCAKPHDKCTKASKFQAKGVCTKKNTKLAASSVSTDVSSSHDDVRAKLAEELSTIKMVESNDTLREGVTADTSLSMQNSVKSDELRNSPNKDIDIICEKLGASDSLTIVDIDSELKDPQLWSFYAPDIYSNIRVTELQRKPLTNYMDKLQKDINPSMRGILVDWLVEVSEEYKLVPDTLYLTVNLIDRYLSTRLIQKQKLQLLGVTCMLIASKYEEMCAPRVEEFCFITDNTYTKEEVLKMEREVLNLVHFQLSVPTIKTFLRRFIQAAQSSYKAPYVELEFLANYLAELALVECSFFQFLPSLIAASAVFLAKWTLNESEHPWNPTLEHYTKYKASDLKTVVLALQDLQLNTKGCFLNAVREKYKQQKFNCVANLSPKSVQSLFQNQV

SEQ ID NO: 23623 - protein, 388 aa, Salmonella enterica subsp. enterica serovar Typhi str. CT18
MKITISGTGYVGLSNGLLIAQHHDVVALDIVPARVELLNDRISPIVDKEIQQFLKEDNIRFRATLDKFDAYQNADYVIIATPTDYDPKTNYFNTFSVESVIQDVISINPAAVMIIKSTVPVGFTAAMRQKFATENIIFSPEFLREGKALYDNLYPSRIVIGEQSERAREFAALLQEGAIKQEIPTLFTDSTEAEAIKLFANTYLAMRVAYFNELDSYAETLGLNTRQIIEGVCLDPRIGNHYNNPSFGYGGYCLPKDTKQLLANYQSVPNNIISAIVEANRTRKDFIADSILARKPKVVGIYRLIMKSGSDNFRASSIQGIMKRIKAKGVEVIIYEPVMQEETFFNSRLERDLHCFKQQADVIISNRMAAELLDVAEKVYTRDLFGSD

SEQ ID NO: 23624 - protein, 468 aa, Salmonella enterica subsp. enterica serovar Typhi str. CT18
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 23625 - protein, 479 aa, Salmonella enterica subsp. enterica serovar Typhi str. CT18
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTASDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRSWGKYNVIDSGKNYLVRCITVKPGEKFVAQMHHHRAEHWIVLSGTARVTKGEQIYMVSENESTFIPPDTIHALENPGMIPLQLIEIQSGTYLGEDDIIRLEQRSGFSKEWTNERS

SEQ ID NO: 23626 - protein, 309 aa, Triticum aestivum
  misc_feature (51)..(51): Xaa can be any naturally occurring amino acid
GDTLPQIPTTAEVPLSPPPSSPNVPTKPTPPLPAVCRRRRRRGRASPALTXSAADPNDELCLSSLQQSLSLRNWTKSFFTDPCDGFISKLQGVTCNNGRVYKLSLPGLSLAGSIPPELSNCTNLQSLDLSSNALSGAIPTELSKLLNLAVLNLSANALSGAIPRELASCAYLNVIDLHGNQLSGPIPDELGLLVRLSTFDVSYNRLSGPIPVLLANRSIAGGGGAVASGTTARFNASSFAGNKDLYGYPLPPMRGHGLSVLAIVGIGLGSGLLSLVLSFSAVCIWLRSTDRTAATPGEEGKISHLMPAY

SEQ ID NO: 23627 - protein, 336 aa, Shewanella sp. ANA-3
MTIKIGINGFGRMGRLALRAAWGWNDVEFVQINDPAGDAPTLAHLLTFDSVHGRWQHEANSEGDDIIIDGKRIRCTRNKTIAETDWSACDVVIEASGKMKTKAVLQAYLDQGVKRVVVTAPVKEEGVLNIVMGVNHQLYDKAIHPIVTAASCTTNCLAPIVKVIHENLGIVHGSMTTIHDITNTQTILDAPHKDLRRARACGLSLIPTTTGSATAITHIFPELKGKLNGHAVRVPLANASLTDCVFEVSRKTTEAEVNRLLKEAAEGPLKGILGYEERPLVSVDYKTDPRSSIIDALSTMIINGTQVKLYAWYDNEWGYANRAAELARMVGLMDKA

SEQ ID NO: 23628 - protein, 275 aa, Oryza sativa Indica Group
MVVADLVWAVDSYGVRLVDWGAAGCSLQLQMVDSSEGFRRLAALLFKCCSLDSSNRPNGLQDPERLARETVFNVNEIEALYELFKKISSAVVDDGLINKEEFQLALFKTNRKDSMFADRVFDLFDTKHNGILGFEEFARALSVFHPNAPIDDKIDFAFKLYDLKQQGFIEKQEVKQMVVATLAESGMNLSDEIIEGIIDKTFEEADTKHDGKIDKEEWRNLVLRHPSLLKNMTLPYLSNSLYRVCKPRSSSTQESGMPLFDRAQQGEHSSSEAVI

SEQ ID NO: 23629 - protein, 327 aa, Silicibacter pomeroyi DSS-3
MSETARTVVIEGFGGPEVLQLRDLPVGEPGPGELRIRHQACGLNFIDVYQRTGLYPLALPHALGMEAAGIVEAVGEGVTHLKPGDRAAYAATPPGAYAQARVMPAAQVCPLPDEISFDQAAAMMLKGLTVDYLFHRTTPLSRGDTVLFHAAAGGVGLIACQWAKAEGITLIGTAGSDEKCALAKAHGATHVINYRTENFTDRVRELTDGKGVDVVMDSIGADTFEGSLDCLKPLGMMISFGNASGPVPPVNIGMLGQKGSLKLTRPTLFTHISDHAACQAMARRLFGKVTGGEVKIRIDQRFPLDQVADAHRALEARQTTGSTILEL

SEQ ID NO: 23630 - protein, 383 aa, Bacteroides thetaiotaomicron VPI-5482
MKHTNPQVEQMTSFIVMDVLERANELQKQGVDVIHLEVGEPDFDVPACVAEAAKAAYDRHLTHYTHSLGDPELRREIAAFYQREYGVTVDPDCIVVTSGSSPSILLVLMLLCNSDSEVILSNPGYACYRNFVLAAQAKPVLVPLSEENGLQYDIEAIRKCVTPHTAGIFINSPMNPTGMLLDESFLRSVASLGVPIISDEIYHGLVYEGRAHSILEYTDKAFVLNGFSKRFAMTGLRLGYLIAPKSCMRSLQKLQQNLFICASSIAQQAGIAALRQADSDVERMKQIYDERRRYMISRLREMGFEIKVEPQGAFYIFADARKFTTDSYRFAFDVLENAHVGITPGIDFGTGGEGYVRFSYANSLESIREGLDRISQYLSRCGF

SEQ ID NO: 23631 - protein, 1533 aa, Magnaporthe grisea 70-15
MAAAPGSISTPEEAVARIAYISSDVVISVQPSLATETDFSRYLKSAAARKEPSLVAKNPNNVPEIQSVRHNADPLLSVFTPIRSGRFVSVTTTSNILLPSIAHLYKLAEYPVVIHVALHPDRFPDFSSITAIRNSGWTFLQSESIQEAQDMAMTAHALAIRSGKGVIHFYSPWVLSNDEPVEREGLAVIREILDIDSVRRYQSAPISASGLYADDGRTVLASDQPEQVPSGAASAPLNGLSSGAISHATSQANSSQVSVKSSENSTSATPHSTSSATTIEAPPTAVSSDDIYKYVTSIWAQLESLSGRKYSPFEYSGPPTPENCLFVFGADAGLLGSAIDEAKSGDVYAKAGILTPRLYRPWLGAKLLEAIPKSVKKIAVLEQISKRTTKWGPILIDVLTSVKSGPGGVETIVGYHVGYINNETVKQALRGICQNLALDKPVQNLEVGSREGPQKADKYALEKPKLETAYTKILDQLFGTRLYTANAIDSDNAGISATISATPEFGFGALLARKEHRHRFVSEAKEAATSGVFLTEKPKRLLTNWAIHSDDPKKIDAAAEDLISELTLENSTAARKLLKNQAFFRRQSLWLVGSDAWAYDLGNSGVHHVLASGENVNMLIIDSQPYSEHTAADANKRKKDIGLYAMNFGNAYVASVAAYSSYTQVLQAMDEADKFNGPSIVLAYLPYNGEHDSPLTVLQETKKAVDLGYWPLYRWNPDNEKQGLPTFSLDSERIKKELKAFLDRDNHLTQLMKKEPSFGASLAQDFGTEVRAQQKRRARDAYNQLLEGLFGAPLTILFGSDNGNAQSLAKRLGNRGRQRGLKTTVMAMEDYPVEDLPTEENIVILTSTAGQGEFPQNGKPFWDAIKDSTELDLASVRFSVFALGDSHYWPRKEDKIYYNKPGKDLDRVLANFGAQRLAEIGLGDDQDPDGYQTGYAEWEPKIWQALGVDNVEGLPEEPAPITNEDIKLASNYLRGTIVEGLNDNSTGAISAADGQLTKFHGTYMQDDRDVRDERKAQGLEPAYSFMIRCRLPGGVSTPQQWVQMDDIATKLGNETMKLTTRQTFQFHGVVKGKLKPAMQAINRALMTTIAACGDVNRNVMCSSLPTQSEYHREVYACSQKISDHLLPSTTAYHEIWLTDDNDKKTMVAGDAVQDFEPLYGPTYLPRKFKITIAIPPHNDTDVYAHDIGLIAIKGKDGHLEGFNLLAGGGMGATHNNKKTYPQTGRSFGYVSKDQVHIACEKVMLVQRDHGDRKNRKHARLKYTIDDMGVDVFRGKVEELWGQKFEEARPFHFDSNIDTFGWQRDEKGLNHFTLFIENGRIEDTAEFQMKTGLREIAKVHKGEFRLTGNQHVILSNVADEDLDNMKALLKKYKLDNIQFSGLRLSSSACVAFPTCGLAMAESERYLPVLIDKLEACLEENGLKQDSIVMRMTGCPNGCARPWLAEVAFVGKAYGAYNMYLGGGYHGQRLNKLYRSSIKEDEILAIMKPLLKRYALEREEGERFGDFCIRAGVIKATTDGQNFHNDVAEEESDEE

SEQ ID NO: 23632 - protein, 483 aa, Saccharophagus degradans 2-40
MSPLKVVEAETMADRLKNDFQFIEVGRQDPTKKDISTRKHEFVEIYQPFSQEQVADQSHRCLECGNPYCEWKCPVHNYIPNWLKLVSEGNIVEAAELCHQTNSLPEVCGRVCPQDRLCEGACTLNDGFGAVTIGNAEKYITDTAFAMGWRPDMSKVTWTKKRVAIIGAGPAGLGCADILVRNGVKPVVFDRNPEIGGLLTFGIPEFKLEKTVMSRRREIFTDMGVEFRLNTEVGKDIQMEEILEEYDAVFMGMGTYTYMKGGFPGEDLSGVYDALPFLVSNVNRNLGFEKDPADFISVKDKKVVVLGGGDTAMDCNRTSIRQGAEKVTCAYRRDEANMPGSVREVQNAREEGVEFLFNRQPIAIVGEGRVEGVKVVTTQMGEPDENGRRRPEPIPGSEEIIPADVVLIAFGFRPSPEPWFETHGINLNNWGGVVAPAEQKFKYQTTNDKVFAGGDMVRGSDLVVTAIWEGREAAEGILDYLDI

SEQ ID NO: 23633 - protein, 424 aa, Coccidioides immitis RS
MASLPLPSSTSHKPTASLDLSKKLSSLRTNRRNPSALSSQAAAPPTPQLPDRPTLTQHQFIRPVPRILSPQDLETFLSSPAHSLIIAFVFNVSDSVRQQSVSSLVQLPVSETIRKVLSILSAIEELIDKHPSLDQNGSRFGNPAFRDLFDDIAAHSVQWHKDILGLDDPAAIEEVSTYLIHSLGSRSRLDFGSGHELNFMMWLLCLYLFGMLDRNDFPVIVCHVFIRYMKLMRHVQTTYYLEPAGSHGVWGLDDYHFIPFLFGAAQLTGHPYITPLAIHNNVVLDEEGDNWIYLDQVRWVDSVKTVKGLRWHSPMLDDISGAKNWYKVEAGMKKMFVKEVLGKLPIMQHFLFGSLIPALPEMGERNEKAEQPDPGSGHPHGHAHSHQNDFWGDCCGIKVPSAVAAGEEMRKRQGGTGLRPIPFD

SEQ ID NO: 23634 - protein, 322 aa, Streptomyces avermitilis MA-4680
MPKTQSGTSNRTRSTTAGGSARGKWNAGDIPDQTGRTAVVTGANSGLGIATVEALARAGAHVVLAVRDLERGEAAAAGVHGSVEVRRLDLADLASVREFAAGWQGDLHLLINNAGVMNIPEASTKDGFEMQFGTNHLGHFALTNLLLPRIKDRVVTVSSGAHRMPGSPYIHFDNLNLTGEYAPLTAYSQSKLANLLFTLELQRRLAEAASPVRALAAHPGWAATNLQSHDGSALRRALMRVGNRFIAQDNRAGALPTLYAAVQDLPGASYVGPDGFGEMRGGPTLVGRSAAAGDPVSARRLWTASEDLTGVTFPRLTAAVSA

SEQ ID NO: 23635 - protein, 326 aa, Streptomyces avermitilis MA-4680
MTWLITGGAGYIGAHVVRAMREAGDRAMVYDDLSTGIAERVPDGVPLVVGSTLDGGLLRRTLAEHAVTGVVHLAAKKQVGESVELPLHYYRENVEGLRVLLEAVTDASVPSFVFSSSAAVYGMPDVDLVREETPCVPMSPYGETKLAGEWLVRATGRATGLSTASLRYFNVAGAATPELADAGVFNLVPMVFEKLTEGAAPRIFGDDYPTPDGTCVRDYIHVVDLAEAHVAAARALEASPGAGLTLNIGRGEGVSVREMVDRINALTGYDTPPTVVARRPGDPARVVASADRIAVELGWKAKYDVQDMITSAWEGWVRLHPGATRG

SEQ ID NO: 23636 - protein, 484 aa, Pseudomonas putida GB-1
MSIRRTKIVATLGPASNSPEVIEQLILAGLDVARLNFSHGTPDEHKARARLIRDIAAKNGRHVALLGDLQGPKIRIAKFANKRIELKIGDKFTFSTAHPLTEGNQDIVGIDYPDLVKDCGVGDELLLDDGRVVMRVETATADALHCVVIIGGPLSDHKGINRKGGGLTAPALTEKDKADIKLAAEMDLDYLAVSFPRDASDMEYARKLRDESGGSAWLVAKIERAEAVADDETLDKLIAASDAVMVARGDLGVEIGDAELIAIQKKIIQHARRNNKAVIVATQMMESMIQNPMPTRAEVSDVANAVLDNTDAVMLSAESAAGSYPIEAVQAMARICLGAEKHPTSQKSSHRLHTTFERCDESIALAAMYTANHFPGVKAIIALTESGYTPLIMSRLRSHVPIFALSPHRATQARANMFRGVYPIAFDPASLPADKVSQAAVDELLKRGLVQQGDWVILTKGDSYHTIGGTNGMKILHVGDPLVG

SEQ ID NO: 23637 - protein, 304 aa, Haemophilus influenzae R2866
MIELNGKPFAEMWQSYGGDTLNSATYLSRVSSSKEIQVHYVSALGTDNLSKQMLKYWQEDGIQINCVLQDEQHQPGLYLIQLDAQGERTFLYWRNQSAARYMVQHPDFAKIIAELQQVDLIYLSGISLAILPKNDRTFLIEQLSSLAKKGVEIVFDSNYRPKLWGSLEEAQDCYLQLLPSVNIALVTFDDEQALWKDKTSRDTLERLHKIGISKVIVKCGKNGAIFSDMYLSQYGQVIPEPILNVVDTTSAGDSFNAGFLNGYLRNKPLEICCQQGNRIAGIVIQHKGAIIDKVATSHLQSEFN

SEQ ID NO: 23638 - protein, 479 aa, Oenococcus oeni PSU-1
MKIVKFGGSSLSSGVQIRKVFQIVKSDPERRIVVVSAPGKRFKGDVKITDLLLKLAEAILNEEKTAQIYEQIFLRYQAIGDFFKIPRSGIEQLKEHLYSVAQADYPSNDFFRAALSAQGENMSAHLITLIFKQLGLKARLLTPKEVGLTVSGEARKAQILPGSYAKIAKTKFTDNEVLIFPGFFGITKNGLINTFSRGGSDITGAILARGFGADLYENFTDVDSIYAVNPGLVADPAPIKEMTYNEMRELSYAGFAVFHDEAILPAIQGKIPICVKNTNRPEMPGTKIVPRDKVSHKNKITGIASSHHFQAIYLHRYLINREVGFTAKILKIMADLNISYEHMPSGIDDLTIILDKNQLTNGRKEKLTQRIKDEIQPDDLQWRNDYAIIMVVGEGLVNRVGAMADIVDPIRDAGISLTMVNQGSSEISIMLGVRPEDEQKAVKAIYNDHFENGHPKKELQIPRASFKSVSKSLIANFFV

SEQ ID NO: 23639 - protein, 97 aa, Glycine max
MAARNFFVRSPKEEESSAAIREAVLLGGKNAAIAGTVVAVPTFVACRVLPWAKHNLNYTAQALIISTACVAGFFITADKTILRNARQNTIGRIDEST

SEQ ID NO: 23640 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 23641 - protein, 354 aa, Bacillus cereus ATCC 14579
MEKRIVCLAGDGVGPEVMESAKEVLHMVERLYGHHFHLQDEYFGGVAIDLTGQPLPQRTLAACLASDAVLLGAVGGPRWDSAKERPEKGLLALRKGLGVFANVRPVTVESATAHLSPLKNADEIDFVVVRELTGGIYFSYPKERTEEVATDTLTYHRHEIERIVSYAFQLANKRKKKVTSIDKANVLESSKLWRTVTEEVALRYPNVEVEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGYAIEEAVSAVLKSGKCTADIGGTETTTSFTKAVIQEMEEQALVGRGR

SEQ ID NO: 23642 - protein, 289 aa, Clostridium difficile 630
MKLNRNDSCWCGSTKKYKKCHMDMDNKIDSFAKLGHIVPTHDIIKNESQIEEIKKSAVINTKILDYISDKIEIGMSTEDINKLVHDFTLQNGAIPAPLDYNGFPKSVCTSVNNEVCHGIPSKDIILKDGDIINVDVSTIFNGYYSDASRMFMIGNVNENAKKLVQVTKECVQKGLEVAKPWGFLGDIGDAINSYAKKNGYSVVREIGGHGVGLSFHEDPFVSYVSKKGTEMLLVPGMIFTIEPMVNEGTHEIFVDEENNWTIYTKDGKLSAQWECMVLVTETGVEILTE

SEQ ID NO: 23643 - protein, 167 aa, Oryza sativa Japonica Group
MQVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLS

SEQ ID NO: 23644 - protein, 283 aa, Oenococcus oeni PSU-1
MSILTDTYTLNNGTKIPKVAFGTWQTPDGDVAYQAVSSALKFGYRHIDTAKIYGNEKSVGRAIADSDVKREDLWVTTKLPSQDKTRDLVLADFESSLSRLGLDYVDLYLIHAPWPWGEAGSKHFDEENAEAWKTLEELQKSGRVKSIGISNFDVHDMENILKIAEIKPVVNQIQYYIGFTEPKISKFAAEHDIRIEAYSPLATGDILNSEAIRKIAGRYNVSVAQLALRFTLQNGTVTLPKAISERHIQENTQLDFTINDDDMRTLNSMPDAAPAHFHNSTQG

SEQ ID NO: 23645 - protein, 200 aa, Triticum aestivum
MAAPALPLANHAAPTATARYLHRNHQLLQPKRQLPPGFLAARPLRQPRRALSAVPETKEEDAKTAEEITEKYGLEVGLWKIFSSKEEEGGEEGEEGKPKKSRTEQAKELLGKYGGAYLATSITLSLISFTACYLLINAGVDVQQLLGKIGIATDETGGKVGTFALAYAAHKAASPIRFPPTVALTPVVANWIGKITKGGD

SEQ ID NO: 23646 - protein, 158 aa, Shewanella oneidensis MR-1
MIAQGQKLPAATLSQLTKDGMVNHQVTELFAGKKVVLFAVPGAFTPTCSEAHLPGYVVLADELKAKGVDLIACVSVNDAFVMKAWGEAQNASELLMLADGDASFTKALGLEMDTAGFGGVRSQRYAMIIDNGVVTLLNVEAPKSFEVSKAEVVLAALS

SEQ ID NO: 23647 - protein, 225 aa, Photobacterium sp. SKA34
MNQISLLAEFGSPITRVENALNALRRGLGVMLLDDENRENEGDLIFSAEHITATQMALMIRECSGIVCLCLTEKHVKQLDLPAMVENNNSANKTAFTVSIEAKEGVTTGVSASDRVTTIKTAIALNAQPSDLARPGHVFPLCANEKGVLGRRGHTEGTIDLMTLAGLEPVGLLCELTNIDGTMAKADEVVYFAKQHNMPVLTIEDIVAYRLQQKKDKSQELEMVL

SEQ ID NO: 23648 - protein, 282 aa, Picea sitchensis
MASATSPFFPLLVSSTHERVKAGCSSSGRWRAPKGALEGLRRVPKGGFEGLGKAFSNRLAGPRTAAACTSNSKSSNLGRRLVVNAGELPLVGNKAPDFEAEAVFDQEFIKVKLSEYIGKKYVILFFYPLDFTFVCPTEITAFSDRHSEFEKLNTEILGVSIDSVFSHLAWVQTDRKAGGLGDLKYPLISDVTKGISKAYNVLIADQGIALRGLFIIDKEGVIQHSTINNLAIGRSVDETLRTLQALQYVQDNPDEVCPAGWKPGDKSMKPDPKLSKEYFEAI

SEQ ID NO: 23649 - protein, 715 aa, Photobacterium sp. SKA34
MSRTIMLVPVGAGVGLTSVSLGVLRAMERKGVRVSFFKPIAQPRKGGDQPDLTTTIISANSDMKIAESFSMASAEELIRNDKTDVLLEDIVARFKAATADADVTLIEGLVATRKHPFANQINFEIAKTLDAEIVFVVSPGTDNPAQLKERIEVACSNFGGIKNKQISGVIVNKLNAPVDAEGRTRPDLSEIFDDAEGTVPSNVEIMQVFNSSPIRVLGCAPWSAELIATRATDIAQHLNAEIINAGDIETRRIKSITFCARSIPNMVEHFRPGSLLVTSADRPDVIVAACLAAMNGVELGALLLTGGYDLPKPVMDLCERAFSTGLPVMTAQGNTWQTSLNLQSFTLEVPADDKERVELVNEYMASHIDGNWIESLTEGSNRERRLSPPAFRYQLTELARKAAKRIVLPEGDEPRTVKAAAICAERGIAECVLLGNPDEIRRVAEQQGVVLGTGVTIINSDEVRENYVARLVELRGAKGMTDVVAREKLQDSVFLGTMMLENNEVDGLVSGAVHTTANTIVPPFQIIKTAPDASIVSSVFFMLLPDQVLVYGDCAINPDPTAEQLAEIAIQSADSAKAFGIDPRVAMISYSTGESGKGADVDKVREATKIAQEKRPDLVIDGPLQYDAAIMENVAASKAPNSPVAGKATVFVFPDLNTGNTTYKAVQRSADLVSIGPMLQGMRKPVNDLSRGALVDDIVYTVALTAIQAEQATEK

SEQ ID NO: 23650 - protein, 642 aa, Silicibacter pomeroyi DSS-3
MSDRPHTPLLDQVTRPADLKRFSDAQLTQLAGELRAETVSAVSVTGGHLGAGLGVVELTVALHAVFDTPRDKVIWDVGHQCYPHKILTERRDRIRTLRMKDGLSGFTKRSESPYDPFGAAHSSTSISAALGFAVARDLGGVTPEGLGDAIAVIGDGSMSAGMAFEAMNNAGHLKKRLIVILNDNEMSIAPPVGALSNYLSRLYAEEPFQELKAAAKGAVSLLPEPFREGAKRAKEMLKGMAVGGTLFEELGFSYIGPIDGHDMGQLLPVLRTVKARATGPILLHVLTKKGKGYAPAERARDRGHATAKFDVVTGEQKKAPSNAPSYTAVFGKALVDQAARDDKIVAVTAAMPDGTGLNLFAERYPSRCFDVGIAEQHGVTFSAALAAGGLKPFCAMYSTFLQRGYDQVVHDVAIQRLPVRFAIDRAGLVGADGATHAGSFDIAYLANLPGMVVMAAADEAELVHMVATAAAHDDGPIAFRYPRGEGVGVEMPELGKVLEIGKGRMIQKGARVALLSFGTRLTEVQKAAEALAARGITPTIADARFAKPLDRDLILNLAHDHEALITIEEGAVGGFGSHVAQLLADEGVFDHGLKFRSMVLPDIFIDQSSPADMYAVAGMNAPQIEAKVLDVLGIGRIGEKRA

SEQ ID NO: 23651 - protein, 607 aa, Brucella melitensis 16M
MNAGKHEAEANAGQAQDAGHPREMTGAEMVIQALIDQGVESIFGYPGGAVLPIYDGLFQQDQIQHVLVRHEQGAGHAAEGYARSTGKVGVMLVTSGPGATNAVTPLQDALMDSIPLVCISGQVPTTLIGSDAFQECDTIGITRPCTKHNWLVKDVNDLSRVLHEAFHVASTGRPGPVVVDIPKDIQFAKGIYTPPETAPRTSYRPVLDGNAEAISEAVRLLANARKPVIYSGGGVINSGPAASRLLRELVEISNFPITSTLMGLGAYPASGKNWLGMLGMHGTYEANMTMHDCDVMLCVGARFDDRITGRLNAFSPNSKKIHIDIDPSSINKNVRVDVPIIGDVAHVLEDIVRQFRAFDRKPDRQALTEWWGQIDRWRARNSLAYTPNKDVIMPQYAIERLYELTRNRNTYITTEVGQHQMWAAQFFGFEQPNRWLTSGGLGTMGYGLPAALGVQIAHPDALVIDIAGDASIQMCIQEMSAAIQHNAPIKIFILNNQYMGMVRQWQQLLHGNRLSHSYTEAMPDFVKLAEAYGAHGIRCEKPGDLDAAIQEMIDIDKPVIFDCRVANLANCFPMIPSGKAHNEMLLPDEATDEAVANAIDAKGRALV

SEQ ID NO: 23652 - protein, 190 aa, Brucella melitensis 16M
MNAQNLASGSAYFIAAETQTPETHTLAVLVDNEPGVLARVIGLFSGRGYNIESLTVSETEHERHLSRITIVTRGTPHVLDQIRHQLARIVPVHRVVDLSHRAATLGHERPIERELALVKVAGKGEARAETLRLADAFKAKVVDATTDHFILEITGKSAKIDQFISIMKPLGLVEICRTGVAAMNRGAEGM

SEQ ID NO: 23653 - protein, 288 aa, Silicibacter pomeroyi DSS-3
MFHERLAQDAALIQRSFDTVLGALEPLDITRAMAWTTEGGKRLRGFLVLESARLHDVDEARAIWPATAIEALHAYSLVHDDLPCMDDDDLRRGRPTAHVKWDEGTAVLAGDALHSLAFELCTRPEVGTAETRATLALTLAQAAGARGMVLGQALDIAAETAPKPLTLDQITRLQAGKTGALIEWAAAAGAVLAGADPDPLRQYARALGLAFQIADDILDVEGDAEKAGKRLQKDAGAGKATFVSLLGLDAAKARARDLVDQGCAALDGYGERAGTLKEAARFVIARDN

SEQ ID NO: 23654 - protein, 172 aa, Triticum aestivum
  misc_feature (51)..(51): Xaa can be any naturally occurring amino acid
  misc_feature (128)..(128): Xaa can be any naturally occurring amino acid
  misc_feature (160)..(160): Xaa can be any naturally occurring amino acid
MEHKETGCQSREGPILCVNNCGFFGSAATMNMCSKCHKEMAMKQEQAKLAXASSFDSIVNGGDAAKEHLAAGNTAVAVAHVEAKTLITAQPADIAGPSEAAMENPKGPSRCSTCRKRVGLTGFNCRCXGNLYCATHRYSDKHECKFDYRAAAMDAIAKAXNPVVKAEKLDKI

SEQ ID NO: 23655 - protein, 295 aa, Bacillus cereus
MAIRKHLITLEDLTDSDINQIVTRGVEFATGKSQPNQILAGNIIGIYFRKTSTRTRSAFSVAALKMGAQIVTYGPNDLQENTGESIEDTTQVLSRMLDGLVARTADSQKEMEKLASQSRMAVINAMSAEEHPTQALTDLTTMKQKFGEIAGLRVLYMGEGNNSAAALALSLSRFPGTELYLFTPAGYGVSPSVLEKSKEYARFSGAKVIECHDIKMLPSEVDVVYTTRWQTTGTSKVDPLWKDAFNPFAVTERILTLYPEATFMHDLPAHRGEEVAATVLMDRKVLYLPRLKIVK

SEQ ID NO: 23656 - protein, 325 aa, Bacillus cereus
MLKKLESLERVIGNTPMIKLEHEKINLYAKLEYYNLMNSVKVRAAYHILKSAINRGEVNENSTIIESSSGNFAVALATLCRYIGLKFIPVIDPNINDSYENFLRATSYQVANVDERDETGGYLLTRLNKVKELLNTIPNAYWTNQYNNADNFEAHYQGIGGEISNDFKQLDYAFIGVSTGGTIAGVSTRLKEKFPNIKIIAVDSQGSIIFGDKPRKRYIPGIGASMIPGMVKKALIDDVMIVPEVHTVAGCYELFNKHAIFAGGSSGTSYYAIQKYFENRDVQNTPNVVFLCPDNGQAYTSTIYNVEWVEWLNTQKSVEDQLVSL

SEQ ID NO: 23657 - protein, 342 aa, Haemophilus influenzae R2866
MKERIKAICLEKPNNVVVKEVPYPEKSDNDVLIQVESMGICGSDIGAYRGTNPLVTYPRILGHEIVGRVIESGIGMPDRVRVGDRVIVDPYVFCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYTSFAGRIALTGWPKTETPLPTNLITFKELNIYGSRTSKGEFEEALDMLATNKINASHIITKCIKFEEIPSFISDLSDHPENYLKINAVF

SEQ ID NO: 23658 - protein, 436 aa, Bacillus halodurans C-125
MAKEIFMPKLSSTMQEGTLLQWFKEEGDRVEVGEPLFEIMTDKINIEVEAYEEGTLLKRYYGEDDEIPVNHVIGYIGTPDESVPTEPPGASEITASSTDEAGDHRTTAVKKAPSSDRENVRATPAARRIAKEKRIDLRQVEGSGPEGRVQAVDVATFKKKGQKATPLAKKVAEVKGVALEKVQGSGPYGKVYREDVEHAQAASPVEDKGNRVKLSGLRKVVAKRMVDSAFSAPHVTITTEIDMSSTIKIRSQLLGMIEQETGYRLSYTEIVMKAVAHALMSHPTINASFFENEIVYHEDVHIGLAVAVEGGLVVPVVKHVDKKGLAQLTNECKTVAMAARDNRLSQEMMSGGTFTISNLGMYAIDVFTPVINQPESAILGVGRIQEKPVGIDGQIELRPMMTASLSFDHRVIDGAPAAAFLTDVKSMLEQPFQLLM

SEQ ID NO: 23659 - protein, 140 aa, Sulfitobacter sp. EE-36
MALERTFSIIKPDATRRNLTGKINAKFEEAGLRIVAQKRIHMTKAQAGVFYAVHAERPFYDELCEFMASEPVVVQVLEGEGAIAKNREVMGATNPADAAEGTIRAEFAESVGENSVHGSDAPETAAVEIAYFFSGLELVG

SEQ ID NO: 23660 - protein, 462 aa, Bacillus halodurans C-125
MKSYDIVVIGGGPGGYVAAIKAAKLGKKVALVEAKDLGGTCLNRGCIPSKTLLHQGEIIEKIKQAKEWGIETGAVTLSLPKMLARKNEIIQKLRAGIHFLLKQGKIDVYFGYGEIERDRSVKIKMKETAEIVSVRTENMIVATGTEPTIPPVPGLAEAVVDTSDTIFELDSIPQSIVIIGGGVIGVEIACIFSSLQVDVTIVEMGKRILPQEDEEAAKVLAKALAAKGVHLLTNTKVTAVLQGDKQKVEIETSTGDRDWLEGERILLAVGRTPNLSVVKELGLGMAGPFLKVDDQMRTSDPSIYAIGDVIGGWQLAHVASAEGLVAAANASGKVEIINRQVIPRCIYTQPEIASVGLTEQEAKEKGYSYKVVKVDLRANGKAMALGETTGFVKMIADPNYGEILGVTMVGPHVTEMIGEPAAFIHLEGTVDELKAMIHPHPTVSEALYEAAASWLGQGVHQP

SEQ ID NO: 23661 - protein, 186 aa, Thermoplasma acidophilum
MPTEFGLFRIYTFVNDENKDHAVIVRGDPRGKEDVPVRIHSECLTGDVLGSLRCDCRDQLIQSLRYLGRQDYGMLIYLRQEGRGIGLLNKIKAYSLQDSGADTVEANLKLGLPVDSRDYSFASEVIKFFEIKSIYIMTNNPEKMKALIESGINVKGRIPIFSDPTPYDKFYLETKKIKLGHEIENI

SEQ ID NO: 23662 - protein, 451 aa, Bacillus halodurans C-125
MTSNDLLAKSKKHLWLPFTQMSDYEKDPLIIESGNGVYLKDIEGNTYLDGYSSLWLNVHGHRKKEIDEAIEKQLQLIAHSTLLGAANIPSIQLAEKLVELAPEAITRVFYSDSGAEAVEIAVKMAYQYWQNRGYENKKSFVTLSNGYHGDTVGTMSVGSIELYHKVYTSLLFDAIVIPFPASKEEQTESDLCRESLKQLRELFEAKHEEIAGITVEALIQGAGGMNLMPKGYLKGVEQLCKEFHILLIVDEVATGFGRTGKMFAVEHENVQPDIMTVAKGITGGYLPIAATLTQEHIYEAFYGEYTDLKTFFHGHSYTGNQLGCAAALANLEIFEKENIIQQVEEKALFLEEQLKHVAELEFVGAVRQLGLMCGIQLVQHKRTSEPFPWEQRVAYRSTLKMRALGMLTRPLGDVIVLMPPLAATNDQLKQMVDIMKEGIMEAATECLEQQV

SEQ ID NO: 23663 - protein, 578 aa, Arabidopsis thaliana
MPFWWPLIVLAFAYAICKFLLMLIPPNVPSIDVDASDVLAHGKDTEENSFIYIPPRGRSQQSDKKVQCYEPATMKYLGYFPALSPTEVEERVTLSRKAQKTWAQSSFKLRRQFLRILLKYIIEHQELICEVSSRDTGKTMVDASLGEIMTTCEKITWLLSEGERWLKPESRSSGRAMLHKVSRVEFHPLGVIGAIVPWNYPFHNIFNPMLAAVFSGNGIVIKVSEHASWSGCFYFRIIQAALAAVGAPENLVDVITGFAETGEALVSSVDKMIFVGSTAVGKMIMRNAAETLTPVTLELGGKDAFIICEDADVSHVAQVAVRGTLQSSGQNCAGAERFYVHKDIYTAFIGQVTKIVKSVSAGPPLTGRYDMGAICLQEHSEHLQSLVNDALDKGAEIAVRGSFGHLGEDAVDQYFPPTVLINVNHNMKIMKEEAFGPIMPIMQFSTDEEVIKLANDSRYALGCAVFSGSKHRAKQIASQIQCGVAAINDFASNYMCQSLPFGGVKDSGFGRFAGIEGLRACCLVKSVYPVAENAFEFQEALVETLYGLNIWDRLRSLIDVLKFLTDQSSNVSRTRKSH

SEQ ID NO: 23664 - protein, 141 aa, Oenococcus oeni PSU-1
MADKDLSHLSKEQYEVTQKGATERAFTGKYDDFYEEGIYVDVVDGTPLFSSKDKYDAGCGWPSFTKPIENPSIVKKIDQSLGMTRTEVRSKDSGSHLGHVFDDGPDDKGGLRYCINSAALKFIPVKELKKAGYGEYLSLFK

SEQ ID NO: 23665 - protein, 448 aa, Pseudomonas putida GB-1
MNQAQTNVGKSLDVQSFINQQPLSRYQWRVVLLCFLIVFLDGLDTAAMGFIAPALSQEWGIDRASLGPVMSAALIGMVFGALGSGPLADRFGRKGVLVGAVLVFGGFSLASAYATNVDQLLVLRFLTGLGLGAGMPNATTLLSEYTPERLKSLLVTSMFCGFNLGMAGGGFISAKLIPAYGWHSLLVIGGVLPLLLALVLMLWLPESARFLVVRNRGTDKVRKTLSPIAPHVVAEAGSFSVPEQKAVAARNVFAVIFSGTYGLGTVLLWLTYFMGLVIVYLLTSWLPTLMRDSGASMEQAAFIGALFQFGGVLSAVGVGWAMDRFNPHKVIGIFYLLAGVFAYAVGQSLGNITLLATLVLIAGMCVNGAQSAMPSLAARFYPTQGRATGVSWMLGIGRFGAILGAWSGATLLGLGWNFEQVLTALLVPAALAAVGVIVKGLVSHADAT

SEQ ID NO: 23666 - protein, 76 aa, Bacillus subtilis
  misc_feature (1)..(1): Xaa can be any naturally occurring amino acid
XDTLERVTKIIVDRLGVDEADVKLEASFKEDLGADSLDVVELVMELEDEFDMEISDEDAEKIATVGDAVNYIQNQQ

SEQ ID NO: 23667 - protein, 500 aa, Arabidopsis thaliana
MLYFILLPLLFLVISYKFLYSKTQRFNLPPGPPSRPFVGHLHLMKPPIHRLLQRYSNQYGPIFSLRFGSRRVVVITSPSLAQESFTGQNDIVLSSRPLQLTAKYVAYNHTTVGTAPYGDHWRNLRRICSQEILSSHRLINFQHIRKDEILRMLTRLSRYTQTSNESNDFTHIELEPLLSDLTFNNIVRMVTGKRYYGDDVNNKEEAELFKKLVYDIAMYSGANHSADYLPILKLFGNKFEKEVKAIGKSMDDILQRLLDECRRDKEGNTMVNHLISLQQQQPEYYTDVIIKGLMMSMMLAGTETSAVTLEWAMANLLRNPEVLEKARSEIDEKIGKDRLIDESDIAVLPYLQNVVSETFRLFPVAPFLIPRSPTDDMKIGGYDVPRDTIVMVNAWAIHRDPEIWEEPEKFNPDRYNDGCGSDYYVYKLMPFGNGRRTCPGAGLGQRIVTLALGSLIQCFEWENVKGEEMDMSESTGLGMRKMDPLRAMCRPRPIMSKLLL

SEQ ID NO: 23668 - protein, 364 aa, Coprinopsis cinerea okayama7#130
MSSPSGGIEVTEEEKQRNKEVEKQLKEAKAKMQSQVKVLLLGSGDSGKSTILKQMRLIHKVPFSPQEVESYRQLVFENLTRGMGYVLDAMEDMELKVSEENQHYIDEVIHARDIRDGEPFPRSYYKPLKSLWLDPNVQKAWQRGNEAALPEKSGASIPSRLFIADCLVTSLLYFYSSLDRLFDPEYQPSEQDIIRCRARTIGITETTFVLREHEMLMVDVGGQKSERRKWIHCFQDVTSILFLVSLSGYDQCLVEDKDANQMQDAMTIWDSICHSQWFKQTSIILFLNKNDLFEQKVPQSDIKNFFPDYDGEPGDAKAGRDYFKKRFARLAQKAGRSKEREIYIHITTATDTAMLRVVMAAVEE

SEQ ID NO: 23669 - protein, 125 aa, Oryza sativa Indica Group
VRRELWLGLAYLVVQTAGFMRLTFWELSWDVMEPICFYVTSMYFMAGYTFFLRTKKEPSFEGFFESRFAAKQKRLMHARDFDLRRYDELRRACGLPVVRTPTSPCRPSSSSSTQESHCHSYCHCQ

SEQ ID NO: 23670 - protein, 478 aa, Saccharomyces cerevisiae
TINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 23671 - protein, 457 aa, Escherichia coli
MTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPSVPALLGRVLDGSGKPLDGLPSPDTTETGALITPPFNPLQRTPIEHVLDTGVRPINALLTVGRGQRMGLFAGSAVGKSVLLGMMARYTRADVIVVGLIGERGREVKDFIENILGAEGRARSVVIAAPRDVSPLLRMRMPAYATRIAEDFRDRGQHVLLIMDSLTRYGMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFHGNRDLVSVGAYAKGSDPMLDKAIALWPQLEGYLQQGIFERADWEASLQGLERIFPTVS

SEQ ID NO: 23672 - protein, 418 aa, Burkholderia xenovorans LB400
MPYQHIKVPTGGDKITVNPDFSLNVSDQPIIPYIEGDGTGIDITPVMIKVVDAAVEKAYAGKRKIHWMEIYAGEKSTKVYGPDVWLPEETLQVLKEYVVSIKGPLTTPVGGGIRSLNVALRQELDLYVCLRPVQYFKGVPSPVREPEKTNMVIFRENSEDIYAGIEWPAESEQAKKIIRFLREEMGVKKIRFPETSGIGIKPVSREGTERLVRKAIQYAIDHDRRSVTLVHKGNIMKFTEGAFRDYGYALAQKEFAAELIDGGPWMKIKNPKTGGDVVLKDVIADAFLQQILLRPAEYDVIATLNLNGDYVSDALAAQVGGIGIAPGANMSDSVAMFEATHGTAPKYAGKDYVNPGSEILSAEMMLRHLGWTEAADLIIKSMEKSILQKRVTYDFARLMEGATQVSCSGFGQVLIENL

SEQ ID NO: 23673 - protein, 284 aa, Aspergillus oryzae
MFRSLLTLTKLASPQYIFPTVDPKIDGEECRHDCADCTVKWPSKVKIDTTLPMYGYIKQFHTHVLVATGKTDWMGKVEQEKGSLMEAFKSEGGKSKHGRIMVSASNLTPPEGEDGTIDSGKTTVLLLPSFTFVDRVAYGDVRHVVDTFIDNPKQESRLSSRPCPHDYVVLLCSHQRRDARCGITAPLIKKELERHLRGHGLYRDLDDERPGGVGIYFVSHVGGHKFAANVLIYRKKEQQMIWLGRVKPEHCEGVVKYTILQGKVVHPDSQLRGGFDRMKGLTSW

SEQ ID NO: 23674 - protein, 166 aa, Francisella tularensis subsp. holarctica
MSNEVKKNEELIEKLVSVKRHSKTVKGGRIMSFAALTVVGDGKGRIGVGRGKSREVPAAIQKAMENAKKNMVSVNLNNDTLWYPVVSNHGASKVFMQPASAGTGIIAGGAMRSVFEAVGVHNVLAKTYGSTNPANVVRATIAGLAKIKSPDEIAEKRGLSVEEIQG

SEQ ID NO: 23675 - protein, 291 aa, Thermotoga maritima MSB8
MMERLIGSTPIVRLDSIDSRIFLKLEKNNPGGSVKDRPALFMILDAEKRGLLKNGIVEPTSGNMGIAIAMIGAKRGHRVILTMPETMSVERRKVLKMLGAELVLTPGELGMKGAVEKALEISRETGAHMLNQFENPYNVYSHQFTTGPEILKQMDYQIDAFVAGVGTGGTISGVGRVLKGFFGNGVKIVAVEPAKSPVLSGGQPGKHAIQGIGAGFVPKILDRSVIDEVITVEDEEAYEMARYLAKKEGLLVGISSGANVAAALKVAQKLGPDARVVTVAPDHAERYLSIL

SEQ ID NO: 23676 - protein, 220 aa, Thermotoga maritima MSB8
MRLLFRKAGEFFRDFVSIFKHISDDLEMYLKLDPAAESKLQVFFFYASFQGLMWYRFAHFFYKWKLKVLAYLIYYFVRVVFSMDIHPAARIAPGVVIDHGIGVVIGSTASVGRGTLIYHGVTLGTRKPCSGKRHPDVGENVMIGTGAKILGPIRVGNNAVVGANAVVLEDVPDGAVVVGVPARIVKWRRDFCDDGKTDREHSYSETRFDRLENLLETGKE

SEQ ID NO: 23677 - protein, 102 aa, Picea sitchensis
MMSTTHSDPRQPSTAKPYTPPAISQDLPADYSSFLAIMFGVAGVMLRYKLGSWLAIICCAQSLANMRNMENDLKQIMMAMTFAVMGLVTNYFGHARQAPVQS

SEQ ID NO: 23678 - protein, 548 aa, Physcomitrella patens
MADQSSSAVGDRNAKGDPGSSMHGVTGKEALYAFSLHEGDKMNHDPDAKKFALPVDSEHKATTMRIYSFARPHMLTFHLSWFSFFTCFLSTFAAPPLIPVIRDNLNLTKEDIGHAAIASVSGSILSRLLMGSICDLIGPRYGCAFLVMIISPAVYAMASVETAAGFTAVRFFIGFSLATFVSCQYWMSSMFNGKIVGTANGIAAGWGNLGGGATQLIMPLVYALIKDSFKSPSYTAWRLSFFLPGVMHTVIGLMVLFLGQDLPDGNFKELQEQGTKVKDSFRKVFFNAVTNYRTWIFLITYGYCFGVELTVDNIIAEYFYDRFGLSLSSAGIIASSFGFMNIVSRPLGGILSDVVARRYGMQGRLWNLWIIQTLGGVFCIVLGKTAALGPAIGVMIVFSFFVQAACGATFGVIPFVSRRSLGVISGFTGAGGNVGAVLTQTIFFTQATYHTEVGIENMGIMIICCTALVLFVWFPQWGSMFFKSSRMTEEDYYASEYSEGEQDQGLHQASLKFAENAKSERGRSKGSKSPPEDGKPDGLKGIKEGAEV

SEQ ID NO: 23679 - protein, 672 aa, Cryptococcus neoformans var. neoformans JEC21
MTTPAPSGPSRLPPHLADHLPPPSTSGDSESSAQQPAAGNGLETGLLKELARTSLIESLNNVQGAKTLILDPVLAGPLGLVTEVALLKHQAVDKMFWLERGPLNVNTRNVVWLCRPKMEFMNIIAEQIRSQQQNPSAAGPLTYTILLVPRVTELCKKVLEDQGVAGDVTLSEFNLGFIPMEDDLLSLEMEDVARDIYLNGDDTPIHSSSLALMTFQRAFGVFPRILGKGDGAKKLTDLLQRHRSSDPSQYSEIEPAEKVDGLIIIDRSVDWVTPMCTQLTYEGMLDEFMGIKNSHIEVDPSLLDPNPTGTNSPPSTALPSATVTKKRKHHLTSQKDALFQDIRDRNFAVVGSRLSKLAKRLQDDRGVVKNLRSVTQMKEFVGKIGGMKGDQQALKLHTELTEALMRITQTEEFNKNLEAQQNLVAGYDTSTQLSNIEDLMYQQIPWQTVLRSVILMSLTTGGIKPKNLEVFKRDFLQVYGYHHLPLLINLQSLNLLVRSPSLTSQNFPALRKSLRLLVDDINDAVPNDISYVYSGYAPLSIRLVQCVTQKNVILSGPTEEGPGRQVLPKAHRISGWKGFEDVLAGIPGSTVDVKQKVERVRSDMAGHNGEQFTTTVVFFLGGCTYTEISALRWMSNQTTGRRFLVATTGIINGNSLIEGFGDKMPVPLRSQD

SEQ ID NO: 23680 - protein, 297 aa, Salmonella enterica subsp. enterica serovar Typhi str. CT18
MMNLKAVIPVAGLGMHMLPATKAIPKEMLPIVDKPMIQYIVDEIVAAGIKEIVLVTHASKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGAKFRKSIEQLLHE

SEQ ID NO: 23681 - protein, 278 aa, Glycine max
MSKEVSQEGLQRKDYVDPPPAPLFDLAEIKLWSFYRALIAEFIATLLFLYVTVATVIGHKKQTGPCDGVGLLGIAWAFGGMIFVLVYCTAGISGGHINPAVTFGLFLARKVSLIRAVFYMVAQCLGAICGVGLVKAFMKHSYNSLGGGANSVSAGYNKGSALGAEIIGTFVLVYTVFSATDPKRSARDSHVPVLAPLPIGFAVFMVHLATIPITGTGINPARSLGAAVIYNNGKVWDEHWIFWVGPLVGALAAAAYHQYILRAGAIKALGSFRSNPTN

SEQ ID NO: 23682 - protein, 235 aa, Zea mays
MSVGFIGAGQLACALARGFTAAGVLSAHKIIASSPEMDLPTVSALRKMGVNLTRSNKDTVRHSDVLFLAVKPHIIPFILDEIGADVQERHIVVSCAAGVTISSVEKKLMAFQPAPKVIRCMTNTPVVVREGATVYATGTHALVEDGKLLEQLMSSVGFCTEVEEDLIDAITGLSGSGPAYAFMALDALADGGVKMGVPRRLAVRLGAQALLGAAKMLLDSEDHPGQLKDNVCSPG

SEQ ID NO: 23683 - protein, 186 aa, Azotobacter vinelandii
MIPVILSGGSGSRLWPLSRKQYPKQFLALTSERTLFQQTLQRLNFEGMQSPIVVCNQEHRFIVKEQLEAIGLNIQGLLLEPFGRNTAPAIALTAMKLLAEGRDELLLILPADHVIADQQAFQQALKVAAQAAEMGELVLFGIPAHSPETGYGYIKCDLAVQGTLPEGSNRVLQFVEKPDLAAPANS

SEQ ID NO: 23684 - protein, 480 aa, Salmonella enterica subsp. enterica serovar Typhi str. CT18
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 23685 - protein, 1422 aa, Streptomyces avermitilis MA-4680
MQIRLTVVDPLGPPSEPRARAASCDVLVTAPAGTALAAVASGLASAVAGDGGAAQPERSRESGGGPVVLYAGAERLDAQRCTLGEPPLTDGAVLSLGAPVEPGPDVAAVTAELHVVAGPDAGGVHLLHGGQIQIGRSADADVPLDDPDVSRLHCAVTVAEDGRVSVADLGSTNGTTLDGRRVGDRAVRFAPGALLRLGESALRLAPPGGVEAVGTAPDGEGHVRVTDGGAPGLGGFRLAWGPGGARGLPEVRRPVWAVPHARGGGGAGRGAPSGGASAAASGDGRPSGETHHAFGASAWGAAGGAPSAPAGGAPGAQEHGPVEPRFPAPVVPGQGGAPRIESRRTPESGGTGPDGRPVAGPGGASAGRPRDVPGADTRDLRGGNARDVPGRDPRDLPGQGPGEGRDRGRREVPGQGPGGVPGHGHGEAHGRGPGEGHGRGPGEAHGRGRRDAPDRGPGDVPGRGSGHDSGGVPGQGPGDGHPLGSAEGPDRGPREGYGARPGEVPGPDDLRGGIPGAGPRKGTPLRGTDVPQGARRRGGFSAWARRLTGGRGEPAGDGPQAYDEDTARVPEPAVTGAQAPEKWPDPAALLLTALGPGPRLWERGPGHPEALTVRLGTADRTAPDGSGLLPAVPVTAGLREAGALGLAGPRARLAGLARAVVAQLAALHSPDTLEIVLISGDRSRPVEERTAEWSWLGWLPHLKPAHGQDCRLLLAYDRDQTAARTDELLRRLEDHLADTDHTRNAPQDLPRPADTPDTALRGGARRPSWARDDQQDGDDTFTGPYTVVIVDGDPGGADVREAVVRLVQDGAQAGIHVICLAETAAASPSSPVTETYEAACAVSPAFRECGAVALLSGDVATALRLLRVAPGEPPRHAQEQGQEQGQEQGQRQGQRPTTDHARGPATGQSQGPDAGHTRDTAATRGRHGSAGAGAPRPRSGPGADERTHHDHTGRALRDSLDRAPAGRADHGSATRAHRGPVGHGTVAAVDAVSSAWAERFARALAPLRTDGSGDRHARVSAPLPQAARLLDELGLARATPASLMARWADAADDPETRGGRAAAVLGAGPRGPVGVDLVAEGPHLLIEGPAGSGRTELLRALAASLAAAERPDRLGIVLIDGRDRGAHGAGAGDGLRVCTDLPHVTTHLAANDPVRMREFAQSLSAELKRRAELLGRLGFAEWHAQRAVPARIVPQRTSRIRPAPRDPGTSGAPGAPGAPGTSDPAGAADLDTPPSSTLRLRPAATRERTESGPPARLVVVVDDLDALLSPALGSPGRPAAGSVVRALEAVAREGERLGVHLVTASSLEGRTAQTEPARAAALRITLEAVSPGVDEPAPGRGQLTFADGRVIPFQGGRVTGRIPRTATLRPTVVPLEWHRMGDPPARRPVRELGNGPTDLALLASALERAARSVSATEVPSLL

SEQ ID NO: 23686 - protein, 526 aa, Candida maltosa
MTSDSTIHELIQSYITKWYVIVPLAIIIYKVFDYFYVLSLRKRLGAAVPTNEETDGYFGFHLPFVLMSKKKDGTIIDFSIERYPELKHPETPTFEFPIFTVKLISTIDPENIKAILATQFSDFSLGTRHAHFAPLIGDGIFTLDGAGWKHSRAMLRPQFAREQVGHVKLLEPHVQVLFKHIRKNKGREFDLQELFFRFTVDSATEFLFGESVESLRDASIGMTSKSKDVDGIEDFTGAFNYSQNYLASRSIMQQFYWILNGKKFRECNAIVHKFADHYVQKALNLTEADLEKQAGYVFLYELVKQTRDPQVLRDQLLNILVAGRDTTAGLLSFVFFELARNPDVVAKLKDEIDTKFGLGEDARIEEITFESLKQCEYLKAVLNECLRLYPSVPQNFRVATKNTTLPRGGGKDGLSPILVRKGQTVMYSVYATHRMESVYGKDATTFRPERWFEPETRKLGWAFVPFNGGPRICLGQQFALTEASYVTVRLLQEFSTLTLDPNLEYPPKKMSHLTMSLFDGTNVQMY

SEQ ID NO: 23687 - protein, 538 aa, Candida maltosa
MPVSFVHNVLEVVTPYVEYYQENLTKWYILIPTILLTLNFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMTPSTKNIAGREEFADAFNYSQTYNAYRFLLQQFYWILNGSKFNKSIKTVHKFADFYVQKALSLTEADLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTILATHRDPNIYGEDANVFRPERWFEPETRKLGWAYVPFNGGPRICLGQQFALTEASYVTVRLLQEFHTLTQDADTRYPPRLQNSLTLSLCDGANIQMY

SEQ ID NO: 23688 - protein, 249 aa, Saccharophagus degradans 2-40
MSDEQTTHFGYEKVDVKDKARRVAGVFHSVAAKYDIMNDVMSGGIHRIWKQFTIELSGVRSGHKVLDIAGGTGDLTKKFSRIVGPTGQVVLADINESMLNVGRDKLIDSGVAGNVVYTQADAQYLPFPDNTFDCITIAFGLRNVTDKDLAIASMLRVLKPGGRLLILEFTKPQNALVEKAYDFYSFKILPTMGQIIAQDADSYRYLAESIRMHPDQETLKGMMDAAGFAQTKYHNMTGGIVALHTGIKP

SEQ ID NO: 23689 - protein, 409 aa, Bacillus subtilis subsp. subtilis str. 168
MIKRYTCPNGVRIVLENNPTVRSVAIGVWIGTGSRHETPEINGISHFLEHMFFKGTSTKSAREIAESFDRIGGQVNAFTSKEYTCYYAKVLDEHANYALDVLADMFFHSTFDENELKKEKNVVYEEIKMYEDAPDDIVHDLLSKATYGNHSLGYPILGTEETLASFNGDSLRQYMHDYYTPDRVVISVAGNISDSFIKDVEKWFGSYEAKGKATGLEKPEFHTEKLTRKKETEQAHLCLGFKGLEVGHERIYDLIVLNNVLGGSMSSRLFQDVREDKGLAYSVYSYHSSYEDSGMLTIYGGTGANQLQQLSETIQETLATLKRDGITSKELENSKEQMKGSLMLSLESTNSKMSRNGKNELLLGKHKTLDEIINELNAVNLERVNGLARQLFTEDYALALISPSGNMPS

SEQ ID NO: 23690 - protein, 107 aa, Haemophilus influenzae R2866
MSEVLHINDADFESVVVNSDIPVLLDFWAPWCGPCKMIAPVLDELAPEFAGKVKIVKMNVDDNQATPAQFGVRSIPTLLLIKNGQVVATQVGALPKTQLANFINQHI

SEQ ID NO: 23691 - protein, 463 aa, Pseudomonas putida GB-1
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMGWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMYSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVGARSMG

SEQ ID NO: 23692 - protein, 541 aa, Oenococcus oeni PSU-1
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLRWEPKY

SEQ ID NO: 23693 - protein, 404 aa, Bacillus subtilis subsp. subtilis str. 168
MKIIVQKFGGTSVKDDKGRKLALGHIKEAISEGYKVVVVVSAMGRKGDPYATDSLLGLLYGDQSAISPREQDLLLSCGETISSVVFTSMLLDNGVKAAALTGAQAGFLTNDQHTNAKIIEMKPERLFSVLANHDAVVVAGFQGATEKGDTTTIGRGGSDTSAAALGAAVDAEYIDIFTDVEGVMTADPRVVENAKPLPVVTYTEICNLAYQGAKVISPRAVEIAMQAKVPIRVRSTYSNDKGTLVTSHHSSKVGSDVFERLITGIAHVKDVTQFKVPAKIGQYNVQTEVFKAMANAGISVDFFNITPSEIVYTVAGNKTETAQRILMDMGYDPMVTRNCAKVSAVGAGIMGVPGVTSKIVSALSEKEIPILQSADSHTTIWVLVHEADMVPAVNALHEEFELSK

SEQ ID NO: 23694 - protein, 547 aa, Physcomitrella patens
MADLSSSAVGDRNAKGDPGSSMHGVTGKEALYAFSLHDGDKMNYDPDAKFALPVDSEHKATTMRIHSFSRPHMLTFHLSWFSFFTCFMSTFAAPPLIPVIRDNLNLNKEDIGHAAIASVTGSILSRLLMGSLCDMIGPRYGCAFLVMIISPAVYAMAVVDSAAGFTAVRFFVGFSLATFVSCQYWMSSMFNGKIVGTANGIAAGWGNLGGGATQMIMPLVYALIKDSFHSPSYTAWRLAFFLPGVMHTVIGLLVLFLGQDLPDGNFKELQEQGTKPKDSFKKVFINAITNYRTWIFLITYGYCFGVELTVDNIIAEYFYDRFGLSLSTAGIIASSFGLMNIFSRPLGGILSDVVARRYGMQGRLWNLWIIQTLGGVFCIVLGKTAALGPAIGVMIVFSFFVQAACGATFGVIPFVSRRSLGVISGFTGAGGNVGAVLTQTIFFTQATYHTEVGIENMGIMIICCTALVLFVWFPQWGSMFFKSSRMTEEDYYASEYSEGEQDQGLHQASLKFAENAKSERGRSKGSKSPPENGKPDGLKGIKEGAEV

SEQ ID NO: 23695 - protein, 805 aa, Coprinopsis cinerea okayama7#130
MALVASLLELPKTSNGLETFGIGIQDNSNDGSASPRRKIARLDADSDIASRSKTKTTPSGPFVIRIIGEDIASKDQAEIRRGLLGSVNRCVRHILTVGQDATALPMSYEKIYQDCRSIVTVHSAGSELYDYVKLDLEQAMSKLASHLLTFDAQEKVKWLSFFAQNLKWFDGRISLLTYLDQVYVANHSLTKTTIHDLAYGLFADRIFSNPDIRDRLLSGLSSWLKYERDNVTRAEERPQIAELIKYLINHNQYRTFEEHYLEVTQFYYRRESKAKVESMRDNPKGFFNLIESRIKQEIERSRELLQVGTWSIALETTETALLDGRVDFLSTSLVPLLLGESDIDTLGALYSRLNRVDALKPLAQAFKEYVQGEVKTIVTDTERDSEMVERLLDLNRLAHKAIDQAFVKVSQPSQKPSTSATPVEPEKKPDQEFIYAMEDAFNRGFRFRRNKPAEMIAKYLDKQLRKGQKGMKDAEFQAELSRVLPLYRFTEDKDVFRTFYHRMLSKRLLLGKSASTDIEKWMLKQLKDKYDPEFGTAEDMFKDLNLSRDLVEGFHRKNDNPESLKLNVMVLQQSVWPFSRPQTDVDLPVEMQDQLIKFTEYYKDQHQGRTLHWDPALGTVSLRASFKAGVKELSVSLYQAIILLLFNDQDDIPFKDIAEQTRIEDAELRRTLQSLACGKKRVLRKVPPGRDVEDGDVFKFNADFTDPHHRVHINTIQAKVSAEESKRTNISIESDRIHTIDAAIVRIMKAKKELNYEQLKVATIDAVKNHFVPSVDLIKKSIDSLVDRDYLTRNEEDMSKFVYVA

SEQ ID NO: 23696 - protein, 490 aa, Pseudomonas fluorescens PfO-1
MARFELQKLYIDGAYSDAGSDATFEAINPANGEVLAHVQRATKEDVERAVVSAEKGQKIWAAMTAMERSRILRRAVDILRERNDELAALETLDTGKAFSETKYVDIVTGADVLEYYAGLVPAIEGEQIPLRDTSFVYTRREPLGVVAGIGAWNYPIQIALWKSAPALAAGNAMIFKPSEVTSLTTLKLAEIYTEAGVPNGVFNVLTGSGREVGTWLTEHPRIEKISFTGGTDTGKKVMASASASSLKDVTMELGGKSPLIICDDADLDRAADTAMMANFYSSGQVCTNGTRVFVPSHLKAAFEAKIVERVARIRVGNPEDENTNFGPLVSFPHMESVLGYIAKGKEEGARVLCGGERLTDGEFAKGAFVAPTVFTDCTDDMTIVREEIFGPVMAILSYETEEEVIRRANDTDFGLAAGIVTRDLNRAHRVIHQLEAGICWINAWGESDAKMPVGGYKQSGVGRENGISSLNNFTRIKSVQVELGDYVSVF

SEQ ID NO: 23697 - protein, 548 aa, Physcomitrella patens
MADQSASGVGNKNAKGDPGTSMHGVTGKEPVYAFSVLQAAKAKPDPDAAKFALPVDSEHKATTMRIYSFRAPHMLTFHLSWFSFFTCFLSTFAAPPLIPVIRDNLNLDKGDIGHAAIASVSGSILSRLLMGSICDLIGPRYGCAFLVMIISPAVYAMASVETAAGFTAVRFFIGFSLATFVSCQYWMSSMFNGKIVGTANGIAAGWGNLGGGATQLIMPLVYALIKDSFKSPSFTAWRLAFFLPGVMHTTIGLMVLFLGQDLPDGNFKELEAQGTKAKDSFRKVFVNAVTNYRTWILLITYGYCFGVELTVDNIIAEYFHDRFNLSLSSAGIIASSFGFMNIVSRPLGGILSDIVAVRFGMRGRLWNLWIIQTLGGVFCIILGKTAALGPAIGVMIVFSFFVQAACGATFGVIPFVSRRSLGVISGFTGAGGNLGAVMTQTIFFTQATYHTEVGIEYMGIMIICVTALVLFVWFPQWGGMVFPSSKMSEEDYYASEYSEGEQDQGMHEASMKFAENSKSERGRRKGSNSPPQDAKPDGLKGIKEGAEV

SEQ ID NO: 23698 - protein, 517 aa, Physcomitrella patens
MADQSRANATDEIVFRLPVDSEHKAKTLHIFSFAKPHMRAFHLSWISFFTSFLSTFAAPPLIPVIRDNLNLTKTDIGQASIASVSGAVLSRLMMGTVCDIVGPRYGSAFLIMINAPAVFSMAVVDDPAGFLICRFFIGFSLATFVSCEFWVTNMFTTKIVGTANGLAAGWGNLGGGATQIIMPLIFLWIRDSFHHPSFMAWRLAFFLPGTVHIFVGLLILFLGQDLPDGNDTTHLHRQNDVKDSFNKVLYFAVTSPRTWIFFIIYGYSFGVELTVDNIIAEYFYDRFDLNLNTAGVIASAFGFMNIFSRPAGGYLSDYIGRRFGMRGRLWILWIVQSLGGVFCILLGLMTDLSAAIAAMIVFSIFVQAACGTAFGIIPFISRRSLGMVIGLTAAGGNIGSVVTQALFFTSSSYHTEVGLIYMGVMILCCTMLVTLIWFPQWGSMFFPARKSATEEDYYVSEWTAEEQGHGLHLASLKFAVNARSERGRHGSSSSRDPEGDHPTADGIGLSLWKSYSH

SEQ ID NO: 23699 - protein, 478 aa, Pseudomonas fluorescens PfO-1
MARGCYTARHFVLQASPVTTIATAFNTLPLSAAMLANLDSLGYAQMTPIQAQSLPVILKGMDLIAQAKTGSGKTAAFGIGLLNPINPRYFGCQALVICPTRELADQVAKEIRRLARAEDNIKVLTLCGGVSFGPQIGSLEHGAHIIVGTPGRIQQHLRKGSLVLDGLNTLILDEADRMLDMGFYDAIEDIIEQTPARRQTLLFSATYPVGIKQLASKFMRDPQTVKAEAFHDDTQIEQRFYEISPEERMSAVTKVLHHFRPASTVAFCFTKQQVQETVDHLTSKGISAVGLHGDLEQRDRDQVLAMFANRSTSVLVATDVAARGLDIDALDMVINVELARDSEIHIHRVGRTGRAGEKGIAVSLVAPSEAHRAQAIEQLQKTPLNWDQVDNLKSQGGAPLQPPMSTLCIAGGRKDKVRPGDILGALTGEAGIPGAQVGKIAIFDFQSYVAVERTVVMQALQRLNNGKIKGRSLRVRVL

SEQ ID NO: 23700 - protein, 281 aa, Burkholderia xenovorans LB400
MTSDIASVSLPDGERIPKLGQGTWEMGEVPARRAAEIDALRCGIELGMTLIDTAEMYGDGATESLLGVALAGLRDKVFLVSKVYPHNASRRGVIAACEQSLKRLKTDQLDLYLLHWRGSVPLAETVEGFEALRRAGKIRHWGVSNFDTADMEELVATPGGDACATNQILYNVARRGPEFELLPWLAARKMPAMAYSPVDHARLPKRSPLDNIADARGVSVFQVALAWVLLAPGVFAIPKAGRAEHVRDNHRAAQLQLGADELAAIDAYFKPPRSKRPLEML

SEQ ID NO: 23701 - protein, 142 aa, Triticum aestivum
MLCIRTYVRMCGQKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAQWRT

SEQ ID NO: 23702 - protein, 382 aa, Treponema denticola ATCC 35405
MIYLDNSATTLQKPESVAQEVFRGIASHQFGNPGRGAHSTAHAALTELFKTRQTLAKLFNIKNPLNVALCQNATSALNLVIKSLFSGKENTHVITTVLEHNSVLRPLYQLEKDGAELSIIPIQDGFLCYELIEKEVKSNTKAIIVNHCSNVIGSICNLDYVHSICKKHGLILIVDASQSAGTIPIDASKYGQSIFCFTGHKGLYGPQGTGGIIVNGTFEFAPVFSGGSGVRSFDKTHPSEMPDIFEAGTMNVPSFMGLNAGASYVLKTGISSIQKKLADLKLLFIEEIKTIPNLKIYGNPWSEKTGAVVGINIGDIPSGEISRLLDEEFGIASRPGAHCAPLVHKALGTEEQGIVRFSFSSFNTFEEVKQAAEALKQIAQNA

SEQ ID NO: 23703 - protein, 457 aa, Magnaporthe grisea 70-15
MSAKATRGSTSSSTPQNSSSSSQSQSQSTAVSRIRNIANHMMASPSTIFTADVVPQAPEDPLFGLMAAYRADESPDKVDLGIGAYRDDNAKPWVLPVVKKADEIIRNDPSANHEYLPITGLASFTSKAGELMLGADTPAKGRVTSVQTISGTGALHLGALFLQKFYRKVYSNSVVHLSNPTWANHNQIFSNVQVPTTTYPYFDKGTKGLDFEGMKATLNNAAEHSIILLHACAHNPTGVDPTQGQWREIAEIMKAKKHFPFFDCAYQGFASGDLDRDAWAVRYFVEQGFELVIAQSFAKNFGLYGERAGCFHYVSAPAAEAAETTKRVASQLAILQRSEISNPPIYGARVASIVLNDPALMSEWRENLRTMSGRIITMRNELRAKLEALGTPGTWNHITDQIGMFSFTGLTEAQVLKIRSDYHVYMTKNGRISMAGLNSRNIDYFAKAVDKVVRETQ

SEQ ID NO: 23704 - protein, 162 aa, Salmonella enterica subsp. enterica serovar Typhi str. CT18
MLEDLRANSWSLRPCCMVLAYRIAHFCSVWRKKNVLNNLWAAPVLVLYRVITECLFGYEIQAAATIGRRFTIHHGYAVVINKHVVAGDDFTIRHGVTIGNRGADSLACPVIGHGVELGANVILLGDITIGNHVTIGAGSVVLDSIPDHALVVGEKARVKVST

SEQ ID NO: 23705 - protein, 262 aa, Silicibacter sp. TM1040
MSGDLSPIDKAKFVAAKRAAELVEDGMRVGLGTGSTAAWLVRCLGEMVREDGLKITGVPTSARTAELAREVGIELITLDEARWLDLTIDGADEFDSELNLIKGGGGALLQEKIVATASDQMVVIADKAKEVETLGAFPLPIEVIPFGWQTSQALVEETLISMDVMGRSSTLRMNGASPYVTDEGNHILDLHLNRIGNPRQLALVLNQIPGVVENGLFIDICDTVVIGYGDGKVEVRDINEGTIETDRIDFVETDNLFADLND

SEQ ID NO: 23706 - protein, 219 aa, Shewanella oneidensis MR-1
MTESHIDFRRAKFLISAPDIAHLDQYLPGDVGVEIAFAGRSNAGKSSALNALTEQKNLARTSKTPGRTQLINVFELDAQRRLVDLPGYGFAQVPLAMKMKWQQSLAEYLQKRACLSGVVVLMDIRHPLKDLDMQMIEWAVASEIPVLALLTKSDKLAQSAKMKTVNEVRKALAEFGDWVQVESFSALKGTGKPKVLSILNEWCHPQWLANELENQDNAE

SEQ ID NO: 23707 - protein, 316 aa, Physcomitrella patens subsp. patens
MEPRVGNKYRLGRKIGSGSFGEIYLGTNIQTNEEVGIKLESIKTKHPQLLYESKLYRILQGGTGIPNIRWFGIEGDYNVLVLDLLGPSLEDLFNFCSRKFSLKTVLMLADQLINRVEYVHAKSFLHRDIKPDNFLMGLGRRANQVYIIDFGLAKKYRDPSTHQHIPYRENKNLTGTARYASINTHLGIEQSRRDDLESLGYVLMYFLRGSLPWQGLKAGTKKQKYEKISEKKMSTPIEVLCKAYPSEFASYFHYCRSLRFDDKPDYAYLKRIFRDLFIREGFQFDYVFDWTILKYQQSQIAGGPSRAVVCPIPVHL

SEQ ID NO: 23708 - protein, 611 aa, Magnaporthe grisea 70-15
MSQFNHFKIKRAANALSRKGSDSSFNPFAHIQWRKERSQTFPVDVERGEGAGGGRARRDDGEDDIDHSPIVHVSTAPVSGRGQNERATDQESIGAAPTATNSEKQSQEPVDASRDDNKTLTGLSPESAENGLRQRRPEPKLDTTVDGLAPSSSGAETGSDADNGKQKKSSRFIKHVEPKEPFTIANQLQRTFLSSWINILLFAAPAGIALHFTSVSPIVIFVVNFIAIIPLASMLGFATEEIALRTGETLGGLINATFGNAVELIVAIIALMEGEVVIVQTSLIGSILSNLLLVLGMCFFFGGLRRREQFFNETVAQTAASLLALAVAGVIVPTVFDRASNTPDHDVALLSRGTAIILLFVYAGYLFFQLHTHQEVFGEESQKVPAKPFRNHSPNPARNGIAAGLAGPGRGLIAQSISPSGEEGREKLSQMLKEPGRVAAAAEEEDDSEEPQLHFFVALALLAGCTVVIAFCAEFLVDSIDYVTSQGGISKEFLGLILLPIVGNAAEHATAVTVAIKDKMDLAIGVAIGSSMQVALFLIPLLVVIGWGKNMDAMGLSFDIFQVAVMFVAVLLVNYLISDGKSHWLEGMLLMCLYAIIAVCSWWYPTPQPTT

SEQ ID NO: 23709 - protein, 473 aa, Streptomyces avermitilis MA-4680
MAAVTAAGAAQAPIVAGHPLLGSMNDLLNDPLATYLRARRDHGDVVRFRAGPPGLRADIYAVFSAEGAQQVLATESGNFRKDNVFYGELRDSVGNGLLTSQDATYLRQRRLVQPLFTRRRVDGYAGQVADEAAGLAEAWRGIPGGGVELVGEMHRFALRVVGRILFGTDMETTFEVIERTLPLLQEYALKRGLAPVRTPRTWPTPANRRAARTQAELFALCDGIIDSRRNRKNEGDGGEESGEDLVTLLVRAGNAEDGSLDAAELREQVLIFLLAGHETTATALAFALHLLARHPEQQRRVRDEADRVLGGPGGRAPTAADMEALPYLTMVLKEAMRLYPSAPVIGRRAVADAEVDGVRIPAGADLFVSPWVTHRHPDYWPDPERFDPERFTPEAEAGRPRYAWFPFGGGPRACIGQHLSMLESVLGLAVLIREFEFEAVGEEEVPLGAGITLLAKGPARCRVIPRSSGPRSS

SEQ ID NO: 23710 - protein, 415 aa, Oryza sativa Japonica Group
MGAKDSKPSYSYSSSYDHGNSSSGYNSRYPAYPANASSSQNTRYAPSMENYVQPETHARLQRKYSRIGDDYRSLNQVTEALAQAGLESSNLIVGIDFTKSNEWTGKLSFNRRCLHDIGNTPNPYEQAISIIGRTLSAFDEDNLIPCFGFGDASTHDQEVFSFYPENRPCNGFEEALERYREIVPTLRLAGPTSFAPMIETAIGIVDSTGGQYHVLLIIADGQVTRSVDTQSGQLSPQERDTIDAIVKASQFPLSIVLVGVGDGPWDMMHQFDDNIPARSFDNFQFVNFTDIMSKSIAADRKEAEFALSALMEIPTQYKATLDLQLLGRRQRIQPRIPLPPPMRNAYSRSTSFDQHSGVYSRSSSFGPQTSGFQQSESFKQRQPVATTAPDTYTSESSLEGRLVSIFVYIHTMLNR

SEQ ID NO: 23711 - protein, 348 aa, Lactococcus lactis subsp. lactis Il1403
MKSVYFVEKNKMQVREFPKAQLVKETDAIIKIVRACVCGSDLWWFRGISERQPGPVGHEAIGLIEEVGTGVKNFKVGDFVIVPFTHGCGHCPICLAGFEANCPNAKDGVNGGYQGEFYRAINTDGALVKIPGQPSDYSDDQLASLTALADVMPTGFHAAKAADVHEGDTVVVFGDGAVGLCAVISAKLLGAKRIIAMSRHEDRAALARDFGATDIIDERGEEAIQKIMSLTNGYGADAALECVGTKQAIESAFQAVRAGGRVGRVGVPHDVDYNEWIDSLFWKNIQLGGGVASVARWDKEILLEAVLSGEINPGRVFTAEFSLDEIQKAYEAMDQRTAIKSLLRISEV

SEQ ID NO: 23712 - protein, 324 aa, Triticum aestivum
MMGGFVSRILLLVFGYAYPAYECYKTVELNKPEIEQLIFWCQYWILVALMTVMERFGDLTISWLPFYSEAKLLFFIYLWYPRTKGTTYIYGTFFKPYISQHENEIDRNLLELRARASDVVVVYVQKVAAVGQNTFFDVLKYVASQSPSQKSKQQRPQEPQQSQPQPQVQQQQPQRQAQPVMHRAASIAARQAAMAQQAQETKPISPKFKRQASAKGGPAASTKPAAAAAPTTKPDEKTKKSEAKPAAELVPAPAAEAVVPRPEPKAQPAPEAEVSDDMAIDEANVAVEGAEEVDPALEEETVMEETIRVTRAKLRRRAAAEGPA

SEQ ID NO: 23713 - protein, 362 aa, Zea mays
MEMTGSLPVPSVQAMVAAGRHAPVPPRYLRPDLAADVVVADDATTIPIIDFQRLLLVDPEESARLHAACQDWGFFQKKMCTQLINHGVPDDVMEAMKASTQSFFALPAEAKQQYRQQAGQLEGYGQLFVVSEDQKLDWADVLYLNTQPPEHRNLSFWPAGESFRQTLDTYSAAVKHVADRLLGAMYMNLGLLSSMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 23714 - protein, 141 aa, Glycine max
  misc_feature (25)..(25): Xaa can be any naturally occurring amino acid
GKVDNFDGRDYDDDVNYSDHFAPKXAITKAVEASGVTTGSILSLRESLQNCKDTLATCQNELEAAKSEIQSWHSTLKNQPSILAGIIPEPKMLINYLQALKSSEESLREQLEKAKKKEAAFIVTFAKREQEIAELKVITLK

SEQ ID NO: 23715 - protein, 336 aa, Anabaena variabilis
MIRVAINGFGRIGRNFARCWLGRENSNIELVAVNDTSDPRTNAHLLNYDSSLGVKKVDITADDNSITVNGKTIKCVSDRNPENLPWKEWEIDLIIESTGVFTSKEGALKHVNVGAKKVLITAPGKNEDGTFVIGVNHHDYDHNVHHIISNASCTTNCLAPIAKVLNDKFGIIKGSMTTTHSYTGDQRLLDASHRDLRRARAAAINIVPTSTGAAKRVALVIPELKGKLNGVALRVPTPNVSMVDFVVQVEKRTITEEVNQALKDASEGPLKGILDYSELQLVSSDYQGTDASSIVDASLTLVMGNDLVKVMAWYDNEWGYSQRVLDLAELVAEKWV

SEQ ID NO: 23716 - protein, 337 aa, Anabaena variabilis
MKIRVGINGFGRMGRLALRAAWGWPELEFVHINEIKGGAVAAAHLLKFDSVHGRWTPEVEAEGERVLIDSTPLSFSEYGKPEDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSAKAIALIYPELKGKLNGIAVRVPLLNASLTDCVFEVNRPTTVEEINALLKAASEQAPLQGILGYEERPLVSIDYKDDPRSSIIDALSTMVVDETQVKILAWYDNEWGYVNRMVELARKVALSLK

SEQ ID NO: 23717 - protein, 623 aa, Lactococcus lactis subsp. lactis Il1403
MADFIAQNLSKSVGEKMVFNKINFIIHDLDRIGLLGVNGTGKTTLLNVISGLSGFDGDRTPFDHPQNYKITYLTQEPDFNPKATILDTVLDDSLPQMRAIKNYEAALLDYENLAKLERAQSGMDALNAWQVEADVKTILTKLQLPDSATLIESLSGGQKRRVQLAQALVNDSDLLLLDEPTNHLDVETIAWLQNYLKNSRRTVLFVTHDRYFLDNVATRIFELEDAGLKEYQGNYQDYLAKKAEDEEREAAASHKAKQLYQSELTWIRKSPQARATKQQARIDRFEDLKDSMKTSKNLGDLELNIASSRLGKKVINFKNAAFSYPDRPIFKDFELIVQGHSRLGIVGDNGVGKSTLLNIIDGELALTDGILEIGETVKIGYFSQEIRGLDENKRMINFLEEVASAAHNSSGENISIVNLLEQFLFPRSSHGTLISKLSGGEKKRLYLLKILLLQPNVLLLDEPTNDLDIATLTVLENFLGSFPGAVLTVSHDRYFQDKVSNELLAFEDGQINHYFGAYSDYLAVKTEEKSADKAVSKIESPISTDKTENTDKTKLTYMEKKEWETIESQIAEIEERISQIDTEMNENGSNTELLLDLQKELDNKTKELEEKYERWEYLSERAD

SEQ ID NO: 23718 - protein, 90 aa, Gossypium barbadense
MAMRKVYSEIKGMKLKEVPGYFKPMLSMGYLKKSVQRGLDNYHAKYIETDSIEPLYHVCFGGMIFSYLVALPNERRHLEHKKHAEQHGHH

SEQ ID NO: 23719 - protein, 269 aa, Populus trichocarpa
MASLIESCWLYLITHFSDFQLACLGSFFLHESIFFLSGIPFIYLERAGWLKKYKIQMKNNTPASQEKCIIRLLLYHFGVNLPVMLASYPVFRHMGMQSSLPFPSWNVILTQITFYFILEDFIFYWGHRILHTKWLYKHVHSVHHEYATPFGLTSEYAHPAEILFLGFATIIGPAITGPHLLTLWLWMVLRVLETVEAHCGYHFPWSLSNFLPLYGGADFHDYHHRLLYTKSGNYSSTFTYMDWVFGTDKGYRKLQALKNAGVENGGKQM

SEQ ID NO: 23720 - protein, 231 aa, Oryza sativa Indica Group
EGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYPGAKFRAPVDPY

SEQ ID NO: 23721 - protein, 291 aa, Triticum aestivum
  misc_feature (252)..(252): Xaa can be any naturally occurring amino acid
VRPIGTLAAIDKSQAELNYDQVFMRDFVPSALAFLMKGEPTIVKNFLVETARLQSREKMVDLFKLAQGVMPASFKVHHSHPTKKTETLLADFGEIAIGRVAPVDSGLWWIFLLRAYTKYTRDSSLAESPHCQRAMRLILKLWLCEGFDTSPALLCADGCSMIDRRMGIYGYPLEIQALFFMALRCALSLLKDSDDDFVYQITKRIKALSYHLHSYYWLDFQRLNDIYRYKTEEYSQTALNKFNVIPESIPDXLFDFMPSRGGYFIGNVSPARMDFRWFCLCNFIAILSCLA

SEQ ID NO: 23722 - protein, 255 aa, Sinorhizobium meliloti 1021
MSKSGLWVGTSWKMNKTLAEAMVFADGLAAADDARDQRIQRFVIPPFTAARQVKERLKATSVKVGAQNMHWDDAGAWTGEISPVMLSDCDLDIVELGHSERREHFGETDRTVGLKTAAAVKHGLVPLICIGETLAQREAGEADTVLKRQVEGAFAFLEGAARKAPVLLAYEPVWAIGVNGIPATADYADARHRLIGEVAERALGVKVPVLYGGSVNPQNCEELILQPHIDGLFIGRSAWDVGGYLDILQRVARAI

SEQ ID NO: 23723 - protein, 333 aa, Thermotoga maritima MSB8
MARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 23724 - protein, 654 aa, Thermotoga maritima MSB8
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASIADKKKITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 23725 - protein, 360 aa, Populus trichocarpa
MDFDLSPRLAQQLFDGEAGSYYSWSSSEFPLLAEEKVGAGRLVLQPRGFALPHYADSSKIGYVLQGSDGIVGMVLPNSSEEVVLRLKKGDVIPVPLGALSWWYNNGDHSEEVVVVFLGQTSKAHIPGEFTYFFLSGGQGIMGGFSTEFISRAYKMNGKEADKLAKSQTGILLIKLEPGISMPHPNTEIVEKMVYNIDAALADVDVRGGGVFKALTAARFPFLEEAGLSVNHVKMEANAMYSPSYTADGTFQVFYVARGTGRVQVVGIGGKRVLDTKIQAGQLLVVPRFFVVAQIADSEGMEFVSILPGTSPAVEEFASKKSVWNALSPIVSQVALSVTPEFEEFFKSNMQKTTILIPPTN

SEQ ID NO: 23726 - protein, 213 aa, Salmonella enterica subsp. enterica serovar Typhi str. CT18
MTDQSHQCVIIGIAGASASGKSLIASTLYRELREQVGDEHIGVIPEDSYYKDQSHLSMEERVKTNYDHPNAMDHSLLFQHLQALKRGSAIELPVYSYVEHTRMQETVRVEPKKVIILEGILLLTDARLREEMNFSIFVDTPLDICLMRRIKRDVNERGRSMDSVMAQYQKTVRPMFLQFIEPSKQYADIIVPRGGKNRIAIDILKAKISQFFE

SEQ ID NO: 23727 - protein, 341 aa, Shewanella oneidensis MR-1
MKALSKLKAEKGIWLVDAPKPEMGHNDLLIKIKKTAICGTDMHIYNWDEWSQKTIPVPMVVGHEYVGEVVDIGQEVRGFNIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFRAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 23728 - protein, 775 aa, Methanosarcina barkeri str. Fusaro
MEEIQLKVEKAYPIDLGRGIIRLDPTTLLKLQLSPGDIVEIRGKKKTTAKVWRADRQDWDQGLVRIDNFIRQNAGVSIGEKVTIKKVEAPEAKKLVLALPESMMQGGPELQFGEHANEIIKRHILKRPVFRGDIIPIINSMSQPMTESLTTSQVIPLVAVETEPSNTIVLVTEETLIELRKKPVQGYEKATRGVTTYEDIGGLGAEIMRVREMIELPMKHPELFGHLNIEPPKGVILYGPPGTGKTLIAKAVANESGASFHYIAGPEIVGKFYGESEERLRKIFEEATQDAPSVIFIDEIDSIAPKRENVTGEVERRVVAQLLTLLDGMVERGQVVVIGATNRVDAIDPALRRPGRFDREIHIGVPDTKDRYEILQIHTRGMPIERDEETEEIGKVETEADEAALERERKEKADKYLMYLAERTQGFVGADLLALVQEAAMRCLRENLPDLDLEKEAIPPERLEKIVVTKRNFEDALMEAEPSALREIYVEMPTVSWNDVGGLDEAKQSITEAVEWPIKNPEKFSHMGIKAPRGILLYGPPGTGKTLIAKAVAKESNANFISVKGPEIFSKWLGESEKAIRETFRKARQVAPCVIFFDEIDSIASMPGMESTDSHTSERVLNQLLTEMDGLESLRDVVVIAATNRPNLLDPAILRPGRFDRLVYIGSPDRKGRLKIFRIHTKDTPLAENVNLETLADETEGYVGADIESVCREAVMIALRENFDTEYVEMRHFREALKKVKPTITENIAQFYEKIEAQFKGGQRLTETAGYIGYR

SEQ ID NO: 23729 - protein, 257 aa, Bacteroides thetaiotaomicron VPI-5482
MKIAIIGAGNMGGSIARGLAKGSLIADSDIIVSNPSAGKLEKLKEEFPGISTTLSNTEAATGADVVILAVKPWFVESVMRELKLKSKQTLVSVAAGISFEELAHFVIAPEMPMFRLIPNTAISELESMTLIAARNTNDEQNLFMLRLFNEMGMAMLIPEDKIAATTALTSCGIAYVLKYIQAAMQAGIEMGIRPKDAMEMVAQSVKGAAALILNNDTHPSVEIDKVTTPGGITIKGINELEHNGFTSAVIKAMKASK

SEQ ID NO: 23730 - protein, 373 aa, Bacteroides thetaiotaomicron VPI-5482
MKLFDVYPLYDINIVKGQGCKVWDENGTEYLDLYGGHAVISIGHAHPHYVEMISNQVATLGFYSNSVINKLQQQVAERLGKISGYEDYSLFLINSGAEANENALKLASFYNGRTKVISFSKAFHGRTSLAVEATNNPTIIAPINNNGHVTYLPLNDIEAMKQELAKGDVCAVIIEGIQGVGGIKIPTTEFMQELRKVCTETGTILILDEIQSGYGRSGKFFAHQYNHIQPDIITVAKGIGNGFPMAGVLISPMFKPVYGQLGTTFGGNHLACSAALAVMDVIEQDNLVENAKAVGDYLLEELKKFPQIKEVRGRGLMIGLEFEEPIKELRSRLIYDEHVFTGASGTNVLRLLPPLCLSMEEADEFLARFKRVL

SEQ ID NO: 23731 - protein, 246 aa, Saccharophagus degradans 2-40
MRRRLIVGNWKMCGDFRTNQKRLEDLSSLWFGVHQTEVSVSPAYPYLAQAAGMLENTNISLCAQDVSTRENGAFTGEVSAAMLADMGCRYVMVGHSERRHYHNEGYDLIAEKFQAVCEAKMIPILCLGETTADREADRTFDVIGRQLLKVVNACGLEGLAKGVVAYEPIWAIGTGRAATPEQAQDVHSYIREILGPEGEQIRILYGGSVKPDTAEGLFAKKDIDGALVGGASLDARDFVAICRAAE

SEQ ID NO: 23732 - protein, 552 aa, Triticum aestivum
VTRLNKFVQKSRLVPVRNSRDIVDPRVRVGFNAVLTSEHFASFLVFIILHVVAFVYYIKGLLTPRLFKMAMTLVITVGLAVCFAVVAILVALVASSPTKGWSGRSLSLLDPTYASKYIPIIASVSEHQPPTWPSYFMDINVLPFLVPAGIISCFLPLSDASSFMVLYLVTAVYFSGVMVRLMLVLAPAACILSGIALSSAFDVLTRSMKCQLSKLFDDGPAISGNGSPNGSSASTVNTSSSKNEKTEKSEAAPKEKPSKKNRRKDKEVTESVSVKPKKEKRLSVLPLEASIVGTLLLIALGGFYVVHCVWAAAEAYSAPSIVLTSRSREGLHVFDDFREAYAWLSHNTDVDDKVASWWDYGYHMTAMANRTVIVDNNTWNNTHIATVGTAMSSPEKAAWEIFDSLDVKYVLVVFGGLVGYPSDDINKFLWMVRIGGGVFPHIKEPDYLRDGHYRVDAPATPPMLNCLMYKLCYYRFVETDGKGFDRVRGFEMGKKPFRLTLLGEVFTTHHWVVRIYKLKPQKNRVRGKLKKLKSGSKASSTNAAGRKKNPWQ

SEQ ID NO: 23733 - protein, 321 aa, Oryza sativa Japonica Group
MSTSRDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 23734 - protein, 269 aa, Aggregatibacter actinomycetemcomitans
MPILTTHLLQDVIEIAQQAGEHLRCFYQRSVTVRMKEDNTPVTEADLFVSQFLTEKLTALTPQIPILSEENCHIPLTERQTWRSYWLIDPLDGTQQFINRTGQFSVLVSLVKDHQPVLGVIHAPMLGSTYYAMQGFGAYKHHDGQHLKLAFHDIQADNALRIAVGSAAAAEKVRSILNKNLAYEFHICGSSGLKSTLVADGVCDCYIRLGCTGEWDTAASEILLAEMGGIIFDLNYQPLTYNKRESFVNPNFVMGITQDFPWDKIFHSN

SEQ ID NO: 23735 - protein, 193 aa, Bacillus subtilis subsp. subtilis str. 168
MSNLPNKITLARIALIPIFMIIMLAPFDWGRLEVGDESIPVAHLEGGILFIIASTTDWVDGFYARKLNLVTNFGKFLDPLADKLLVSAALIILVQFDLAPAWMVIVIISREFAVTGLRLVLAGTGEVVAANMLGKIKTWAQIIAVSALLLHNLPFELVSFPFADLALWVAVFFTVVSGWEYFSKNWEALKTSN

SEQ ID NO: 23736 - protein, 639 aa, Physcomitrella patens
MVSIARLKEACSHCLPPTVAPYHAVCTPPALVTRVFEQATIGRDVRVIGPADLAKFMTDWQGDRNATEERATSLMADFNFLKSTASRALRIPGLSHSSKYSLSSRHSGSKHGQSAPETPTFDIATFLKFLLHPEFNGHRVPVSKTPTDDMNAPLSDYYIFSSHNTYLMGNQLCSPSSTAPIVKALLDGCRVIELDCWNGSNKRIDVLHGGTLTKAVPFEDCVKAIKDNAFTTSAYPVVVTIESHLDLEHQKEAARVLNKILGNIMFVPPPNELPPQSFRSPEQLKHRIIISDKPPGDALLSQAANEPEFAQQTLLHEVVRDPSPDNRHEHRHGRRGKKKKLRRRQSQIAESRIQKLPSGKLGDSGRPAIANDPAFDELLYIHCQKPTEMATAQKKGGPLIKGQHAIMANLSESQLDDLIEDHTDSLIEFSKTNLTRVYPFGLRVTSSNADPMDAWEHGVQVAAINMQGRDRPVWISKAIFSRNGGCGYVKKPDILLPESNMDHKSLMNLQPKLELKVTVLLGTDWHKNYDVFKKPGYFVKVAIHGMHDDEQKFKTHVCKRSREPHWEVEEFVFQIRVPKLAILRLEVREYDRIVRDDMVGQSCVPVTEHRQGIRAVQLASKKGEPGSSKLLCHFITRTL

SEQ ID NO: 23737 - protein, 477 aa, Streptomyces avermitilis MA-4680
MATAPSVSYSMTVRLEVPASGTAVSQLTTAVESHGGSVTGLDVTASGHEKLRIDVTIAATSTSHADEIVAQLRTIEGVTLGKVSDRTFLMHLGGKIEMQSKHPIRNRDDLSMIYTPGVARVCMAIAENPEDARRLTIKRNSVAVVTDGSAVLGLGNIGPKAALPVMEGKAALFKRFAGIDAWPLCLDTQDTDAIVEIVKAIAPGFAGINLEDISAPRCFEIEARLREALDIPVFHDDQHGTAIVVLAALTNALRVAGKAIGDIRVVMSGAGAAGTAILKLLIAAGVKNAVVADIHGVVHADREDLVNAAADSPLRWIADNTNPEGLTGTLKEAVRGADVFVGVSAPNVLDGDDVAAMAEDAIVFALANPDPEVEPAVARQTAAVVATGRSDFPNQINNVLVFPGVFRGLLDAQSRTVNTEMMLAAAAALADVVTEDELNPNYIIPSVFNEKVAGAVAGAVRTAAKAAGVTESDSKDA

SEQ ID NO: 23738 - protein, 171 aa, Solanum lycopersicum
ARKVSLIRAVLYMVAQCLGAICGVGFVKAFMTHPYNALGGGANFVQSGYNNGTALGAEIIGTFVLVYTVFSATDPKRSARDSHIPVLAPLPIGFAVFMVHLATIPITGTGINPARSFGAAVIADNKNVWDDQWIFWVGPFVGALLAAAYHQYILRAAAIKALGSFRSNATN

SEQ ID NO: 23739 - protein, 82 aa, Glycine max
QKRFQKALDLLHNVVTAPMSTINAIAVEAYKKHTLVSLIRHGQFSTSLPKDSSSFAQTNPKNLCQPYAQLGKNHGTGKIAKI

SEQ ID NO: 23740 - protein, 216 aa, Magnaporthe grisea 70-15
MSSTDPTTTGQTAQDASRQQPTAAASSSSELASAKITLYKVLRRFADFPIEGIVFIDIMPIFIDPKAHLALLRALELQVLSSFAPATAKPDVVVGLDARGFLFGPSLALKLDASFVPVRKKGKLPGPCVTATYEKEYGQDFFQMQEGAIKPGQKVLVVDDIIATGGSAAAAGELVKKLGGELMGYLFLLEIAPLKGREKLGGVPVVTLLEEADYPH

SEQ ID NO: 23741 - protein, 504 aa, Sinorhizobium meliloti 1021
MSSETGTYDLFVIGGGINGAGIARDAAGRGLSVLLCEKDDLAQGTSSRSGKLVHGGLRYLEYYEFRLVREALIEREVLLESAPHIIWPMRFVLPHNPADRPAWLVRLGLFLYDHLGGRKRLPGTRVLNLRTAPEGAAIKPAYRKAFEYSDCWVDDARLVVLNALDAKKKGARILTRTACTSIRRRGDLWHVEMTDAETGAKTEAKARCVVNTAGPWVNDVIGRVAGLNSSRSVRLVKGSHIVVPKFWEGRQAYLVQNPDKRVIFINPYQNDLALIGTTDIPYDGRPEDVTADENEVAYLLKSVNRYFKQQLAPGDILHSFSGVRPLYDDNAENPSAVTRDYIFELDAAGKEAPLLSVFGGKITTFRKLSEHALERLRPFFPTMGPAWTARAHLPGGDMADADFDQFLGELRARYRWLPADLAKHYARLYGTRAHDLIGGATSLDELGTAFTPLFREREARFLIENEWARTAEDLIERRTKHGLHMSEAEKRAFSGWFEGQQAAA

SEQ ID NO: 23742 - protein, 396 aa, Salmonella enterica subsp. enterica serovar Typhi str. CT18
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSNPSWPNHKSVFNAAGLEVREYAYYDAENHSLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDALRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 23743 - protein, 387 aa, Pseudomonas fluorescens PfO-1
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAKA

SEQ ID NO: 23744 - protein, 350 aa, Pseudomonas fluorescens PfO-1
MPQPRPYKVALNGYGRIGRCVLRALFERGSAAGFEIVAINDLADMASIEYLTRFDSTHGRFPGEVKVEGDCLHINGHCVKVLRSATPEGIDWASLGVDLVLECSGAWHTRADGQRFLDAGAPRVLFSQPMASEADVDATIVYGVNQDCLTGDELLVSNASCTTNCGVPLLRLLDQAVGLDYVSITTIHSAMNDQPVIDAYHHEDLRRTRSAFQSVIPVSTGLARGIERLLPELAGRIQAKAVRVPTVNVSCLDITMQTASDTDAGEVNRILRDAATSGPLKGLLAYTELPHASCDFNHDPHSAIVDASQTRVSGPRLVNILAWFDNEWGFANRMLDVAEHYLQTATSKKP

SEQ ID NO: 23745 - protein, 396 aa, Physcomitrella patens subsp. patens
MATIMAAAVAAGSTVSTFAKASSSSSVLGRGAQAAAPLRSVACASLGGKSSSLYGAQVINARNAVAQKASSTNREALIRAELGDSLEEFLAKATPDKKLARLLVCMGEALRTIAFKVRTASCGATACVNTFGDEQLAVDMLADKLLFEALRYSHVCKYACSEEEPVLQDMEGEGFSVAFDPLDGSSIVDTNFTVGTIFGVWPGDKLTGITGRDQAASAMGIYGPRTTYVIAINGFPGTHEFLLMDDGKWQHVKETTEIKEGKLFSPGNLRATFDNADYEKLINYYVSEKYTLRYTGGMVPDVNQLIVKERGIFTNVTSPSTKAKLRLLFEVAPLGLLIENAGGYSSDGKQSVLDKQVVNTDDRTQVAYGSRDEIIRFEEMLYGDSRLKAELAALKA

SEQ ID NO: 23746 - protein, 474 aa, Ralstonia metallidurans CH34
MSKQFDVLVIGAGPGGYIAAIRAAQLGLNVACLEGNAYDDPKGEARLGGTCLNVGCIPSKALLASSEEFENASHHLADHGITVGDVKVDVAKMLKRKDDIVSKMTKGIEFLFRKNKVTLFKGYGKFTGKAAEGFQVEVNGETLTAKQVIIATGSKARHLPGVAVDNNLISDNEGALKFGTVPKKLGVIGAGVIGLELGSVWRRLGAEVTVLEALPAFLGAADEGVAKEAQKLLTKQGLQFHLSVKVDEVKTGKDNVTVNYTDKDGKAQTLEVDRLIVSVGRVPNTDNLGLDAVGLGVDQRGFIEVDDHCQTKVPGIWAIGDVVRGPMLAHKAEDEGVAVAERIVGQKPHIDFNTVPWVIYTFPEIAWVGKTEQQLKAEGREYKSGQFPFMANGRALGMGASDGFVKMLADARTDEILGVHIVAANASDLIAEAVVAMEFKAASEDIGRVCHPHPSMSEVMREAALAVDKRQLNM

SEQ ID NO: 23747 - protein, 419 aa, Ralstonia metallidurans CH34
MAIVDVKVPQLSESVAEATMLNWKKKPGEAVAQDEILIEIETDKVVLEVPAPSAGVLSQIIKNDGDTVVADEVIAKIDTAATAGAVAPAAAAPAPAAAAPAPAAAAPAAAASAGAIAMPSAAKLMAEGGLSASQVAGTGKDGRITKGDVLAAGSAPAPAAKAAPAPAAAKPALPQVSAQVDFAALGDRPEERVPMSRLRARIAERLIQSQSTNAILTTFNEVNMKPVMDLRAKYKDRFEKEHGVKLGFMSFFVKAAVHALKKYPVINASVDGNDIVYHGYFDIGIAVGSPRGLVVPILRNADQMSLADIEKKIAEFGTKARDGKLSLEELTGGTFSISNGGTFGSMLSTPIINPPQSAILGVHATKDRAVVEDGQIVIRPMNYLAMSYDHRIIDGREAVLGLVAMKEALEDPARLLLDL

SEQ ID NO: 23748 - protein, 393 aa, Magnetospirillum magnetotacticum MS-1
MSNLPVQSFQPPLRILMGPGPSDVHPRVLAAQARPTIGHLDPAFVGMMDELKGLLQAAFRTANEMTFAVSGPGSAGMEACFVNLIEPGDTVVVCVNGVFGGRMKENVERCGARAVVVEDAWGTPVDAGKVEEALAANPGAKALAFVHAETSTGVESDAAILCALAHAHGALTIVDAVTSLGGIPVLVDQWGADAVYSGSQKCLSAPPGLSPVTFSPRAVEALKARKTKVQSWFLDLTLLTAYWGGGAKRTYHHTAPVNALYGLHESLVMLHEEGLDAAWARHRAMHEALRAGLEAMGLGLLVAEKSRLPQLNAVTVPDGVDEATVRAQLLARFGLEIGAGLGALAGKVWRIGLMGQSATPKHVITCLTALEGVLGDKVKAGAGPAAASRLLFG

SEQ ID NO: 23749 - protein, 335 aa, Shewanella oneidensis MR-1
MKYLVTGAAGFIGANVSKRLCAMGHEVVGIDNLNDYYDVALKLARLAPLEALSNFHFIKLDLADREGIAKLFAQQGFQRVIHLAAQAGVRYSLDNPLAYADSNLVGHLTILEGCRHHKIEHLVYASSSSVYGLNQKMPFSTEDSVDHPISLYAATKKANELMSHTYSHLYQLPTTGLRFFTVYGPWGRPDMALFKFTKAILAGETIDVYNHGDLSRDFTYIDDIVEGIIRVQDKPPSPTPDWRVETGTPANSSAPYRVFNIGNGSPVQLLDFITALERALGIEAKKQFLPMQPGDVHATWADTEDLFKAVGYKSQVDIDTGVAKFVDWYRNFYAQ

SEQ ID NO: 23750 - protein, 365 aa, Debaryomyces hansenii CBS767
MFRQITRQSAISPRFTRSYIAGQFTGSKKSNGKYTVTLIEGDGIGPEISQSVKDIYAAAKVPIEFESVDVTPLLIDGKTTLPQPAVDSVNKNLVALKGPLATPVGKGHTSMNLTLRRTFNLFANVRPCKSVVGYDTPYENVDTVLIRENTEGEYSGIEHTIVPGVVQSIKLITKPASEKVIRYAFEYAKSINKPHVLVVHKASIMKLSDGLFVSTAKEIGKEYPDIKLDYELLDNTSLKLTADPADYKDVVMVMPNLYGDIMSDLSSGLIGGLGLTPSGNMGNKVSIFEAVHGSAPDIAGKGLANPTALLLSSCMMLRHMSLNSDADKIEKAVLDTIASGKENRTGDLYGTSSTQNFTEQVITRL

SEQ ID NO: 23751 - protein, 387 aa, Shewanella oneidensis MR-1
MNIVVVGMGYVGLSNAVLLAQQNQVTAIDLMPERVKLVNDRKSTVADNLIEEYLRNSALNLRATMDKNAVKDADFVIIATPTDYDPQTNYFNTQSVENVAKEVLSLNPDTTIIIKSTVPVGFTASLRTRLNSDNILFSPEFLREGQALYDNLHPSRIIVGERSARAQTFATLLVNAAIKQDIPILLTDSTEAEAIKLFANTFLAMRVAYFNELDTYAESRGLNTRQIIEGVCLDPRIGDYYNNPSFGYGGYCLPKDTKQLLANYNDVPNNLISAIVDSNTTRKDFIADAIISKQPKRVGIYRLIMKSESDNFRASAVQGVMKRIKAKGIEVVVYEPVLKESEFFKSTVIRNLEEFKAMCDVIVTNRMTSELEDVADKVYTRDLFHHD

SEQ ID NO: 23752 - protein, 380 aa, Debaryomyces hansenii CBS767
MSDSTTGKTIICKAAIAWEAGKPLTIEDIEVAPPKAHEVRIKILHTGVCHTDAYTLSGVDPEGAFPVVLGHEGAGIVESVGEGVDNVKVGDSVVALYTPECKECKFCKSGKTNLCGKIRSTQGKGVMPDGTSRFKCKGKELLHFMGCSTFSQYTVVADISVVAVNPKAQPDKTCLLGCGITTGYGAATITANVGEGDNIAVFGAGCVGLSVVQGALQRKAAKIIVVDINDSKKEWAEKFGATDFVNSAKLPSDTTIVDKLVEMTDGGCDFTFDCTGNVNVMRNALEACHKGWGTSVVIGVAAAGKEISTRPFQLVTGRVWKGAAFGGVKGRSQLPDIVENYMNGGLKVDEFITHRHELENINTAFDDMHAGDCIRAVINM

SEQ ID NO: 23753 - protein, 356 aa, Oryza sativa Japonica Group
MAGALLSPRAPPPAPAALTGAGDGEDVDFFFFPFLVLYKSGRVVRFIGTDTVPASMDPATGVASKDVVIDADAGLAVRLYLPNVANLTAGKRGGGDKLPVVVFYHGGGFVTESAFSPTYHRYLNALVSKARVVAVSVEYHLAPEHRLPRAYDDAWAALRWVLENAGAGPEPWLSRHGDTARLFLVGDSAGGNIAHNVAMRAGGEGGLHGGAAIRGVALLDPYFWGKRPVPSETADPATRRWRERTWGFVCAGRYEVDDPVIDPVAMARGEWRRLGRARVLVTVASLDTLSARGRAYVAAARASGWGGEAVLYETPGENHVYFLVEPDGEKAAKEMDAVVAFINEGEQVITASRMDA

SEQ ID NO: 23754 - protein, 404 aa, Silicibacter sp. TM1040
MRDSVKLSSGRSYLAIPGPSVMPDQVLQAMHRASPNIYAGELVEMTGTLPADLRRVARTQHHVAIYIANGHGAWEAALSNTLQEGDKVLVPASGRFAYGWSEMAEALGINVEVMDFGLQAPFDLARVAERLAADKAYEIKAVLGVHTDTSTSIRNDINGLRAAMDEVGHPALLMADCIASLGCDRFEMDAWGVDVMVTGCQKGLMVPAGMSFVFFNDKAAEARARLPRISRYWDWVPRANPEYFYQFFGGTAPTHHLYGLRAALDLIHAEGIEQIWTRHETLARAIWAACDRWSEGGALAMNVADPALRSHAVTALRLPSPRATDLRVWLEENLGLTLGIGLGMAPPDSAEWHGFFRLGHMGHVNGHMIMGLLGGIETGLRALDIPHGAGALESAAKVLAGAPS

SEQ ID NO: 23755 - protein, 478 aa, Glycine max
  misc_feature (325)..(325): Xaa can be any naturally occurring amino acid
MVKICGIGAGYVGGPTMAVIALKCPSIEVAVVDISHSRISAWNSNKLPIYEPGLEQVVNQCRGKNLLFSTNVEKHVHEADIIFVSVNTPTKIRGLGAGKAADLTYWESAARMIADVSRCNKVVVEKSTVPVRTAEAIEKILCHNTNSKGIKYQILSNPEFLSEGTAIQDLLNPDRVLIGGNQCPEGLQAIQKLKAIYAHWVPEDRIITTNLWSAELSKLADNAFLAQRISSINAMSALCEATGAEVSQVSHALSKNTKIGPKFLNASVGFGGSCFQKDILNLVYICESNGLTEVANYWKQVIKVNDYQKSRSVRRVVTSMFNTVXGKRIAILGFAFKKDTSDTRKTPAIDVCKGLLGDNACLTIYDPCVTEEQIQKDLSMDGVELDQHAMSSTMVKPVSVVGDAYEATKEAHGICILTEWDEFKNIDYQRVYDNMHKPAFVFDGRNILNVDKLREIGFIVYSIGRPLEQWLKNMPQQA

SEQ ID NO: 23756 - protein, 248 aa, Bacteroides thetaiotaomicron VPI-5482
MGLLDGKTAIVTGAARGIGKAIALKFAAEGANIAFTDLVIDENAEKTRVELEAMGVKAKGYASNAANFEDTAKVVEEIHKDFGRIDILVNNAGITRDGLMMRMSEQQWDMVINVNLKSAFNFIHACTPVMMRQKAGSIINMASVVGVHGNAGQANYAASKAGMIALAKSIAQELGSRGIRANAIAPGFILTDMTAALSDEVRAEWAKKIPLRRGGTPEDVANIATFLASDMSSYVSGQVIQVDGGMNM

SEQ ID NO: 23757 - protein, 387 aa, Saccharophagus degradans 2-40
MTSGHLLNVALRPAILVLADGSVFRGTAIGADGDSVGEVVFNTAMTGYQEILTDPSYAKQIVTLTYPHIGNTGTTSEDDECSNVWASGLVIRDMTMVSSNFRSEQTLEDFLKSKNIVGIADIDTRRLTRILRDKGAQSGCIMAGEVDEDIALAKAKAFAGLQGMDLAKVVSTEKAYPWTAGSWQLGKGFGGLPEGDRFKVVAYDFGAKANILRMLVDRGCELTVVPAQTPAADVLAMNPDGVFLSNGPGDPEPCDYAIEAIKTLLDKNIPLFGICLGHQLLALASGAKTVKMKFGHHGANHPVQDLKTGKVMITSQNHGFAADEASLPSNIVATHKSLFDGSLQGIERTDKRAFSFQGHPEASPGPHDAAELFDHFIDLMNEAKSEM

SEQ ID NO: 23758 - protein, 601 aa, Caulobacter vibrioides
MTAHQTIESQAPADTADRAMTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 23759 - protein, 374 aa, Saccharophagus degradans 2-40
MSKRDYYEVLGVSKDVSPQELKKAYRKVAMKYHPDRNSDDPNSEDKFKEASEAYEVLSDAQKRAAYDQYGHAGVDGNAGMGGGAGAGNFSDIFGDVFGDIFGGGGGRRRGGPSRGSDLRYTLDLSLEDAVKGTTVKIRVPTLVSCKPCGGSGAKPGTSPQTCTTCGGHGQVRMQQGFFSVQQTCPNCRGQGKMITDPCKECHGHGRVEETKTLSVKVPPGVDTGDRIRLAGEGEAGADGGPAGDLYVQVDVQDHAFFQREGRNLYCEVPISLFDACLGGELEVPTLDGRVKLKIPAETQTGKLFRLRGKGVTPVRGGAAGDLMCRVIIETPVNLTKKQKELLEELKASMKGEKNSPKQESWFEGMKNFFGDLKM

SEQ ID NO: 23760 - protein, 716 aa, Coccidioides immitis RS
MAAFDPISRVPKKIRILSLRRKSMDPGCYPTAKLGIGRAMALVFRDDPGRGFCTRFLFRPSVFTQQTERPSDRDQRPRGTQRCTTFLPQGTGSLSLFNTRHPARKAERLFLSPFLGMLRSLLIMISPAVLALCVGFYIFSTFADLSCATPIRRHSSYPWLNQGSGRPDSGQEVDAWARQDDRLGAVASESSICSGFGIDMLKLGGNAADAMVATVFCVGVVGMYHSGIGGGGFMLIRSPDDTYEFVDFRETAPAAAFQDMYNNNTDASIFGGLASGVPGEVRGLEYLHKKHGLLPWRLVMQPAIHTARYGFPVTEDLVRYMREATEGKEDFLTNNPTWALDFAPNGTRLGLGDTITRKRYANTLETIANYGADAFYSSAIAETMIQALQAQNGTMTLEDLKNYTVDIKETAQIDYRGFKVTSTSAPSSGAILLSTLNILEGYDDFFAQGTTDLSTHRLDEAIRFAYGQRTHMGDPRFVEGLGEFQQDILNKSVSAQIRGKILDERTQNISAYEPSGFEILETSPGTSHISSADRNGLAISLTTTVNLYFGSKVMVPETGIIMNNEMNDFSIPGSDNAFGYRPSPANYIRPGKRPLSSICPTIVTHPNGTMYFVTGAAGGSRIITSTLQSVINVLDRHMTAPQALAEPRLHDQLVPNLTEVEWSFDNSTVAFLIDRGHNITRVEHASSTVQSIRVLSNGTFEAAGEPRQLNSGGLAI

SEQ ID NO: 23761 - protein, 347 aa, Bacillus subtilis subsp. subtilis str. 168
MQSGKMKALMKKDGAFGAVLTEVPIPEIDKHEVLIKVKAASICGTDVHIYNWDQWARQRIKTPYVFGHEFSGIVEGVGENVSSVKVGEYVSAETHIVCGECVPCLTGKSHVCTNTAIIGVDTAGCFAEYVKVPADNIWRNPADMDPSIASIQEPLGNAVHTVLESQPAGGTTAVIGCGPIGLMAVAVAKAAGASQVIAIDKNEYRLRLAKQMGATCTVSIEKEDPLKIVSALTSGEGADLVCEMSGHPSAIAQGLAMAANGGRFHILSLPEHPVTIDLTNKVVFKGLTIQGITGRKMFSTWRQVSQLISSNMIDLAPVITHQFPLEEFEKGFELMRSGQCGKVILIP

SEQ ID NO: 23762 - protein, 222 aa, Staphylococcus epidermidis ATCC 12228
MDVKENLAKIEKEIDASIKKSAHSAQPHVIAVTKYVTIERAREAYKVGIRHFGENRLDGFKEKKESLPSDVKLHFIGSLQSRKVKDIINEVDYFHALDRLSLAKEINKRANHVIKCFLQVNVSGEESKHGIALEEVNQFINQIKEYENIQIIGLMTMAPLTDDLSYIRNLFKELRHKRNEIQQFNLAHAPCTELSMGMSNDYQMAVEEGATFVRIGTKLVGE

SEQ ID NO: 23763 - protein, 173 aa, Sulfitobacter sp. EE-36
MTLYALADITPQVHADAWVAPDANVIGNVTLEADASVWFGCTLRGDNELILVGKGSNVQENCVFHTDPGCPLTVGENCTIGHKVMLHGCTIGDNSLVGMGATILNGAKIGKNCLIGAGALITENKVIPDGSLVMGAPGKVVRELDAVAIAGLTASAKHYQDNARRFASQLKPV

SEQ ID NO: 23764 - protein, 311 aa, Physcomitrella patens subsp. patens
MGEMDAGFAKLQGEDFEYYMQTYSIVLGRNSKKSSVDVDLAALGGGMNISRQHAKILYDFDRQRFVLEVLGKNGCYVEGVLHFPGTSPVKLDSQDLLQIGEKRFYFLLPAKKIARSVAAVPSPIVRRKRAAVGAGGAPSASLVLSSAPTPAPTPARKPRGQGKNGQAGGDARERKQAVVAPWMGSTTRAAREGYRHDEDEADVVHEQFEEKEVAKAVLEKLQSQYHPGEWMAVSKLHADIVDFFQSRQMSPQLMHVLGMDEYRQELDGKGNGKAWSGLVNLLKKYPRHFVINTKLKGGIRVEYVSLYPEEQ

SEQ ID NO: 23765 - protein, 374 aa, Pseudomonas putida GB-1
MSKRDYYEVLGVERGASEADLKKAYRRLAMKYHPDRNPGDKESEDKFKEANEAYEVLSDASKRAAFDQYGHAGVDPSMGGGGAGFGGANFSDIFGDVFSDFFGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 23766 - protein, 464 aa, Bacillus halodurans C-125
MDRKETAKLMENVMTELSEKEGFLGIEDDEKRKRIVLSAQEILTTTDKIIKSYIRVSTEHGIMRIPAYRVQHNNISGFYKGGIRFSEFVSEEEVENLAILMTLKNALHRLPFGGAKGGVHVDPRKYSEKELNLISKKYVQRFARDLGPNHDIPAPDLGTNEQVIDWMVGEFKTIHPGQAYLGSFTGKSVENGGARGRREATGKGTFLSYIWLLSQWYDEHVSGNGINRTKQWETISNLKQQADNSDPIRVAVQGFGNVGSVAALEAYQCSEIAHRVVAVSDRYTTLYNEKGLDVRALAAYTIGGKDLPKNSEELAAAGVEASVLPVDAVLTCETDVLILAAIENQIHERNMKQVNARVLVEGANAPISTEADDYFEAAGTVVIPDILANAGGVIVSYLEWKQSRITELYSEDDILDEMGTQMKETLKSVYERYFSSVGHTLRFTCFTLALERLTSLLYKHGKLY

SEQ ID NO: 23767 - protein, 304 aa, Zea mays
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKTPDFATIINSVTAKKVAA

SEQ ID NO: 23768 - protein, 348 aa, Triticum aestivum
  misc_feature (130)..(130): Xaa can be any naturally occurring amino acid
MHPTRWELSHMVDLQAARLVISVVAAAAVSSPAAVPSTGKGAKQLPKDFLHINDFDKDTIMKILNRAIEVKAMIKSGDRSFQPFKGKSMAMIFAKPSMRTHVSFETGFFLLGGHAVYLAPRPIQMGKREXTRDVARVLSGYNDIIMARVFAHQDILDLAKYAPVPVINGLTDYNHPCQIMADALTMLEHVGRIENTKVVYVGDGNNIVHSWLLLAAVIPFHFVCACPKGFEPDAKTVEIARSGGSKIEITNDPKEAVKGADVVYTDVWASMGQKEEAEYRKKVFQGFMVDEALMEMAGPKAFLMHCLPAERGVEVTDGAIEAPNSIVFPQAENRMHAQNAIMLHVLGA

SEQ ID NO: 23769 - protein, 386 aa, Pseudomonas putida GB-1
MLDLREVFLTKPAILALADGSIFRGEAIGADGQTVGEVVFNTAMTGYQEILTDPSYAQQIVTLTYPHIGNTGTTPEDAESNRVWSAGLVIRDLPLLASNWRNTQSLPEYLKANNVVAIAGIDTRRLTRILREKGAQNGCILAGDNISEEAAIAAARGFPGLKGMDLAKVVSTKERYEWRSSVWELKTDSHPTIDAADLPYHVVAFDYGVKLNILRMLVARGCRVTVVPAQTPASEVLALNPDGVFLSNGPGDPEPCDYAIQAIKEILETEIPVFGICLGHQLLALASGAKTVKMGHGHHGANHPVQDLDTGVVMITSQNHGFAVDEATLPGNVRAIHKSLFDGTLQGIERTDKSAFSFQGHPEASPGPTDVAPLFDRFTDAMAKRR

SEQ ID NO: 23770 - protein, 285 aa, Populus trichocarpa
MGKDIEVGGEFSAKDYHDPPPAPLIDAEEITQWSFYRAIIAEFVATLLFLYITVLTVIGYKSQTDVNKNGDECGGVGILGIAWAFGGMIFILVYCTAGISGGHINPAVTFGLFLARKVSLVRAILYMVAQCLGAICGCGLVKAFQKSYYTNYGGGANGLANGYSKGTGLGAEIIGTFVLVYTVFSATDPKRNARDSHVPVLAPLPIGFAVFMVHLATIPITGTGINPARSFGAAVIFNKEKAWDDHWIFWVGPFIGAAIAALYHQFILRAAAVKSLGSFRSSPNI

SEQ ID NO: 23771 - protein, 629 aa, Coprinopsis cinerea okayama7#130
MSYGDEKAPVRDVEAGSAPSITSTEIAAHVGVRNIEATHKVFGKYSKWCLFISLGLAAYIYSLDGTTTYNYLAFAASYLGGHSLISTIQVAQAIIVAVGKPVIAKIADVKSRPIAYVLVLIFYIVGYIVIASAKNVGTIAGGIVIYAIGYTGLQLLTQIIIADITVLKWRGLVSSLMSLPFIINAFVGSNISTAVLEGSAGWRWGYGMFAILVPATLSPLIVTLIWAERKAKKQGLIKDDGEKKPVLQSMLDTANKLDVVGLFLLGACVALILLPMTLSRVLGKGWQSPSMIATICVGGALIPVYLIWEAKFTKYPVIPRRFLLNKTVVIACLIGALDFVSFYISYAYLYSFVIVVKPWSLKNATYFIQCQTVTLTVFGIVGGALMRYLRRYKPILIGGLAIRLLGTGLMIHSRGANASDAEIVWSQILQGMGGGMAAVSSQVAAQASVPHIDTASVTAIVLLITEIGGAVGNAIAGAVWTSLMPDQLAKHLPMLDQATRDQLFGSIVAVSAEPRGHPIREAVILAYDNVMLKLCIAACVFAVPPLLLSLLMPNWYLGDFQNAVEQTDLAGSVVGGDESSERGVGEKGDGSSEKGGVGEKGDGSSERGVVAQQVGQGQTQPGSNAVAAQ

SEQ ID NO: 23772 - protein, 358 aa, Populus trichocarpa
MSCFKNKYADELVKNAAYIGTPGKGILAADESTGTIGKRLSSINVENVEENRRALRELLFCTPGALQHLSGVIFYEETLYQKTASGKPFVDVLKKGGVLPGIKVDKGTVELPGTNGETTTQGLDGLGQRCAKYYEAGARFAKWRAVLKIGLTEPSELAIHENAYGLARYAAICQENGLVPIVEPEILIDGSHSIEKCAAVTERVLAACYKALNDHHVMLEGTLLKPNMVTPGSDAPKVANEVIAKFTVRALQRTVPAAVPAIVFLSGGQSEEEATRNLNAINKLKTKKPWSLSFSFGRALQQSTLKAWAGKTENVEKARAAFLCRCKANSEATLGTYQGDAAPGEGASESLHVKDYKY

SEQ ID NO: 23773 - protein, 506 aa, Frankia sp. CcI3
MTYVPPGKPGSIVHVTDRYENFIGGKWLPPRAGKYSTNLSPATAQPICEIPRSAAEDVEDALDAAHAAAGSWAAASPAERAEVLTAVADAIDANREMLAVTESWENGKPVRETLAADIPLAADHFRYFAAAARTLEGSISEIDGRTYAYHFHEPLGVVGQIIPFNFPLLMAAWKLAPALAAGNCSVIKPASPTPWSILKLAEVIQDVIPPGIINIVNGPGAEVGRALATSPKIAKIGFTGETTTGRLMMQYAARNIIPVTLELGGKSPNIFFEDVLAADDAYLNKAVEGLVLYAFNKGEVCTCPSRALIQESIYDEFMARALERVGRIQQGNPLDPATMLGPQVSAQQLSKIGSYVDIGLAEGAELLAGGHRTRLAGEFANGYFFEPTLLKGHNKMRVFQEEIFGPVLAVTTFKDEAEALAIANDTPYGLGAGVWTRDGARQFRMGRGIKAGRVWVNCYHQYPAGAAFGGYKVSGIGRENHRMMLEHYSQTKNMLVSYDENALGLF

SEQ ID NO: 23774 - protein, 336 aa, Frankia sp. CcI3
MKAAVVTDFRAPLRIEDRDVPVPGPGQILVRMEASGLCHTDIHAAHGDWPVKPTPPFVPGHEGVGVVKAVGAGVTGRAIGDRVAIPWLGHACGRCRYCVGGWETLCESQRNSGYSIDGAFAEYAVADADYTVPVPGDVPSFDAAPLTCAGVTTYKAIKVAGVTPAETVAVFGIGGLGHLALQYARIAGGFTVGVDVTEAKLELATELGADHVVNARTADPVEAIQRLGGADVAVALAASPRSFEQAFASLRRGGRLVCVALPADGTMSIPIFDTVLKGITVKGSIVGTRNDLAEVFRLHAAGRTRVIASGRKLDDVNACMDEVLDSRVPARLVFEF

SEQ ID NO: 23775 - protein, 159 aa, Triticum aestivum
MQFLRGVGGGGGGGAGGAGSMAWEVLRRHFSRKRAVDIRRINPKVPKEEAVAISGRLLQILADHGPLTVGSTWNHAKDAAIDGLNSKTHMKILLKWMWGRRIIKLSCTQAGNTKKFLYSPFTAEDTEAAEEPAEEQPKRKGWKGKHPKYQTKKQPATAA

SEQ ID NO: 23776 - protein, 496 aa, Nostoc punctiforme PCC 73102
MKRPGFIERHHLWTEIQKEASEKIKTIVKEQDLLLIRTAWSDQHGIVRSKSLLPQAFFSALENGMQISTGTFLLDTGGAIVFNPFVPGGSLDMPLMTGAPNLVAVPDPDTFKIVPWAKRTGFILCDEYFQNGQPMPFSSRGILRQSLIDLHQRGLEHIVGLEVEWYLAKLEDPMLAIANVGSSGKPGEPAKVSAVDHSFQYLLESHNPEIQDLLGLLAENLVEMKLPLRSVENEGGVGQFEFTFDPIPALQAADTMMIFRMATKQICRQQGYIASFMCRPGLQGSSSNGWHLHQSLVDLTTGENAFMSANSQTLTSDLAKHFVGGLLKHANAASVFTTPTINGYKRFRPYSLAPDRAGWGLENRGAMIRLQGGFDDPSTHIENRVGEPAANPYLYMASQLISGLDGVDCKLDPGSPTEEPYTTENPILPKSLSEAISYLSQSELFPQKMGQQFINFIIKMKESEINRFLQSVADQPPEEYLKQVTNWEQREYFELF

SEQ ID NO: 23777 - protein, 421 aa, Pseudomonas fluorescens PfO-1
MLELVAAFICLTTLLTFVNFRFIGLPPTIGVMVTALMFSLLLQGLSLLGYPGLEERVQQLIGQIDFGDLLMNWMLSFLLFAGALHVNLNDLRSYRWPIGLLATFGVLIATAVIGSLAYYIFALFGWHVSFLYCLLFGALISPTDPIAVLGVLRTANASKPLKTTIVGESLFNDGTAVVVFTVLLGIAQLGETPTVGATAMLFAHEAIGGVLFGGLIGYLVYLMIKSIEQHQIEVMLTLALVIGGSAMATELHVSAPIAMVVAGLIIGNLGRNLAMNDMTRKYLDGFWELLDDMLNALLFALIGMELLLLPFNWLHVAAASLLALAILLSRLLTVAPAIVLLRRWRTVPRGTIRILTWGGLRGGVSVALALALPLGPERDLLLSITYIVVLSSILLQGLTIGKLVKHATRDEPASAAEPAHH

SEQ ID NO: 23778 - protein, 286 aa, Nostoc punctiforme PCC 73102
MASVMLATVDPGDEVIVFEPYYENYGPDAILAGATPRYVTLHPPHWTFDEAQLHQAFNANTKAIIINTPHNPTGKVFTREELTLIAELCQKWDVLAFTDEIYEHILYDGTQHIALATLPGMEERTITINGLSKTYSVTGWRVGYILANPALTGAIRKVHDFLTVGAPAPLQRAGVTAMQLPPSYYEELGKLYHQKRDSILQILDGVGIPYFLPQGAYYVLADISKFGYKTDIEFTYHLIKNIGVAVVPGSSFFSQPEKGHSLIRFCFSKTPETLQAASDRLLKLSK

SEQ ID NO: 23779 - protein, 209 aa, Ostreococcus tauri
MVFALSRAVSVTDARKVDRARTPRTTFDRVAAASALAFALSTAQPAFADSGDKIRLPPIDTDPNRCERAFVGNTIGQANAVSDKVLDLRKCEYKSGADMSGKTLSGALMVNTNAKGANMRETVMSKVYAPDADFSGVDFTNAVIDRATFDGSDMIGTNFTNAVITGVSFEGANLKDATFEDALVGKEDVKRLCLNPTVQDETRMQLGCR

SEQ ID NO: 23780 - protein, 286 aa, Frankia sp. CcI3
MTARQRIAFQGERGANSHIACRDVYPDYDAVPYQTFDECFSALEEGEVDLAMIPVENSTAGRVADIHHLLPRPGVHIIGEYFLPIRHQLLGLPGVTLDEVKTVHSHPQALAQCREALRTLGLTAVAHADTAGAAREIAEAGDPARAAIASRLAAEAYGLQILQADLEDAEHNTTRFLILSGENLRAAAGVGPIVTTFFFKVHNRPAALYKALGGFATNGVNMTRLESYMVGGGFVATQFLADIEGSPEEPAVARAFEELSFYADHRILGVYRASRYRERISTGSGA

SEQ ID NO: 23781 - protein, 388 aa, Photobacterium sp. SKA34
MKITVVGTGYVGLSNAVLLSQHNEVVALDIIEEKVALINQGLSPIVDTEIEAFLQQKALNLVATTDASHAYDSAEFVIIATPTDYDPITNYFNTSSVEAVIKDVAKKNPSATMVIKSTVPVGYTESIKKQFGITNIMFSPEFLREGRALYDNLYPSRIIVGERSERAEIFAGLLKQGAEKQDIAVLFTDSTEAEAVKLFSNTYLAMRVAYFNELDSYAEALGLDSRQIIEGVGLDPRIGNHYNNPSFGYGGYCLPKDTKQLRANYRDVPNNIIGAIVDANTTRKDFIADSILAKQPKVVGVYRLIMKSGSDNFRASSIQGIMKRIKAKGIEVVLFEPVLEEDEFFNSKVIKDLEEFKAMSDVIVSNRMAVELQDVQEKVYTRDLFGAD

SEQ ID NO: 23782 - protein, 372 aa, Arabidopsis thaliana
MMMSDLSLDLVEEILSRVPATSLKRLRSTCKLWNALFKNPGFTKKQFLKAPKESLVLMLKEYSVCPMIANLSVSAPSIEFKGALNLKNYPPYSEEVDIHEACHCDGLLLCTTMDYRIVVWNPCLGETRWIRWPKNIYSRFALGYEKNKYGRIYKILRCWDRHNSPTGRVDEFEIYEFSSDSWRVLDLVALDCHIASHIGVSFKGNTYWLASDKKDKYGLLLCFDFTTERFTRLCLPPSQDVSKMALSVVGGKQLSLLSQSDSTSKIMEMWVTNIIEDVLMWSKSFTVDIPIRGDYCPYLTSYLVDEEKKVAVCYNENFEKSNKKVYIIGEDNGYYTEIPLVESSYQVWGYPIIFNYVPSLVQIEEGGCIIKE

SEQ ID NO: 23783 - protein, 515 aa, Thermotoga maritima MSB8
MSLRDKIEELKKIEKEIEQGGGPEKVEKQHRAGKLTAWERLELLLDPGTFVEIDKFVEHRNTYFGLDKVKLPRDGVITGVGEINGRKVAVFSQDFTVMGGSLGEMHAKKIVKLLDLALKMGIPVIGINDSGGARIQEGVDALAGYGEIFLRNTLASGVVPQITVIAGPCAGGAVYSPALTDFIVMVDQTARMFITGPNVIKAVTGEEISQEDLGGAMVHNQKSGNAHFLADNDEKAMSLVRTLLSYLPSNNAEEPPVEDPDTSLETPEDILDILPDNPNKGYDVRDVIKRVVDHGEFFEVQPYFAKNIVIGFARIQGKTVGIVANQPSVLAGVLDIDSSDKAARFIRFLDAFNIPILTFVDTPGYLPGVAQEHGGIIRHGAKLLYAYSEATVPKITVILRKAYGGAYIAMGSKHLGADMVLAWPSAEIAVMGPEGAANIIFKREIEASSNPEETRRKLIEEYKQQFANPYIAASRGYVDMVIDPRETRKYIMRALEVCETKVEYRPKKKHGNIPL

SEQ ID NO: 23784 - protein, 352 aa, Methanosarcina barkeri str. Fusaro
MKGFAMLEIGKVGWIDTERPSAGPYDAIVRPIAVAPCTSDVHTVWEGALGNRKNMILGHEAVGVIEETGSEVKDFKPGDKVIVPAITPDWRSIEAQDGMPMHSNGMLSGWKFSNFKSGVFAEFFHVNDADMNLALLPKGMPLEQAVMLSDMATTGIQGAEMAKIKMGSTVAVIGIGPVGLMAVAGATILGAGRLIAVGSRKVCVDLALEYGASEIVDYRKGGLVEQILEKTNGKGVDSVIIAGGNENTISDAVKIVKPGGTVSNVNYYGTGDILPIPRIEWGSGMSQKDIRGGLTTGGRLRMERMADLCTYGRIKPEKMATHVFKGFDKMEEALMLMKEKPRDLIKPVVLLD

SEQ ID NO: 23785 - protein, 101 aa, Glycine max
FLIVAVYSSLLHFASRRFVLQFNIASPTTGCQKKLEIDDDLKLRAFWDKRISQEVSGDALGEEFKGYVFKITGGCDKQGFPMKQGVLTPGRVRLLLHRGMM

SEQ ID NO: 23786 - protein, 219 aa, Oryza sativa Japonica Group
MARFEVYENNGGTCVAVAGADYCVVAADTRLSVGYSILSRDSSKIAHLADKCVLASSGFQGDVKALQRNLTAKELLYEHNHNKKMSCPAMAQLLSNTLYYKRFFPYYAFNVLGGLDSEGKGCVFTYDAVGSYERTGYSAQGTGAALMMPVLDNQLKSPSPLLLPARDAVTPLSQSDAVDLVKDVFASATERDIYTGDKLEIVVINSAGSHREFIELRKD

SEQ ID NO: 23787 - protein, 301 aa, Fusobacterium nucleatum subsp. nucleatum ATCC 25586
MSLKEAFMKKVTKAVIPAAGLGTRVLPATKALPKEMLTIVDKPSLQYIVEELVDSGITDIVIITGRNKNSIEDHFDFSYELENTLKNDNKLDLLEKVSHISNIANIYYVRQSMPLGLGHAVLKAKSFIGDEPFVIALGDDIIYNPEKPVTKQMIEKYELYGKSIIGCQEVAKEDVSKYGIAKLGHKVDETTYQMLDFLEKPSVNEAPSRTACLGRYLLSGKVFKYLEETKPGKNGEIQLTDGILAMMRDNEEVLAYNFIGKRYDIGSKFGLLRANIEFGLRNEETKEEVKEYLKKLDIEKI

SEQ ID NO: 23788 - protein, 846 aa, Oryza sativa Japonica Group
MASSSPLCCYLLLFVVVVVLTGSCRARDTVVPGRPLAANETLVSGGDANFVLGFFTPPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKGKLEDGQEIAVKTLSKTSVQGLDEFKNEVMLIAKLQHRNLVRLLGFSISGQERILVYEYMANKSLDYFLFEKSNSVLLDWQARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 23789 - protein, 396 aa, Debaryomyces hansenii CBS767
MTNQKPAEPSNIEEDANYQIDIQEDKEHPIFKIKYRSNSVISIGALSDGSSYENLPTVKVLGTGGTIASKGTSSHQTAGYEVDLTIEDLIKSIPDLSTTCNLQYEQVLNLDSKDIGTHELLMLYQKIQEDLPKYDGIVITHGTDTMEETSFFLQSTLRTSKPIVMCGSMRPSTAISSDGPMNLYQAIVIAAHKDSRGRGVLVALNDRIGAGFYITKSNANSLDTFKSIGQGYVGSFVNNEVHYFFPAARPLGITYFKLSNPSALADLPEVPIIFAHQGLNNKIIEVTIKELGAKGLVFATMGAGSMSKGTNEFACKFSKEHNNIPIIYSKRSMDGMVPVGSLPKISNDKGETIEYKNAIASGYLNPQKSRILLQLCLSDGMEINEIKRVFKGVYGG

SEQ ID NO: 23790 - protein, 256 aa, Oryza sativa Japonica Group
MARNLATVAPIKISSSRLASLQRLPHHFLNSLRTKKSLAKKDVMGINKWRFEKLKEHIQGDIDAENEAYERYTQNVGLLEETFGLTEDAADEPEPEATSSEERMETLVSEAKVRLKSDSANADGFRDRIATILDQKIKELLESKSTYEDDNPPDQNPDDHPKPVKLSIKQQMERGAKMTELLAKMIRAQSEVDLKICSGIAAQLFGKKNELSNQESVASVTIPYSFPKLWTRVEIDDAMMCKINGEFSSSTERQKP

SEQ ID NO: 23791 - protein, 590 aa, Mycobacterium smegmatis str. MC2 155
MMPFTTRPTLTGWHGMAASTHWLASGTAQAVLERGGNAFDAAAAAGFVLHVAEPHLNGPGGDMVALVSTATTSEPVVLVGQGPAPEGATIAAFRERGLTHVPGAGALAAAVPAAVETWFHLLERYGTWRLSDVLGYAAEYAERGIECSEQLSAVLATMARHFTAHWPTSRDVWLPDGTPPAPGDLVRNPAYAAVLRRLSEAGATGTRVAGIDRARRMWRNEIASAIVEFTSRPHRHSGGGDHAGVLTTSDFQNLRIGSEASLRLRFRGVDVVKAGFWSSGPVLLQALGILDQAAASRSIDPDTAAGAHTIVETVKLAMADREAYYGDARPDQGVLGQLLSVEYCAERAGAITDHAATVVDPGVLPGIRPYRSRTTVTPHDELGTGEPTVSRTGETRGDTCHLDVVDRFGNMISATPSGGWLQSSPAVPGLGFCLGTRLQMTWLDEDSPSALKPGTRPRTTLSPTMVLEAGVPVTSLGTPGGDQQDQWQLLYLLRTIVTGMTPQQAIDAPMYHTTAFPGSFVPRTASERGVVVEDRAGTEVIDGLRGRGHDVTVTDGWSLGRLSMVGRDRVTGRLCAAANPRGGTGYAVGR

SEQ ID NO: 23792 - protein, 480 aa, Mycobacterium smegmatis str. MC2 155
MTITETLQRRLFIDGEFVGSDGDTLPVTDKASGAVIGESVVATDRDVDRAVAGAVAAQREWYATPATERAAILRRGGAILERETGRFQDILIREGGAVGPKAHGEIGASVIEFFQAAELATTPLGEIIPSGQRGRVNIVERRPVGVVGLITAWNAPVHIAMRVLAPALALGNAVVLKPAPETPFTGGLMLAEVLAEAGLPSGVVQVLTGGPAGAALVTHPQVDMIHFTGSEDTGRRINVAAAPLLKRVALELGGNNASIVLADADVALAARCGAGSSFGHQGQVCIATGRHIVLADVAHEYIAALSAEAAKLTVGDPYTSQVDLGPMVSTRQVDKALAMVASSVDLGARVVQGGTADSVFLRPTVVDRVRPGMPLHDEEVFAPIAPVTVVDSVDEALKIVNGTRFGLSTSVFSRDLDRAWSVADQVRSGMVHVNDGTALHESQVPFGGTAASGLGDDLGGRANIDLLTERRWTSLQRNTL

SEQ ID NO: 23793 - protein, 799 aa, Bacillus halodurans C-125
MMMRTFRTFVSFTLILLLTLTSYIPVSQANGESPSLAPMVGEIDTSSSALETVIVEIEDPSIIEAKHQGQKQSKNELKQARQSVIEQIQDLVPSSTVTHEYDFLFSGFALELPAHQIPSILGIDGVHAVYPNIEYEVETDFDEVVIEKDAYSPEMLDSAPFIGANDAWEAGYTGEGITVAILDTGVDYTHPDLVHAFGDYKGWDFIDNNDDPQETPPGDPRGIETTHGTHVAGTVAANGLIKGVAPDANLLAYRVLGPGGRGSTAGVIAGIERAVQDGADIMNLSLGNTLNDPDFATSIALDWAMAEGVVAVTSNGNSGPNNWTVGSPGTSRDAISVGATRLPYNKYKASVFTSDGIDYPSADIMGFPSDEELLELDGETYEYAFAGLGKPGDFEGVDVEGKIALIVRGEIPFVEKAENAKAAGAVGAIIYNNVAGVQPTVPGLAIPTIMLSNEDGLKMRNELENGQNTVTFSIEFDKLVGETVADFSSRGPVMHTWMIKPDVSAPGVAIVSTIPTHQPDDPYGYGSRQGTSMASPHVAGAAALLLEAHPNWGVDHVKAALMNTAENLVDENGNRYPHNTQGAGSIRIVDAIESETLVTPGSHSFGTFTKERGKQVERQHFTIHNLSNKRKTYQFDVQFAGNPDGIKVKTSKNLRVQPGKTQKINFNVQVDARKLDPGYYEGTIIVSDGSQTVEVPTILFVSEPDYPRVTTFDLDIDENGVLFGSAYLPNGAEEFGLWIYTRDTLEYVTSAAVVQNIGKGYHDVTWDTTELAPGRYYVFAYAERLGKTDFVLGDEIVVK

SEQ ID NO: 23794 - protein, 198 aa, Crocosphaera watsonii WH 8501
MILVIDNYDSFTYNLVQYLGELGFKWPVASDIQVYRNDKIDIPKIRHLNPDGIVISPGPGRPEDSGVSLALLQELGPTVPILGVCLGHQSMGQVFGGKVVSASILMHGKTSPIYHNDQGVFQGLDNPFEATRYHSLVVERETLPHVLEITAWTEDGTIMGLQHKDYPHLQGVQFHPESILTTSGKSLLENFLKVLNPQ

SEQ ID NO: 23795 - protein, 366 aa, Staphylococcus epidermidis ATCC 12228
MLEKRYLVLEDGSYYEGYRLGSDDLSIGEIVFNTAMTGYQETISDPSYTGQIITFTYPLIGNYGINRDDFESLTPKLNGVVVKEASTHPSNFRHQKTLHETLAQYHIPGISGVDTRSITRKIRNYGVLRAGFTDNKDNIQELVEQLKTAELPRDEVQTVSTKTPYVSTGSDLSVVLLDFGKKQNIVRELNLRGCNVTVVPYDTSAEEILGMSPDGVMLSNGPGDPDEVDVALDMIRGILGKIPFFGICLGHQLFALSQGATSFKMKFGHRGANHPVKDLRTGKIDITSQNHGYSIDCDSLKNTDLEVTHIALNDGTVEGLRHKELPAFSVQYHPEARPGPSDSNYLFDEFIAMMKDFKEKERQINA

SEQ ID NO: 23796 - protein, 362 aa, Oryza sativa Japonica Group
MAGARAIGSLPVPNVQELAKTCNGPDEHIPERYIRPEASSEEVISNYHGEAIPIIDLNKLLSPQSSEECVKLRSACQYWGFFQHYLWNKLQLINHGVPDEVIANLKRDIVDFFSQPLDAKKEYTQLPNSLEGYGQALVFSEDQKLDWADMLYLQVHPSDSRDLRFWPTSPASFRRSLDAYSSETKSLALCLFEFMAKAVGAKPEALLGIFEEQPRGLRMTYYPPCLQSDKVMGISPHSDVVGLTLLLQVNDVQGLQIKKDGKWLSVDAPNGAFIVNIGDTLEILSNGKFRSVEHRAVINPNKERISASLFHYPCENMVIRPLTEFVKDGKVNYRSISYLDFMTQFFTQQLDGKNRLEMLKLE

SEQ ID NO: 23797 - protein, 251 aa, Pseudomonas putida GB-1
MRRPMVAGNWKMHGTRASVAELTEGLSNLALPSGVEVAVFPPALFINQVIDGLAGKEITVGAQNSAVQPEQGALTGEVAPEQLVEAGCKLVLIGHSERRQVIGETDEVLNRKFAAAQAKGLKPVLCIGETLEEREAGKTLEVVGRQLSSIIEAFGVKAFANAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 23798 - protein, 68 aa, Triticum aestivum
MTTSRRLADRKTAKFQKNITRRGSVPETTVKKGNDYPVGPVVLGFFIFVVIGSSLFQIIRTATSGGMA

SEQ ID NO: 23799 - protein, 782 aa, Oryza sativa Japonica Group
MAPTLAFLLVLLLLLAGGGGGGAFLAAAASTDTVVPGKGMAGNQTLVSKNGRFELGFFTPGSGIHYFLGVRLRNMAEYSPTFWIGDRVGVIDLPGVSLEVFGDKLYIKEDGVSLWWSSVAGNGSSSSSDGGAVAVLLDTGDLVVRDQGNPSGVLWRSFDYPGDSLLPGGRLGLDAATGTNVSLTFKGFSHNGSLQVDASRRNGFVLTTDGIDSRGAFPDWMVTSQDNGSSLVLNHPDAPNSTEFLQFNLGLISLMRWSDSTAGWVARWTFPSDCKSGAFFCGDFGACTAGGGGGCECVDGFTPSYPDEWRLGYFVTGCSRSLPLSCEANGQTEHDDSFAILDNLRGLPYNAQDEPVTTDEDCRAACLNKCYCVAYSNESGCKLWYHNLYNLSSADKPPYSKIYVRLGSKLKSNRGLATRWIVLLVVGSLAVTSVMLGLVLLCRYRRDLFASSKFEVEGSLIVYTYAQIRKATGNFSDKLGEGGFGSVFRGTLPGSTTVVAVKNLKGVGQAEKQFRTEVQTVGMIRHTNLVRLLGFCVNGNRRLLVYEYMSNGSLDAHIFSEKSSLLSWHVRYQIALGIARGLAYLHEECEDCIIHCDIKPENILLDYEFCPKICDFGMAKLLGREFNSALTTVRGTMGYLAPEWIYGQPITKKADVYSFGIVLFEIISGRRSTETVKFGSHRYFPTYAAVQMNEGDVLCLLDSRLEGNANVKELDITCRVACWCIQDEENDRPSMGQVVRMLEGVVDMEMPPIPASFQNLMESEDSGIYSEESWNFRTRDQF

SEQ ID NO: 23800 - protein, 232 aa, Oenococcus oeni PSU-1
MEKNLQNELKKEAAIRAAEFVENDTVVGLGTGSTVKFLVDELGRKVREENLSFTGVTTSKRTASQAESLGIKIVSLDSIPRIDLTIDGADQVDNNFNGIKGGGAALLWEKIVATNSKKNIWIVDQSKLVDRIGSFPLPVEVIPFGALHVLNKFEELNLNPALRLTENGKKVMTDSQNYIIDLHLNQIIDPAKLSNQLINTVGVVEHGLFLNVVDKVVVGKKGQPLILENPDK

SEQ ID NO: 23801 - protein, 474 aa, Populus trichocarpa
MSVQEYLDKHVLSRKIEDAVNAAVRAKTPDPVLFISNHMRKAVPSVITKIKGRQILDSRGIPTVEVDLFTNKGSFRASVPSGHVTGMYEAVELRDGDKGMYLGNSVTRAVKNINEKISEALIGMDPTLQSQIDQAMIDLDKTEKKGELGANAMLAVSIAACKAGAAEKEVPLYKHISDLSSKTNPTLPVPAFTVISGGKHAGNNLAIKEIMILPIGASTFEEALQMGSETYHHLKAVIKEKYGEQGCNVGEDGGFSPNLSSVQEGLNLVKEAISRTGYSEKIKMAIDVAATTFCIGTKYDLDYKFQNKSGQNFKSGDDMIKMYEELCAAYPIVSIEDPFDREDWEHVKRFSDLGLCQVVGDDLLMSNHKRIERAIHESSCTALLLKVNQIGTVTEALEVVKLAKDAHWGVVVSHRSGETEDSFIADLSIGLAMGQIKTGAPCRGERLAKYNQLLRIEEELGDQAVYAGEDWRAT

SEQ ID NO: 23802 - protein, 567 aa, Nicotiana tabacum
MGSCFSSSKVSGSNSNTPSTTTTNVNVHHNRPSTTTTTTVTSRKQEGSNYNRDKGNINTKNSHQKQQPRSSQQNVVVKPSSRRQSGGVIPCGKRTDFGYDKDFDKRYTIGKLLGHGQFGYTYVATDRSSGDRVAVKKIEKNKMVLPIAVEDVKREVKILKALAGHENVVQFYNSFEDDNYVYIVMELCEGGELLDRILSKKDSRYTEKDAAIVVRQMLKVAAECHLHGLVHRDMKPENFLFKLFKGGFAIKSTDFGLSDFIRPGKKFQDIVGSAYYVAPEVLKRRSGPESDVWSIGVITYILLCGRRRFWDKTEDGIFKEVLRNKPDFRRKPWPNISNSAKDFVKKLLVKDPRARLTAAQALSHPWVREGGIASEIPLDISVLSNMRQFVRYSRLKQFALRALASTLDEEELSDLKDQFSAIDVDKNGVISLEEMRQALAKDLPWKMKESRVLEILQAIDSNTDGLVDFPEFVAATLHVHQLEEHNSTKWQQRSQAAFEKFDVDRDGFITPEELKMHTGLKGSIDPLLEEADIDKDGKISLSEFRRLLRTASMSSPTVRDSRRNVAL

SEQ ID NO: 23803 - protein, 340 aa, Oenococcus oeni PSU-1
MLDYLIDEVSKAFYLIFTNFILDKKEVDLVNKVIVLGSLNVDTILKIKRFPNPGETLETLDKSSAAGGKGANQAVAAVRSGAQTTMIGQIGHDDLGKFMIDSLQNDHINVSPITVNDTVGTGTATVLLDENGQNCILVYGGANQKISPEDIKKISDNIKNSDFLISQFETPQNATKAAFEIAKENSLTTILNPAPASKIDSSLLTLTDLIVPNETESTVLTGIKITDEKSMIETAKAFSKMGIDNLIITIGDRGVFYSTKEKSELVSAYHVKAVDTTAAGDTFIGALSSQLKKDLSNIKSAISFAQCASSITVQRLGAQPSIPTLNEIRIAEKNYESVKN

SEQ ID NO: 23804 - protein, 381 aa, Vitis vinifera
MSNTAGQVIKCKAAVSWEAGKPLVIEEVELAPPQANEVRIKILFTSLCHTDVYFWEAKGQKPAFPRIFGHEAAGVVESVGEGVTDLKPGDTVLPVFTGECKECRHCKSEESNMCDLLRINTDRTVMLSDGKSRFSAKGKPIYHFLGTSTFSEYTVAHVGSVAKINPAAPLDKVCVLSCGISTGLGAAINVAKPKKGSSVAVFGLGAVGLAAAEGARISGASRIIGVDLNASRFEQAKKFGVTEFVNPKDHDKPVQEVIAEMTDGGVDRSIECTGSVAAMISAFECVHDGWGVAVLVGVPNRDDSFKTHPINLLNERTLKGTFFGNFKPRTDLPRLVEKYVNKLDLQLEKFITHEVSFSDINKAFDYMLKGEGLRCIIRMGA

SEQ ID NO: 23805 - protein, 644 aa, Triticum aestivum
  misc_feature (37)..(37): Xaa can be any naturally occurring amino acid
  misc_feature (64)..(64): Xaa can be any naturally occurring amino acid
MAATAGAAAEIVREIAAVGAADLAAAPEPLRGDCLRXLGGRCGCLCGSPAEVARGGWGGQRGGXAPEAAAWVADLLWALQAARRFVALGRGPALDTGAADQDVNDKNIAVQFKYVTWQLQAALTNLPHSCFQISDEVQEEVDLVRGQLKREMEKKGALDLNIFSKIHDILAHHVDNVGSQSEEPHSQPETLSLENLSSDHLELQHVALLISEISGISKSDIKKITSELIEGLENTRVDDSAKPTNGDSKTSDEAKDSPDNVKKPDTVAMPEDFRCPISLELMRDPVIVSTGQTYERAFIQRWIDGGNRTCPKTQQKLQNLTLTPNYVLRSLILQWCEEKGIEPPTRSKYEGSSVEVGEDRLAIEALVRNLSCSSLDERKSAAAEIRSLAKKSTDNRMLLAESGAIPALVKLLSSKDPKTQEHAVTSLLNLSIYDQNKELIVVGGAIVPIIQVLRTGSMEARENAAAAIFSLSLIDDNKIMIGSTPGAIEALVELLKSGSSRGRKDAATALFNLCIYQANKVRAVRAGILSPLVQMLQDSSSAGATDEALTILSVLVSHHECKTAIAKAHTIPFLIDLLRSSQARNKENAAAILLALCKKDAQNLACIGRLGAQIPLTELSKTGSDRAKRKATSLLEHLSKLQVL

SEQ ID NO: 23806 - protein, 451 aa, Shewanella oneidensis MR-1
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLNLENGESVTVDCLIWAIGRSPATGNIGLENTEVQLDSKGYVITDAQQNTTHKGIYCVGDIMAGGVELTPVAVKAGRLLSERLFNAMSDAKMDYSQIPTVVFSHPPIGTMGLTEPEARAQYGDGNVKVYTSSFTSMYTAVTSHRQACKMKLVCAGKEDKVVGIHGIGFGMDEILQGFGVAMKMGATKADFDAVVAIHPTGAEEFVTMR

SEQ ID NO: 23807 - protein, 352 aa, Solanum tuberosum
MDRGPGPCMDMPIMHDSDRYDFVRDIGSGNFGVARLMTDKQTKELVAVKYIERGDKIDENVQREIINHRSLRHPNIIRFKEVILTPTHLAIVMEYASGGELFERISNAGRFNEDEARFFFQQLISGVSYCHSMQVCHRDLKLENTLLDGSPAPRLKICDFGYSKSALLHSQPKSTVGTPAYIAPEVLLRKEYDGKIADVWSCGVTLYVMLMCAYPFEDPDEPKDFRKTINRILSVQYSVPENIQISEECRHLISRIFVGDPAQRITMPEIRNHVWFLKNLPADLIDDKMISDQFEEPEQPMQSIDTIMQIISEATVPPIGLYNLEMMDDDMDDLDSEPDLDIDSSGEIIYAM

SEQ ID NO: 23808 - protein, 458 aa, Zea mays
  misc_feature (441)..(441): Xaa can be any naturally occurring amino acid
MPTRNHNAAAAAAPQHHHHNRGGAPALGKSKAVPGRADAMNRRAPLGDIGNLVSVRPAEGSLSCRSRSIAPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILADWIIEVHHKFALMPETLYLTMYIIDQYLSLQPVLRRELQLVGVSAMLIACKIEEIWAPEVNDFILISDSAYSREQILSMEKGILNNLEWNLTVPTVYMFLVRFLKAATLGNIVEKEMENMVFFFAELALMQYGLVTRLPSLVAASVVYAARLTLKRAPLWTDTLKHHTGFRESEAELIECTRCWSAHTRRPHADSKLRAVYKKYSSEQFRTRARXRPPAAAVEINETKITCC

SEQ ID NO: 23809 - protein, 130 aa, Frankia sp. EAN1pec
MAKLSTDELLDAFKEMTLLELSEFVKQFEDTFGVTAAAPVAIAAGPVAGGAGGEAAAVEEQDEFDVILESVGDKKIQVIKEVRALTSLGLKEAKDLVDGAPKPVLEKVAKEAADKAKAALEGAGATVTVK

SEQ ID NO: 23810 - protein, 514 aa, Bacillus thuringiensis serovar konkukian str. 97-27
MSILTVENLSHSYGEKTILYNACFRLLKGEHVGVVGENGIGKSTLIRILTGELIHDDGNIEWFPHVKIGFLQQHMDLQEGMTIEGYLQSAFADLYAIEYEMLKIAEEMNGAGEVEKLLVKYGELQTILESSNFYHIHAEVEEVAIGLGLFEIGLKKDVSKLSGGQRTKLLLGKLLLEKADVLLLDEPTNYLDTAHIEWLQSYLRLYEKAYVIISHDELFLNSITNVIFHLEGGKVKRYVGNYEKFVQSYQVQKKQLQSAYVKQQKEISQLETFIQKNKIRKAKQAKSREKVLEKMQRIEKIHPVPRSRFDFNVYEEPVSRILQAEKLRIGYSDPLCPELNLQVKKGEKIAIIGHNGIGKTTMLKTLLGQIKPLSGSISVGERVNPAYFAQEEFASETTPLEKVWAERPDMTKKEVRQALAKCGLKEEHVLKPIRLLSGGEQTKVRLCELIVTRSNVLILDEPTNHLDIETKKSLQEALQQYKGTVLLVSHEPSFYEAWITKVWNIEEWNAEQYE

SEQ ID NO: 23811 - protein, 478 aa, Bacillus thuringiensis serovar konkukian str. 97-27
MRKTMSQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 23812 - protein, 138 aa, Triticum aestivum
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVEVEEVKKEYPDAYVRIIGFDNMRQVQCVSFIAFKPPGCEESGKA

SEQ ID NO: 23813 - protein, 220 aa, Zea mays
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 23814 - protein, 440 aa, Ostreococcus tauri
MATTRGILVTEGARGRANGTTASASASASASVSAADEDGIKKIGDDASRCYATIATSTSSSLRWFRARTDLARFAMFPGRPRDVIGNRTSSYDWMGGGLGEDARDPVDASVVYRKTLVGLEVCDRRTHVSCGMPYAIGDGQTSSGLRTCAMRIMRSRETKSGDEQCAADFFVIYLHGNACDVGDCAEEAMKLAIGLSSHVIVPEYPGYGVADGISHEESVNTIVKATVKYCVKYLLAPQSRMIIFGRSIGTGPATWLARLMCVQNGAPAGLVLQSPFTSIRDLAARYIGVGRYAIGDGWNIMENLAEVECPVLLLHGDQDEIIPYEHSNKLVDTMHVVNADRVPCKPPSISMFTQQGADHNNYEVKAHIVMPCMKWIRTKVIPHALENLRKNKTAINKEEGEQKWLNPMHCRLVAKPHMLVHERPPSPPLSAKGSASAGV

SEQ ID NO: 23815 - protein, 402 aa, Frankia sp. EAN1pec
MAAMSRISHRIAGIAPSATLAVDATAKAMRAAGRDVIGFGAGEPDFPTPEHIVAAAEKACREPRMHRYTPAAGLPELREAVAEKTRRDSGLVVEPSQVLITNGGKQAVYQAFATLLDPGDEVLLPAPYWTTYPEAIRLAGGVPVDVVTGPEAGYRVTVEQLEAARTPRTKVLLFCSPSNPTGAVHTPEEVRAIGRWAAEAGIWVLSDEIYEHLVYGDARFASMPVEAPELADRWVVVNGVAKTYAMTGWRVGWLIGPLDVVKAATNLQSHATSNVSNVAQAAALAAVAGPLDAVHEMRTAFDRRRKTMHEMLVQIPGVRCPLPDGAFYAYPSLEGVLGRTLRGRTPATSADLCQFILEEAGVAIVPGEAFGTPRFARLSYALGDTDLVEGVRRLGALLSEAV

SEQ ID NO: 23816 - protein, 230 aa, Magnetospirillum magnetotacticum MS-1
MSPEEREKRIRAVFNAVAPRYDLMNDVMSFGIHRLWKRAMVKAARPASGQVLVDLAGGTGDVARLLAGRDRRVMVCDPSPEMMAVGEARSRGLGIQFVEGSAEAMPFESNSVDTLTMAFGLRNATSPEAALAEIFRVLKPGGWYVCLEFSRPWALIRPFYDFYSFHVIPRLGAWIAREPAAYAYLVESIRRFPDQRQLAGLMGDAGFERIAWRNLSAGIACLHSAVKPAS

SEQ ID NO: 23817 - protein, 507 aa, Oryza sativa Japonica Group
MDHVTSSTIARGAMSWVAATVALLLTTAVILTALQKRKISSPAAAAPPVVRGAGLVRFARAMARDGPLEAIREQQAKLGSVFTAIAPFGLFKVTFLIGPEVSSHFYLAPESEMGQGSIYRFTVPLFGPEVGYAVDPDTRAEQMRLFWDVLKPRSIEARVGAMAEEVQNYFSRWGEQGTVDLKKELEQVLMLIASRCLLGREVRESMVDEVYELFRDLDNGLHLISTMLPYLPTPAHRRRDRARQRLGEIFTEVIRSRRNSGTADNGDDVLQRLIDGRYKDERDLTDVEVVGLLVALVFAGKHSSSSVSTWTGINLLSHPNHLVAVIAEQDRLMASRARTDDDHDRVNYDTVQEMTTLHRCIKEALRLHPPAVAMFRQARKHFTVQTKEGKEYTIPGGHTVMSTILVNHHMPNVYKDPHVFDPSRFARGRGEDKAAGPFSFLAFGAGRHSCAGESFAYTQIKVIWSHLLRNFELKMVSPFPETSWRMVTPEPKGTVMISYRRRNLTCK

SEQ ID NO: 23818 - protein, 690 aa, Cryptococcus neoformans var. grubii
MRKAMANDGQGTTESTEAAMENSQTNLSHTSRTTGPKGTLRVKVISARGLAVSHSPGAEPQPYVVIQFEQNEYVSRPPHPVTSASSVPFTTSTPQPIGTPNNLTRSSSGLGVGAISRAFADAVGRGKKKEDGSGTMTPKAEEPAGGSWLGKPGPGDPVWKEEVSFDVTSSKPTLHLSVYDRNRDGEGFLGMLDIKPVLQDGYVLDNWYKLDTRGDETVTGEVWIQMTYTIIRKRISLKPSDFEFLKLIGRGTFGRVFQVRKKDTRRIYAMKVLSKKEIVAKKEVAHTIGERKILQCSLECPFLVGLKFSFQTDTELYFVTDYKCGGELFWHLQKEGRFQRRSGGLQKEGRFSEDRARFYIAELVLALEHLHKYNIVYRDLKPENILLDATGHVALCDFGLSKPDLTDDKLTNTFCGTTEYLAPEVLLDEKGYGKHVDFWSLGVLLFEMCCGWSPFYAEQTQEMYRLICYGKIRFPKNVIGDDGKQFVKGLLNRNPQNRLGSHRGAVELKEHPFFKNIDWDLLYKKQITPPFKPIVDSDESVANFDPEFTNSSLLDAGIVPWEEVNANVDPGTASQPGKHSYLGPGAGISGSVPGGGGVAINKAQRPGLPGANGSPLTSSVQENFRGFTYTGESLMPQSMLADQSMDSDSDNENAVDDDEDDDEDEEEYEEDDDEENGIGSSRRECDVDMD

SEQ ID NO: 23819 - protein, 141 aa, Physcomitrella patens subsp. patens
MAATVVRNVFVYGSLLAPEVLTALLHRVPPASLAVVHDYHRFSIKNRIYPAVLPSKGDKVFGKVLFDLSDQELHILDEFEDIEYTRLIVSPRILVTAYMYIWADQGDPDLVGDWEYEEWARTYLEDYVKMCEEFESELSKI

SEQ ID NO: 23820 - protein, 676 aa, Hordeum vulgare subsp. spontaneum
MFPLGARQPPPSAMDNHQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPKESSVKPTDGRCEYLPHNNSSDTVMENLEEPIVRAADLIGSMAKNMDAQQAAARAIDAPNCSLQAPEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHAANYGSNSFSNNNTNNGSTAATTAAAATVHAETGGGVDKRSNMMNMKRERRVAAVNKFREKRKERNFGKKVRYQSRKRLAEQRPRVRGQFVRQPPAPAAVER

SEQ ID NO: 23821 - protein, 527 aa, Vitis vinifera
MISADDFYKVMCAMVPLYFAMLVAYGSVKWCKIFSPEQCSGINRFVAVFAVPVLSFHFISQNNPYEMDTKFIVADTLSKLLVLVLLSVWAILFKGGLDWLITLFSLATLPNTLVMGIPLLNAMYGDFTQSLMVQLVVLQCIIWYTLLLFLFEYRAATLLIKNQFPGSTAASISKFEIDGDVISLDGRDPVRTESEIDGNGRIRVRIRRSTSSAPDSALSSSMGITPRASNLSGAEIFSVNTPAPLHDPRLSGYASSDAYSLQPTPRASNFNELDTTTITTTNTPFWVRSPVAGKVYRQQSPAFSGVRMVWESPGKCNGGGGERQGCKDVVGEREISFRDSSKFPVAEEEDPKATATGQDMPRTHVMLRLILTMVGRKLSRNPNTYSSVLGLLWSLISFKWNVGMPSLVKYSIKIISDAGLGMAMFSLGLFMALQPRIIACGTKRATMGMGIRFICGPILMSAASIAVGLRGVRLHAAIVQASLPQGIVPFVFAREYGLHPDILSTGVIFGMLVSLPVTLLYYILLGL

SEQ ID NO: 23822 - protein, 380 aa, Vitis vinifera
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPVYHFLGTSTFSEYTVVHVGCVAKINPLAPLDKVCVLSCGISTGLGATLNVAKPTKGSTVAVFGLGAVGLAAAEGARIAGASRIIGVDLNPKRYEDAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLNGEGLRCIIHMEP

SEQ ID NO: 23823 - protein, 407 aa, Mycobacterium smegmatis str. MC2 155
MLEDTKVRARPSWLLLGPAFVAAIAYVDPGNVAANVSAGAQYGFLLVWVIVVANVMAGLVQYLSAKLGLVTGRSLPEAVADHTRTPTRVAFWLQAELVAMATDLAEVVGGAIALYLLFDLPLLVGGLITGVVSLLLLAVQNRRGQRVFERVITGLLMVIAIGFLTSLFVKTPPAAAVADGLIPRFDGAESILLATAMLGATVMPHAVYLHSGLARDRHGHAEGPRLRMLLRVTRFDVGLAMLVAGAVNMAMLLVAATNLQGRGDTDSIEGAHAAVSDALGPTVALLFAIGLLASGLASTSVGAYAGAMIMQGLLKKSYPLLLRRLVTLVPALLVLAIGVDPSRALVLSQVVLSFGIPFALIPLVRLTSDKALMGGDANHRVTTAFGWGVAGLISVLNVVLIYLTVNG

SEQ ID NO: 23824 - protein, 236 aa, Zea mays
MAGGGDDELKLLGAWASPFVLRVKLALSFKGLSYEDVEEDLSGGKSELLLESNPVHKKVPVLLHNGKPVCESQIIVQYIDEAFAGTGPSLLPADPHQRAVARFWGAYIDDKLLAFWLQSARAKTQEEKAEALKQALAAAENLEAAFTEISEGKPFFGGDSVGYLDVTLGALVAWVHAAEKLYGMRLFDATRTPRLSAFVERFGALGAAKAVLPDVDGLVEYAKQRQADAAAAASDS

SEQ ID NO: 23825 - protein, 155 aa, Methanosarcina barkeri str. Fusaro
MAVWKGKKVVLHTTMGDITIEFFEDMPITAGNFAKLVEKGFYDGVIFHRVIDKFMIQGGDPTGTGMGGPGYEIPDEFTNHNRNDRGTLSMANAGPNTGGSQFFINLVNNNYLDKMHPVFGKVVEGMDVVDSIGKVKTDRQDRPKTEVKITKAELV

SEQ ID NO: 23826 - protein, 344 aa, Sulfitobacter sp. EE-36
MHVASDLAQAIGNTPLIRLRKASEETGCEIYGKAEFMNPGQSVKDRAALFIIQDAIAKGTLKPGGTIVEGTAGNTGIGLALVGASMGFKTVIVIPETQSQEKKDMLRLAGAELVQVPAAPYRNPNNFVRYSERLANELARTTNEGVIWANQFDNVANRQAHIETTGPEIWEQTGGKVDGFCCAVGSGGTLAGIGMALQPKGVKIAIADPDGAALHNYYTKGELVAEGGSIAEGIGQVRITKNLEGFTPDFSYNVSDAEALPYVFDLLQHEGLCLGASSGVNVAGAVRLAKDMGPGHTIVTILCDFGTRYQSKLFNPDFLREKDLPVPAWLDRAPQSIPGVFEDQ

SEQ ID NO: 23827 - protein, 427 aa, Oenococcus oeni PSU-1
MPALRWQFLFLLAAIISGISGMAYSEFASALPVAGSAYSYGSVIFGQVVVGWFLGWSLILEYFLATSAVSVGFSSYLAGLLQTDHISGFNSILAGPMEGGIINLPAVVLLLVILGIQIIGLSTTRWVENVFVAIKLAILAIFIIVGLFFIKSNNYVPFYPKEFQTGAFGLSGIWMATSGIFFAFIGFDTLAAHTAEVKNPKKQVARGIIYTVIVAAVLYTLFAIVLTGMVNYTKLNVSDPASFAFTFVGQKGLASVIGIGSMIGMFTGVLALVFASSRLIYSFGRDGLLPNFIGKISGSQHVPFNALLIAGVVEIILAGFVPLSYLASLINAGTLAAFTFVNFGIIPLRHRTDLPNENGFRVPGYPIIPIIGGLTSFFFITQLETKTLVMFGVWTLVGLLIYFTYGVRHSMVKESKFDQSIIKENNA

SEQ ID NO: 23828 - protein, 424 aa, Glycine max
  misc_feature (8)..(8): Xaa can be any naturally occurring amino acid
MDPLEALXIAQIQGLSSSPGDLTRLHSVLKQADDSLRSESTRLAPILTQLDPSIHSLGFLYILEASMTDPVTKTQAETVVPIVTRFIGACSPEQIRLAPDKFLSVCKRLKDQVMLLEAPIRGVAPLFTALRKLQVSTEHLTPLHSEFLLLCLLAKCYKTGLSILDDDVFEVDQPRDLFLYCYYGGMICIGQKRFQKALDLLHNVVTAPMSTINAIAVEAYKKYILVSLIRHGQFSTSLPKYSSSTAQRNLKNFCQPYVELANSYGTGKIAELEAYVKANAEKFESDNNLGLVKQVVSSMYKRNIQRLTQTYLTLSLHDIASTVQLNSPKEAEMHVLQMIQDGEIYATINQKDGMVRFLEDPEQYKTCEMIEHIDSSIQRIMALSRKLTATDEQISCDQLYLSKAGRERQRYDFDDFDVPQKFNI

SEQ ID NO: 23829 - protein, 721 aa, Triticum aestivum
  misc_feature (11)..(11): Xaa can be any naturally occurring amino acid
VRYPDDPFDRXWESDSLRRANYLVDVAPGTERITTTKPVFVGTELEPPEKVMQTAVVGQNGSLNYRLDLEGFPGNAWAVSYFAEIEDLAPDETRKFKLVVPGMPLFSKPTVDVEENAQGKYRLYQPGYTNVTLPFVFSFEFKKTNDSSKGPILNAMEIYKHVQITMGSPDANTMSSLASRYPQAGWAQEGGDPCLPVSWTWVQCSSEAAPRVLSITLSEKNITGSIPEELTKLSALVELRLDGNSFSGGIPDFSGCRNLQYIHLENNQLNGALPSSLGDLPNLKELYIQNNRLSGHIPRALSKKSIIFNSSGNNLQGPSDSISHGTIIIIVCAVVGAILLLAVAIGCCLCTHKRKKKPSRETVVLAAPAKKLGSYFSEVATETAHRFALSEIEDATDKFERRIGSGGFGIVYYGKLADGREIAVKLLTNDSYQGIREFLNEVALLSRIHHRNLVTFLGYSQQDGKNILVYEFMHNGTLKEHLRGGPNDVKITSWVKRLEIAEDAAKGIEYLHTGCSPTIIHRDVKSSNILLDKNMRAKVADFGLSKPAVDGSHVSSIVRGTVGYLDPEYYISQQLTEKSDIYSFGVILLELISGHEPISSDNFGLNCRNIVAWARSHIESGNIDAIIDASLDTGYDLQPVWKIAEVGIMCVKPKGAQRPTISEVLKEIQDAIAIEVQREAPQVQQLMSKRSMGSVSINTDNSVDLEQNASFDEMLMRPGLR

SEQ ID NO: 23830 - protein, 320 aa, Clostridium difficile 630
MRVLNNVTEAIGNTHMLHLSKIADEFGVQGNIYAKMEYLNPGFSKKDRVALQMITEAENAGLLVPGQAVVELTSGNTGTGLAIACACKGYKFIACMSKGNSMERARMMKALGAEVVLVDQMPNSVHGQVSGEDLALVEIEAQKIAKERNAFRADQFNLEACNHAHEKYTAEEMWEQLDGNIDVFVDFLGSGSTFAGCSKTLKKHNSSIKCYVVEPETAAIYSGKEITDQGHKIQGGGYSMDLPLVDKKLIDGYIQVTDEEATDVARKLAKLEGVFAGFSSGANVCAAIKLLKSSEKGKNIVLTLNDSGLKYLSTDLYEEL

SEQ ID NO: 23831 - protein, 219 aa, Cynodon dactylon
HTELRSRQILCKAEVNISSNIPESLPSSVPESKPEVSQYEKVVELLTTLFPVWVILGTIIGIYKPSMVTWLETDLFTLGLGFLMLSMGLTLTFDDFKRCLRNPWTVGVGFVAQYLIKPLLGFAIATSLNLSAPLATGLVLVSCCPGGQASNVATYISKGNVALSVLMTTCSTIGAIVMTPLLTKILAGQLVPVDAVGLAMSTFQVVLMPTIVGVLAHEY

SEQ ID NO: 23832 - protein, 252 aa, Glycine max
  misc_feature (211)..(211): Xaa can be any naturally occurring amino acid
QKQLCGCAAANSALHLLPIIHIFAKPPIPLSVSTVALSRDNLCKNCKRPGHYARECPNVAICHNCGLPGHIASECTTKSLCWNCKEPGHMASSCPNEGICHTCGKAGHRARECSAPPMPPGDLRLCNNCYKQGHIAAECTNEKACNNCRKTGHLARDCPNDPICNLCNVSGHVARQCPKANVLGDRSGGGGGARGGGGGGYRDVVCRNCQXLGHMSRDCMGPLMICHNCGGRGHLAYECPSGRFMDRYPRRY

SEQ ID NO: 23833 - protein, 461 aa, Photobacterium sp. SKA34
MKHPNVLQITLVVALGGLLFGYDTAVISGATESLQTFFNLNPAELGFAAASALIGCVIGAIAAGYTSTKYGRRGALLIAALLFFISALGSAIPDQYWTFIFYRIIGGIGVGIASMVSPMYIAEIAPPQKRGALVSCNQFAIIFGMLVVYFVNYGIALMGSESWLNEMGWRYMFGSEMIPAGLFFCLLFSVPETPRWLAMRGRDEQAKELLSKISKGKDFDNQWKEIKDSLVEVGTASVTSRKILPILVIGIMLSVLQQVTGINVFLYYAPVILKSFSSSSTDLALLQTILVGAVNLTFTVIAIITVDKYGRKPLMMLGSGLMAVSMIAIGTAAYLNAIGGYLLFFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 23834 - protein, 332 aa, Pseudomonas syringae pv. tomato str. DC3000
MGLLVDGRWQDQWYESSKDGAFQRENAQRRNWVTRDGQAGPSGEGGFAAEAGRYHLYVSLACPWAHRTLILRKLKGLEKLIDVSVVSWLMLENGWTFDQQKGSSGDALDDFQFFHQRYTADDPRYTGRVTVPVLWDKQQQRIVSNESAEIIRMFNAAFDELTGNTLDFYPSALQSSIDELNEQIYPKVNNGVYRAGFATSQGAYEEAFDDVFAELDVLENLLGEKRYLTGKHLTEADIRLFTTIVRFDAVYYSHFKCNLRRIADYPNLSNWLRELYQWPGIAETVDFEHIKGHYYASHRTINPTGIIPKGPALDLQAGHDRERLSGEGAWSK

SEQ ID NO: 23835 - protein, 364 aa, Cryptococcus neoformans var. neoformans JEC21
MAPKDRTSEFHSTLNSIKSRSALTTNRAKGKQQDREAKQPLISNGPGQTGAKSEFGKMAGGIAKDINATTLKLQKLAQLAKRKTLFDDRPVEISELTYIIRQDIASLNSQIAQLQAYIKSSKGGKGGSAASGSKGKGNGGKQEEEHNSNVVMLLQSRLANMGMGFKDVLELRTQNMKASKDRTEQFMHTAQGSSVLAPAENSLLFNQPGDRKGKSRANTPTPNPSSSLSNLGSKRGEKEGQDFLALDIDGDRGESGIGMGGDYQQMQLVEQQDTYIQSRSTAIESIESTIAELGNIFSQLATMVAEQRETVQRIDADTTDIAANVSGAQRELLKYYASVSSNRWLMLKIFGVLIIFFLVFILVS

SEQ ID NO: 23836 - protein, 430 aa, Vibrio campbellii AND4
MSFSSQGFAPEVVKALAECGYEKLTPIQQKAIPMARKGFDIFATAQTGTGKTAAFSLPMIQQLLESSRSVSRKTARALVMAPTRELAEQIADNIKAYTKYTDLSVAAIFGGRKMSSQISALESGVDILVATPGRLEEHIEQGNVSVANIDFLVFDEADRILDMGFIHAVRKIMLDVDTNPQIMMFSATTSSQLNLLAKDILHKPKRIEVERANTTAQTIAHVLYPVDQERKTELLSELIGRKNWRQVLVFVNYKETANDVVKELKLDGIKAVVCHGDRAQSARRRALEEFKTGKARVMVATDVAARGLDIEDLPHVVNYDMPFLAEDYVHRIGRTGRAGKQGHAVSFVNREEELTVVQVENLIQQRIRRIELAGYEPKQRESYIEKLNSKPAFKNRQGRRNNPNQSATDQGSAERRLAMVKRLKARRSSN

SEQ ID NO: 23837 - protein, 256 aa, Brassica napus
MEDIIIGVVALAAVLLFFLSQKSKTKRYKLPPGPRGLPVIGNLHQLSQLNPQRFFYGWAKKYGPIFSYKIGSQTMVVISSAELTKELLKTQDVNFANRPQHRGHEFITYGRSDMAMNHHTPYYREMRKMGMNHLFSPTRVATFKHVREEEARTMMVKVEKAAERAEPVDISELMLTFTNSVVCRQAFGKKYNEDGEEMKRFIKILYGTQSVLGKIFFSDFFPLFGFLDDWTGLTAYMMKCFERQDTYIQEIIDETL

SEQ ID NO: 23838 - protein, 496 aa, Corynebacterium glutamicum ATCC 13032
MVKYPQSTLGDLVTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 23839 - protein, 1862 aa, Cryptococcus neoformans var. grubii
MLPSSQQTTAAGPPATPDQLTLRHRHPSSKRRKSRNLDDPSKSKPSPSESARRGKPTFLSSMHFSQALPQSIPSMASDEPRPELQRGQRRSKIEALTKIDRAGTPIQLAAGPAATSFVPHTIQQSTPPASAPHYLRNPLHRPKVVNPPFSIDSVRTKAPRHPHPRTEPRLFGLEDCPTFYPTPKEFTDPMAYIESIAQQGKKYGMCKIVPPEGWNMPFRLETEIFRFKTRLQRLNQLEAASRAKLNFLEQLSMYHMQQGNPKIHIPLIDRQPLDLWKLRREVNRSGGNFELDRTKGWSKITEVLGHKPSWTPHIRAAYMNIVLPFDNWAVTAKSASVSPLAHFNSGSNSSPSKAPPAFITDNLSATPIKQDYGVSRMGTTSHRPTLRVRLNDMHFAPSFDNGRSPSKCASVKGGGALADAIEIKQPVSLPTAPSVAADTPTMLRINVPGFSDREGSDSELSDEDSPSSLPSIRKAPFEPEYQKGEVCEICKGEYDADKILLCDGCDRGFHIYCLDPPLASVPNNEWYCTSCLLSQGEDFGFEEGDEHSVASFQARDAAFSCAWWNRHMLHNSPGASVNGAQLADNGDNERVRPRQFGKVTVSEDDVEREFWRLTESPLDTVDVEYGADIHSTSHGSAGPTPETHPLDPYSKDPWNLNNMPILPDSLLRYIKSDISGMTVPWIYIGMMFSAFCWHNEDHYTYSINYMYWGETKTWYGVPGSDAEKFEAAIKSEAPDLFEQQPGLLFQLITMMNPGRLSDAGVKVVACDQRPNEFVITFPKAYHCGFNHGINMNEAVNFALPDWLPDGKDSVRRYREHNKAPVFSHNELLITITLFSESIRTALWLKDAIIEMVEEESARRDALRAKYPKLVEDVIEEDCPEEQYQCAICKGFCYLAQLTCSCTSLVSCLSHADQLCTCGKPRKVLRMRYSEAQLEDIRDVVIQRAALPEQWRIRFLSLMESPRPQLKSMRTLVSEGERIAHPIPEFETLKRFVDVASSLMEQIGTITARKNTGRRKKKSKGDVNHNGKRAGVERDDDENDGIDRSPGLLTDLLKQADRLAFDAPELTQLRQLMLTVEGFRTEASSLLSTPEDQLDLQKCKNTLILGQSFGLDFPELSPLEQLIQRQEWFRQLEEEVDDVNMEYGDVVTLLQESLNCQIPQDHVMVKELRLREGKGRHWIDLVEKLLSSPQIAVDDISTLIEARQHVPVSIDILRKLENLRKSAISWQTSARSVFATNGSSVAASRLCKNVAAASEPLSNVVIPEIRQLQAELEHHALWREEASKVLGVPVARLASTIGYIRGEFENSLAPDDDACNDQRICFCRSLSVDNIVVCKICQHSYHPRCVDLSPRRIPQEFKCAVCQRLPNDDGPSLDVFIGLISPQRWNFLINPPEFEQAQYIASAAIRYAPQVFRLADPVSLSHPCRDLELLRHTIRKIYTLPLVFDTRNSQTNERCVFVNWLFRRMQDAIRVERKEASLLAVSAQSKMDRRHSVALAVGEFGSTNDENGTSSGRAKPRRRARIILAESHPHEFHCLCGLPSAGKSATTEVECPKCGQGYHEVCVKVTEELARKSIWRCPCCTVRDGRHYRKGVEVRVQLSSHRGTDQFLDYRTIINDFAKQLVIVRKPTSTSAITLECIDFVPAHIPDDVKTMGEGADSLNWTKKRKSTEVYGDFRNEQGTNSPVTHVLNAMAAKGSMGPPSTTPNKISTHAISSGTCGSLAAMGVRSGIETKSSAVPRTIYTSAAESNADTSCSVLTPTIQNRSSSGMRSNVDPASYFSSTPFAIGVSTTSVVRQNGGTSMATICGEERETAVLGKSVHDDSIDSHRDSEGDSYSDMRESIAVEEAVPFGHYVVDEDVIIENY

SEQ ID NO: 23840 - protein, 1182 aa, Cryptococcus neoformans var. grubii
MFVTRPPSSSVDHRGSLLDGHTNHTNTPGSSRDDVPSSDSTSTAFHKFKNSSRFSPHYLNIPPGLAFKSYLEKWGPEQVIGFLAIHGCEHHSGIFIKNSIDGKLLLDLDMGILTSLGITKVGERIRLMAGIKCLRQRVAHEAEKHNIPSAHLCNGSLEMDRVKVIIHPKLSASLYVHRHGPFDSGPITARRCPLTPSSSADPEGDPSPMQRSQEVMKHSFITRSSRRQVIPPLPPGQIHNHGIDNSPMPSLRHIPLRSGVSYSDIDVKGMPPLVTQSTNSVFNHTFAVTGSHDTTSCLGGHLRRPDYFRSTNDTFQTCTKRGDNTISELPQRNQESSPSMWKQSGVICEDKAMRNGSLFAPTSHKPFAISITGDNVMEYPHNLPIKNGLPLRSFQSPDKSADDDRLNINPSAPSLDDLRRQLVKFVNAEDGTTRTVNVMKTTSGVEVLERALRKFGKTGTGRALLLDDESHNGGKHEGPLCIDGWGVFAENLQGEEMGPMSEEDLLDICASLRNGAAMQRDALILRQTSKSQKRKDMRFYLGSMPVLPTPVNLPISFSSSHSGQFEQNSALQYTAQHQPLRSKNRSRASMMSIMSGLGVSHPDIKQPTHDSLQSPASVTMPSSKKKSMYNFFGHRPPSELISSHLTDYFPSAKKRDVAKARGSMLRLNIAHSAERNPRSVENLGMIEADDVPFSSTEQSLTEQRDHYFDSSTCQPADTSSPGHVDHNITDPAGNSEGNYRLPYDQKVLPTPITQELHSANSVNPILRTYPPNLPSTYLSARLTDLHRDSFLSQLQPLQHSSSLSSAQPFSSHRRTVDEITAEMQHRQTSLSCDRPTSTIDSDISGPPCNSEISLDHTSEASGISESSSEYCDDHSSVSSEDSEDNSAAHTRAFTTKRNIKWIKGALIGAGSFGSVFLGMDAQSGLLMAVKQVELPRGIAKMEARRRDMLSALEREIELLKDLQHDNIVQYLDSSMDANHLNIFLEYVPGGSVAALLNNYGAFEEALAGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSRAFALDYRMRPSAASLLKHAFMVHDGNGGNDEPIQNTYA

SEQ ID NO: 23841 - protein, 746 aa, Candida albicans SC5314
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHKNILTIQDMIFEEPKMSNRTDIITMRGSFYTVTPYMSSDLVGLLENPKIKLELGQIKCIMQQLLKGIQYVHNQKFLHRDIKAANILIGQDGVLKIADFGLARIYHGNVPRLGMGPGGGEKAYTGLVVTRWYRPPEILLGERKYTTAVDLWGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKFEESHEIDKERFKKLKDKEQAVSELKPPTEIRYDNHSESRYNADHSTFGGGGVGGKETSFSSGKSDYIDHYEPRARRDHYEPRIRNDNKDSNDVRGEFESATRQEQRRRDIQNRLDAGGMDTYIPKTTTAKLREHSGTESLSKKYDNYQPINVSRGSKSPSPSKLSSISQSKADLISKPSAPKVASRESSLERKQVSNGIRTTTDVEPPRARARRPTDMFGRPLTSNSTQAQPTRNKSVERPKDLEKPTNGVTEDRNKKPVLEEKKEVVKPNLAIPKIKKSSSLVSLSSRSSTTPVISNPSKVTKRAASSVTPPVLPKKPKISKTSSESEVSDLEEDSDFTGENATVFERFMALEQLQKSPVYKRIINEKMRFEKLSGGHKSM

SEQ ID NO: 23842 - protein, 223 aa, Oryza sativa Japonica Group
MAPAAAMAILLLALLMPATLCSRSGPPSSKHGHGGHAKRAPPPASPVVPVAPQAAALVRATCNSTAYYDVCVSALAADPSSTTADVRGLSAIAVSVAAANASGAAQAAAALANGTAPLAAAAAGDGTVQALLRACAGKYGDARDALAAAKESMGQQDYDLATVHVSAGAEYPQVCKALFRRQRPGAYPAELAAREEALNKLCSVALDIIALLTSSPASNNNNS

SEQ ID NO: 23843 - protein, 396 aa, Oryza sativa Japonica Group
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHASVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWED

SEQ ID NO: 23844 - protein, 738 aa, Aspergillus fumigatus
MSSGTPSTEPESSGRSAGMSTSPTSIPAGKGTTTPPKVTQQDVSVELKNMRPDRSPPKGSIPLGEDIMQIARIGEIGPMQRLFDEKKFTANYQDEEGITPLHWAAINNQYAMCKFLLDNGADVNAKGGDSVATPAMWAAQRCHYYIVHLLLQHGADPLLTDVQGYNILHLATIDGNAFLLVLLLHQEIPVDVIDQQGHTGLMWAAYKGYPACVDLFLRWGANVNAVDDGGLTPLHWALVKGSLPCVQKLIEYGADRFAKTRDGKSPATVAGEMNTTRVWYRALDECGYDVDGNTKVLPMGLTSWLRNKSVMSKFFFLWPFLMVYAAVYILSHMVIYAAIPIMLVATFGLQWVAQKAASQAPSEYRVLQKTPYLSGVFAGSLFWVGVTYIFSVLPATYSTSPILNILFAVFYCLTTYFYIYSMTEDPGFVPKTGSRNQQKVVINELFEQWKFDEENFCVFCMVRKPLRSKHCKRCSRCVAKHDHHCPWIDNCVGANNLRHFVLYIICLEIGIILFLQLTYRYINILPAPVEHACNIINEELCGFVLRDPFTLVLDLWIAIQLVWVTMLCAVQLVQISRNQTTYENMRGHSIDRSYPSSRAFASAITAGTTSLEAAGLSATGQGPNPALARGHSHRGRRHGCLQQWSSLLGIDTFFATARDGLRDGPRADRPKNPFSRGIITNCRDFWCDPAPYFGKREPGTAMLGGEIVNYNQMYEVPMRMYSDGRYQSVAHDDPEQHV

SEQ ID NO: 23845 - protein, 463 aa, Physcomitrella patens subsp. patens
MLVAHQGPASAVHFLKQSSLLTLQCRRGGRVEGGVVVKAVSNIQNYVSEGSSLGEVTKGDFPILDQYVNGYKLVYLDNAATSQKPASVLNALRDYYEGYNSNVHRGVHALSAKATDEYEAARKKIAGFINAPSDREIVFTRNASEAINLVAYTWGLTNLKEGDEVVLTVAEHHSNIVPWQLVAQKTGAILRFVELTSEEILDLEQLNGFLNERTKLVSIFHVSNVLGCINPVEDIVKWAHAVGAKVLVDACQSVPHMPVDVQALGDFLVASSHKMCGPTGMGFLWGKTEVLESMPPFLGGGEMIVDVFCDRSTYAGPPSRFEAGTPAIGEAVGFGAAVDYLNKIGMDRIHEYEMELSKYLYESLSKVPGVRIYGPPPGDHGERRASLCSFTVEGIHATDLSTFLDQQHGIAVRSGHHCTQPLHRFLGISASARASLYFYNTTDEVDSFIQGLNDTIDFFSSLK

SEQ ID NO: 23846 - protein, 176 aa, Zea mays
MAQRDKKVEEPTELRAPELTLCANSCGFPGNPATNNLCQACFLAATASSSASASVSPPPPSSSSSSPAVLQFDEQQQQQNPRPRAPAASGPTEEPPRPARASAPAPAPASSSSVRRCQTCRKRVGLTGFRCRCGDLFCGAHRYSDRHDCCFDYRAAGRDAIARDNPVVRAAKIVRF

SEQ ID NO: 23847 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVEMFSDVNVRSIGAMYAACTNWAGSLVIATTFLTMLENITPTGTFSFFAGLCFIAFFFVYFLLPDTAGLELEETTDFLSNGFNVKQAAQLSKERKKHSKFAKSKPTV

SEQ ID NO: 23848 - protein, 191 aa, Zea mays
MMATSASGVSLLLLLAHPAPPPHPANGASSLWRGGGAALAPHPARFAAKRRTLRLVNVSVSCSAEALRSDGAGAEPAVPRSVPVRVAYELQQAGHRYLDVRTEGEFSAGHPEGAVNIPYMNKTGSGMTKNAHFLEQVSRAFGKDDEIIVGCQSGKRSLMAATELCSAGFTAVTDIAGGFSTWRENELPTVQ

SEQ ID NO: 23849 - protein, 357 aa, Lactococcus lactis subsp. lactis Il1403
MSKRLLILEDGTIFEGESLGANLDVTGELVFNTGMTGYQESITDQSYNGQILTFTYPIVGNYGVNRDDYESIHPTCKAVVVHEAACRPSNWRMQMSFDEFLKAKNIPGITGVDTRAITKIVREHGTMKASLVQARDEVEHQMSQLQATVLPTNQVETSSTTTAYPSPNTGRKVVVVDFGLKHSILRELSKRECNLTVVPYNTSAQEILEMEPDGVMLTNGPGDPTDVPEAIEMIKEIQGKIPIFGICLGHQLFSLANGAKTYKMKFGHRGFNHAVREIATGRIDFTSQNHGYAVSSENLPEDLMITHVEINDDSVEGVRHKHFPAFSVQFHPDAAPGPHDASYLFDDFMDLMDNFKK

SEQ ID NO: 23850 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRELNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 23851 - protein, 340 aa, endosymbiont of Acanthamoeba sp. UWC36
FYVLAEFWGSMMLSLMFWQLANQIYSINDAKKFYSLFGFVGQIGLFSAGSFMMLFTKTGTTWQTSLHYITSSILLSGILLSIALFVLGNYLVGNDTINGTQTKSKKKKPGLVESLKYVFSSKYIGLIALLVICYGISINLVEGVWKKLIQIVYPDPKDISNFGGKVQMYTALATFTAMLASSFVLRIFSWRTAAIITPIIILITGVPFFIFVSYKGWFANTLDVTSATILFFAVIFGATQNVLSKAIKYSFFDPTKEMAYIPLDEELKAKGKAAADVIGGRLGKSGGAIIQWSMLSFITGSTLVSLAPILSIIFVVVMCIWFIAVIKLNKEFKIKSSGSN

SEQ ID NO: 23852 - protein, 418 aa, Streptomyces toyocaensis
MLAGLAVTFAVAFVFARLAKRIRQPRVMGEIIAGLALGPSLLGLLPGDPVEALFPADARPVLQALSQLGLVLFMFGIGYELDFALLRGAGSRVTLVSLSSMALPMALGAGLAVLLFPLYDKSQLSSDGVLAPAIFLGVAMSITAFPVLARIIAENGMQRTRIGAMALACAVVQDFLAWCVLAVAVVIATASGLWPLARMVLESGLFLGVLLYVVRPGLRRLLAPERRRAVGSSLIHAILVTGLLVSAWATHEIGLHAVFGAFAFGAVVPHRHIEVQAPQVVERIEQTSLFLLPVFFTVTGLSVDVGGLGRTGLIMTVAVVLVACTGKYVGAAVSARLTGASKAESRTLGVLLNARGLTELVILNVGLGLGVLDSRLFSAMVVMALVTTFMTGPLLHRLGFHEELRLVPAPVKNADNSV

SEQ ID NO: 23853 - protein, 108 aa, Triticum aestivum
  misc_feature (89)..(89): Xaa can be any naturally occurring amino acid
  misc_feature (99)..(99): Xaa can be any naturally occurring amino acid
MKFNVANPTTGCQKKLEIDDDQKLRAFYDKRLSQEVSGDALGEEFKGYIFKIMGGCDKQGFPMKQGVLTPGRVRLLLHRGTPCFRGHGXRTGERRRKSXRGCIVSQDL

SEQ ID NO: 23854 - protein, 376 aa, Musa acuminata
MALPPSSFFLLLFLSVGSSLLSSAAKLGEGCSANQDCDAGLRCDGCDGDLGVCVRIRPYEPRSKVRIRHYPFSIRNLGLWVGWFRFRANLGLECAQGKDLPFNKYSWLTTHNSFADAGAHSATGATLITFTNQHDNITSQLNNGVRGLMLDMYDFRNDIWLCHSTAVYQQPAINVLKEIETFLAANPSEVITIFIEDYVKSPSGLSKVFNASGLMKYWFPVDQMPKNGSDWPLLSKMIDQNHRLLVFTSVASKEASEGIAYEWNYVVENQYGDEGMTPGSCPSRAESSPMSTTLKSLVLMNYFRTNPSASSACHNNSAPLLDMLKTCHGLSANRWANFIAVDFYMKGDAPEAADVANGHMVCGCDNIAYCKASGKV

SEQ ID NO: 23855 - protein, 207 aa, Triticum aestivum
VTFRTRCTKKQVATGPEFPGYRRPTRPRLTTAAMACAFSASTVSTAAALVASPKPAGAPQCLSFPRAAARPSRLAAAGSRTARARSFVARAAAEYDLPLVGNKAPDFTAEAVFDQEFIHVKLSDYIGKKYVILFFYPLDFTFVCPTEITAFSDRHEEFDKINTEILGVSVDSVCSHLAWVQTERKSGGLGDLKNPLVSDVTTSISKS

SEQ ID NO: 23856 - protein, 166 aa, Cynodon dactylon
IAAVSALQNQPIVNAVIDGDDIIYRDYIDVSVAVGTSKGLVVPVIRDAENMNFADIEKGINNLAKKATEGALSIDDMAGGTFTISNGGVYGSLISTPIINPPQSAILGMHSIVQRPVVVNGDILARPMMYLALTYDHRLIDGREAVFFLRRIKDVVEDPRRLLLDI

SEQ ID NO: 23857 - protein, 157 aa, Chlamydomonas reinhardtii
MATKVKLMSSDAQMFEVDEDVAFQSQTVKNLVEDAGTEDAIPLPNVSGRILAKVIEYSKYHVEAEKKGADDKPTKTEDDVKRWDDEFVKVDQATLFDLILAANYLNIKGLLDLTCQTVAQMIKGKTPEEIRKTFNIKNDFTPEEEEEVRRENQWAFD

SEQ ID NO: 23858 - protein, 473 aa, Bacillus thuringiensis serovar konkukian str. 97-27
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFIDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTNTTEVESL

SEQ ID NO: 23859 - protein, 213 aa, Triticum aestivum
MGCVSSKQFRRAPPHEDAALLAKETTFSLNEVEALYELFKKISYSIFKDGLIHKEEFQLALFRNSNRKNLFADRIFDLFDLKRNGVIEFEEFVRSLHIFHPDTPMADKIAFAFRLYDLRGTGSIEREELKEMVLAILNESDLLLSDDAVEQIVDQTFKQADLNSDGRIDPDEWKEFASKNPALLKNMTLPYLKDITMSFPSFVVYSGAGDEEL

SEQ ID NO: 23860 - protein, 414 aa, Bacillus thuringiensis serovar konkukian str. 97-27
MNTSRKVAIIGLGYVGLPLAVHLAERGHTVLGLDKDTRKIESIIKGESYIPDVSSKELQSLLTKKKLIVNTPDQGVAEFQNSDYVIVTVPTPINEQREPDLSALISASHYIQQNLQKGQTFIFESSTYPGTLEEVIIPIISQTGKKAGEDFYIGYSPERIDPANSQYSVQTIPKVISGQTEKCKQKVQALYSTIFDVVVPVSSPKVAEMCKLFENIQRLVNISLVNELNTLCESLGIDFYEALEAASTKPFGFTPYWPGPGIGGHCIPVDPLYFQWRIKKNGAMSQLIEAAHVINEEMPEKMVQKVKGVVQPPATVLIVGIAYKKDVNDLRESPALPIIELLIKEGYEIEYHDPYISSAKFGDKVYQSISLNEQAVNQASCILILTDHSNIDWKLFKGIKRVVDTRGIVKKVSK

SEQ ID NO: 23861 - protein, 278 aa, Zea mays
MSQEQPRRPSGHEETSGGGEQGAVRYGDVFPAVSGGLAEKPVARRTATMQSAENLVFGQTLKGGPAAAMQSAATTNERMGAVGHDQATDATAVQGVTVSETRVPGGGRIVTEFVAGQAVGQYLARDDDGGGGIAGPGAGAGVAGKDITKVTIGEALEATALAAGDAPVERSDAARIQAAEARATGLDANVPGGLARQAQSAAAANSWAWGDEDKATLGDVLANATARLVADKPVESADALGVAGAENRNRNDGTARPGGVAASMAAAARLNRNEAVWE

SEQ ID NO: 23862 - protein, 181 aa, Solanum tuberosum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSACATSGEGLYEGLDWLSNNIANKA

SEQ ID NO: 23863 - protein, 322 aa, Clostridium difficile 630
MEKRKVIIDCDPGIDDSLAILLALNSPELEVIGITTCCGNVPANIGAENALKTLQMCSSLNIPVYIGEEAPLKRKLVTAQDTHGEDGIGENFYQKVVGAKAKNGAVDFIINTLYNHEKVSIIALAPLTNIAKALIKDKKAFENLDEFVSMGGAFRIHGNCSPVAEFNYWVDPHGADYVYKNLSKKIHMVGLDVTRKIVLTPNIIEFINRLDKKMAKYITEITRFYIDFHWEQEGIIGCVINDPLAVAYFIDRSICKGFESYVEVVEDGIAMGQSIVDSFNFYKKNPNAIVLNEVDEKKFMYMFLKRLFKGYEDIIDSVEGVI

SEQ ID NO: 23864 - protein, 333 aa, Debaryomyces hansenii CBS767
MAETITKTQPQSLKLRSGFELPQVGFGLWKIPKDKTAQVVHDAIKCGYRNFDGAYDYQNEEEAGEGIRKAISDGLVTRDEIFVTTKLWNNYHSKENVFKSAKWQNEAWGLGYIDLYLMHFPIALKYVDPKENQYPAWWADKEMTIVQPDRVPIRETWEAMESLVDLGIARSIGVSNFQAQAIYDILTYNSLPISALQVEHHPYLVQPELFQLCQEQNIAFIAYSSYGPQSFLELPGSFSELANDITPLFQNKTILSIASTHKKSPAQVLLRWATQRGVVVIPKASSQTHLEQNLQLDFDLSEDQINSISKLDIGLRFNDPGFYLKSHPLHIFA

SEQ ID NO: 23865 - protein, 274 aa, Glycine max
MEIFPIPAESYTLGFIGAGKMAESIARGAVRSGVLPPSRIRTAVHFNLARRGAFESFGVTVLPSNDDVVRESDVVVLSVKPQLVKDVVSKLTPLLTKHKLLVSVAAGTKLKDLQEWAGNDRFIRVMPNTPAAVGQAASVMSLGGSATEEDGNIIAQLFGSIGKIWKAEEKYFDAITGLSGSGPAYVYLAIEALADGGVAAGLPRDLSLSLASQTVLGAASMVSQTGKHPGQLKDDVTSPGGTTITGIHELENGGFRGTLMNAVVAAAKRSRELS

SEQ ID NO: 23866 - protein, 225 aa, Solanum tuberosum
MVSRSRAGFTLNIIDTPGLVEGGYVNDQALDLIKKFLLNKTIDVLLYVDRLDAYRVDNLDKQIVKAITDSFGKEIWRRGIVVLTHAQLSPPDGLTYDEFTSRRSEALLKIVRMGARIRKQDIQAASIPVVLVENSGRCNKNESDEKILPSGTAWIPNLVQTITDAVLSGSKGILVDQKLIEGPNPNNRGKVLIPFILAFQYFFVVKRIQKSIKNDIARESRPAWA

SEQ ID NO: 23867 - protein, 303 aa, Zea mays
  misc_feature (165)..(167): Xaa can be any naturally occurring amino acid
MASFFADDGADDLPRTTSHPFDSDDFGAAAADGAGAGADGYGGYASFAEGGVEEVDEEITVESDGVPIRHVSGGYSPSPFSPELEPNGGDGPILPPPTEMGRDEGILLREWRRKNAMELEKKEQKERELRAPIIAEAEESKKGFFEKRIQNCASNMVEREKIFVXXXPARSAGADKQYWKSISDLIPHEIATIEKRGKKDKDKKPSVTVIQGPKPGKPTDLSRMRHILVKLKHAPPSHMLQPPPAPAAKEGAKDGSKEGGKDGGAKDGAAAPANDAKQPAESQETSTANGPSEAEKEQPAASE

SEQ ID NO: 23868 - protein, 169 aa, Zea mays
MAPTVMMASSATAVAPFQGLKSTASLPVARRSSRSLGNVSNGGRIRCMQVWPAYGNKKFETLSYLPPLSTDDLLKQVDYLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 23869 - protein, 511 aa, Cryptococcus neoformans var. grubii
MFARQPLSRNLLRPLSRPSSSFSRASTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKVNVKLLEGGETQVEAKNIIIATGSEVTPFPGLEIDEERIVSSTGALELKEVPKKMVVIGGGVIGLELGSVWSRLGAEVTVVEYLGAIGAGMDSEVGKQFQKILTKQGFKFKLNTKVVSGHREGDIVKLKVDSAKGGKEETIEADVVLVAIGRRPVTTGLNLEAIGVETDKRGRIIIDDEFNTSAKGVKCIGDVTFGPMLAHKAEEEGIAAIEILKSGHGHVNYDAIPSVVYTHPEVAWVGKNEEELKAAGVQYKIGKFPFAANSRAKTNQDSEGFVKFVVEKETDQVLGCHIIGPAAGELIASAVLAMEYKASAEDIARTCHAHPTLSEAFKEAALSSYDKPINF

SEQ ID NO: 23870 - protein, 313 aa, Mentha x piperita
MAINLSHINSKTCFPLKTRSDLSRSSSARCMPTAAAAAFPTIATAAQSQPYWAAIEADIERYLKKSITIRPPETVFGPMHHLTFAAPATAASTLCLAACELVGGDRSQAMAAAAAIHLVHAAAYVHEHLPLTDGSRPVSKPAIQHKYGPNVELLTGDGIVPFGFELLAGSVDPARTDDPDRILRVIIEISRAGGPEGMISGLHREEEIVDGNTSLDFIEYVCKKKYGEMHACGAACGAILGGAAEEEIQKLRNFGLYQGTLRGMMEMKNSHQLIDENIIGKLKELALEELGGFHGKNAELMSSLVAEPSLYAA

SEQ ID NO: 23871 - protein, 409 aa, Triticum aestivum
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 23872 - protein, 645 aa, Arabidopsis thaliana
MPLGERGGWERTESRYCGVETDFSNDVTHLLNFNISTGGFDYVLAPLVDPSYRPSLVEGNGVDTQVLPVCGSDLVLSPSQWSSHVVGKISSWIDLDSEDEVLRMDSETTLKQEIAWATHLSLQACLLPTPKGKSCANYARCVNQILQGLTTLQLWLRVPLVKSEGDSMDDTSEGLVRHNDSWELWNSFRLLCEHDSKLSVALDVLSTLPSETSLGRWMGESVRAAILSTDAFLTNARGYPCLSKRHQKLIAGFFDHAAQVVICGKPVHNLQKPLDSSSEGTEKNPLRIYLDYVAYLFQKMESLSEQERIELGYRDFLQAPLQPLMDNLEAQTYETFERDSVKYIQYQRAVEKALVDRVPDEKASELTTVLMVVGAGRGPLVRASLQAAEETDRKLKVYAVEKNPNAVVTLHNLVKMEGWEDVVTIISCDMRFWNAPEQADILVSELLGSFGDNELSPECLDGAQRFLKPDGISIPSSYTSFIQPITASKLYNDVKAHKDLAHFETAYVVKLHSVAKLAPSQSVFTFTHPNFSTKVNNQRYKKLQFSLPSDAGSALVHGFAGYFDSVLYKDVHLGIEPTTATPNMFSWFPIFFPLRKPVEVHPDTPLEVHFWRCCGSSKVWYEWSVSSPTPSPMHNTNGRSYWVGL

SEQ ID NO: 23873 - protein, 369 aa, Methanosarcina barkeri str. Fusaro
MMKAVLGLEDGTVIKGTGFGAEGTACGELVFTTQFTGYEEALTDPSYKGQILMFTYPLIGNYGVSGERVQSDNMHAEGLVVREACKKPYHYKSSRSINKFLEDEGKPGIEGVDTRMLTIRAREHGTMRAALIAGSDDGEEAVDVARNAPQLTDEELISLVTCKEPYFIPGAEGAWKGGSKRKHAVIVDLGIKRNIINNLHKRGIDLTLVPATTKPSEIANYEPDLLFISNGPGDPEKATDAINAVKAFAGTIPVCGICFGHQIISLAMGAKTYKLKFGHRGGNQPVKDLIENKIFITSQNHGYAVDADSLDGTGLYVKYLNANDKTVEGVSHKDLDVFSVQFHPEAQAGPMDTEETFFGKVVKVLGGEI

SEQ ID NO: 23874 - protein, 377 aa, Mentha x piperita
MSALVNPVAKWPQTIGVKDVHGGRRRRSRSTLFQSHPLRTEMPFSLYFSSPLKAPATFSVSAVYTKEGSEIRDKDPAPSTSPAFDFDGYMLRKAKSVNKALEAAVQMKEPLKIHESMRYSLLAGGKRVRPMLCIAACELVGGDESTAMPAACAVEMIHTMSLMHDDLPCMDNDDLRRGKPTNHMAFGESVAVLAGDALLSFAFEHVAAATKGAPPERIVRVLGELAVSIGSEGLVAGQVVDVCSEGMAEVGLDHLEFIHHHKTAALLQGSVVLGAILGGGKEEEVAKLRKFANCIGLLFQVVDDILDVTKSSKELGKTAGKDLVADKTTYPKLIGVEKSKEFADRLNREAQEQLLHFHPHRAAPLIALANYIAYRDN

SEQ ID NO: 23875 - protein, 1607 aa, Debaryomyces hansenii CBS767
MPESTNSSNINRTNIQLVSSTLSGLSKNELTNRDIFGRTILHILILANRYDLLRNLLKNPDVRLLVTLTDYENGWNCLHYVIFHKRLSCYKVLINYLQNLKTGLTGNLNNSLLLEMLRCKDRNKVTPLQLLDNDFKDLVWVPEYIDENNEYHLSYRFQGAKDSDGGDNENNEEIEKILTNKRPFIRQKHNWSTPERGGSDIYMFGSNKNNNLGVGDATDRAIPSKISHECFKTKGIESQNIQTGLMKPRYRMVKISKNHSIVLTYDGSLYSCGIGSRGRLGHGFNDLNNTFRFKKINFYEFNEDDEDNGQDHAEQVIKDVAISSNHSIALNNENEIYSWGLNNFNQLGYTSSIASSSNSVSNKTFLEPFEGQPKEIISGDLKRNQSPINGLAVSKIHSVAYTRNELFFWGLCIGQMGIPIDSTTTPIEHKVNNTIYKGFIQRSPKRVALRDDIKYVLTSETCTCVISSTNDIHIFYQYQHFKLPKIPVKGSTDKHFDLFKPTKLTQAIKIEKVCLKSHQFIALLLDNGDVMSFSLSHSENDDGSSKGYKNLKYASLWKSYDRDMKVIDIDVSNDGSIILCTRNGSAFIKTHSSQRKNSMSEVSLSVPALKNKFKKIESLNKVIKVSCDDNFLSFGFIRDDIDLIPFELQSNDFLKDMEYLSCLSDIDFARKQKQLLNSGHKHSSYISDYLYSQRTKANVNNSYHSIFPSHQQEDEEELDEMHTMEDNEYSKNLTYDILYNRYISRYDFQKNKRIKLRNTYLHTSRAEDEILMNLLKSDILYLSYKLAGNSESNKRYNCSIKFAKFPDISIKIHKEIFIKRSPFCAKIFNPTNAGEYFIEGGVEGRYSPDENELVFTNNINIKSVLIITHFIYSNRVLSIWDDFPGGLNCPSDIKEIRQDFDKLSKLFLVTDLLGKLTKDEVYLKKVQALINDKQNGDVIIRLKDGDITCHSYILIASSAFFETVLSERWDNQEDTEGLKVLTLGDVSVFQFELILRHLYGYNDLELFDCLNEKTSDNPDIDEFINCLLELIEISDELLLLQLKNLCQLGIKDFISLENVLILLMHAHYLGATKLFMNCCWFIYNNLDAILFDPSFREIPDDLLKELERQAQFFQYCKLIDFAENCEKVSENSLKNWMELQSNSLIFDFLNNIKEHNEVFISDKRGFEGFDPVIDIKYNQRKPTQESSKKKKDGRSHSVASRKNSTISNIQANLVDFRKIAATKNNENEEALDDSEDGFEVVNKRRQNSKSDNIRPASVLNSTSPTPPPSQSPSRSSSIVDVPNIQPTRKTSLPGSAPTKPLMVTKETQCNPRLSPHSNWATKSNAGTLIDKQPVLGKGLELQTKEQQSLSLKKNSKLKFGPSVRLSQKERKKMASQITPDNNSNEEVSKILNPWSKKDSIGATANNSDGIGLPTRGSLSRSSKHEDNTKRKNSQIKGIVRNGANNSSGTGELRKSDLPKLGNADSQAKQGTNQIKSSAYSSMALNVNKPVNKVYSTPSLTEIMIHESLKIEEAKIKETERKTLQEIQQEQQFAKWWEEEALRIQRQMLQMEINGRVESGSSTKHNSGTNKTKKSRNTKPKRSSTSNSDSAYTPNNKTQTKHKNATKE

SEQ ID NO: 23876 - protein, 254 aa, Fusobacterium nucleatum subsp. nucleatum ATCC 25586
MRLIKTLDEIKGIKKANQIIAKIYADIIPPYLKAGITTREIDKIIDDYIRSCGARPACIGVEGFYGPFPAATCISVNEEVVHGIPGDRVIKDGDIVSLDIVTELDGYYGDSAKTFAIGEIDEESRKLLEVTEKSREIGIEAAVVGNRLGDLGHAVQAYVEKNGFSVVRDFAGHGVGLDLHEEPMIPNYGRKGRGLKIENGMVLAIEPMVNVGTYKVAIMPDGWTVVTRDGKRSAHFEHSVAIIDGKAVILSELD

SEQ ID NO: 23877 - protein, 306 aa, Nocardioides sp. JS614
MNSPGVLVIGEALIDIVEAPSGAVAEAPGGSPLNVAVTLGRLGVPVTLATALGDDERADRIQAHLADSGVALAAGARTLDRTASARARMQSDGSALYDLDVTWDPATPDPGGATAIHAGSIALFQEPGASRVGDVLRRAPAGAMISLDPNIRPSLLPGRRRVVAQFEQLAALAHLVKLSDEDAAWLYPDLTWRQVAQHLLRLGPTLVVVTRGGQGSHLAAAGITVDRPAITSVIADTIGAGDSFMGALIRQALALGVIDRLVSRSALGSHDLVTLGDAAGLVAAVTVSRVGADPPWDWEIDAALTE

SEQ ID NO: 23878 - protein, 749 aa, Ashbya gossypii ATCC 10895
MGEQLTVRGVVSPLTPATTQRVVHQHRGGSGGCRKMWMRLETAVGGAETGGTINEAIAVPFDEGDTVDDLKVGVLLQRLRQTRWSQQRDGTCIAVGFYCRCTHAESVATAPPGLVAPQALRAGRFVPRSGTLGGQLTDGDSAGHDSPQSPQAASRMQSPSSLQGLWCGQTTLPPADIEPVAYISARGLLETTHNQFVSAHERPQFPAQDRFDRNKIFGSGARRRAWSGQSMIPPGGSPSPSHFHRQAPPVHAHKVLFEPDVPVSAISQTIFGGSQRSREALVVFFDTVPSCLPLESPVSSPVSSPVSKHSSVRGSHLTLSPGPAASSELTGPPHLDMPFAYRQSSDELHAKLDTELLANPLLHNLPPVKENFKLITDIEQLRQLSSTMGHKLGSPLRQAILLLPKHIREHVKTEEDGSETQIRPSEPVPAATSSSAPAPAPTCDSSSGYFSLEPPVGACPGFQSEQINARVPGSSAEDALSYFSVHGDANLRDASVPSNQTRDRVFPKINVLIVEDNIINQAILSSFLRKHKISYEIAKNGVEAVEKWRKGGIHLILMDLQLPLLSGIDAAKQIRNLERASGICAFQKHCEARSQETYSELNRAKFRAPVIIVALTAFSSHADRNEALVAGCNDYLTKPVNLDWLSNKITEWGCMQALIDFDGWTKGESRMTDNVLLKPQLTACRSHNSVNNSMSAGATITSPASGDATATPGTPIGTLAATMIPTPNPMAKLADTSDSHTLACEWKEN

SEQ ID NO: 23879 - protein, 335 aa, Pseudomonas aeruginosa
AFNMHNRNLLSLMHHSTRELRYLLDLSRDLKRAKYTGTEQQHLKRKNIALIFEKTSTRTRCAFEVAAYDQGANVTYIDPNSSQIGHKESMKDTARVLGRMYDAIEYRGFKQEIVEELAKFAGVPVFNGLTDEYHPTQMLADVLTMREHSDKPLHDISYAYLGDARNNMGNSLLLIGAKLGMDVRIAAPKALWPHDEFVAQCKKFAEESGAKLTLTEDPKEAVKGVDFVHTDVWVSMGEPVEAWGERIKELLPYQVNMEIMKATGNPRAKFMHCLPAFHNSETKVGKQIAEQYPNLANGIEVTEDVFESPYNIAFEQAENRMHTIKAILVSTLADI

SEQ ID NO: 23880 - protein, 187 aa, Xanthomonas campestris pv. campestris str. ATCC 33913
MSLINTQVQPFKANAYHNGNFIEVTEASLKGKWSVLIFMPAAFTFNCPTEVEDAADNYAAFQKAGAEVYIVTTDTHFSHKVWHETSPAVGKAQFPLIGDPAHKLTRAFGVHIEEEGLALRGTFIINPEGVIKTLEIHDNSIARDVTETLRKLTAAQFVANNPGQVCPAKWKEGAKTLAPSLDLVGKI

SEQ ID NO: 23881 - protein, 232 aa, Neisseria elongata
DQGAGVTYLEPSGSQIGHKESIKDTARVLGRMFDGIEYRGYGQEVVEELARYAGVPVFNGLTDEFHPTQILADLLTMREHSGKPLQQTAYTYIGDARYNMGNSLLLIGALLGMDTRIGAPKALWPSENIIAQAHSLAEKSGARLLLTDNPQEAVRGTDFIHTDVWVSMGEPKEVWQERIDLLRGYRFTADLMAAAGNPQVKFMHCLPAFHNRETKVGEWIYKTFGLDGVEVT

SEQ ID NO: 23882 - protein, 162 aa, Cryptococcus neoformans var. neoformans JEC21
MHAEWTGHGMGAGRGAAEMTAKRSQQIIFTPRAASDYPADCRADRSALVNSKNLQSSFDTLIDNYTSTTPARVKLIDAFLLFILLSGILQFAYRVLITVYPFHAFAGGFGSTVGQFVLLAGLRAQVAPGRDGEFKEVSQERAFADFCAASVVLHLFAFNFLG

SEQ ID NO: 23883 - protein, 406 aa, Zea mays
MPIFSTNSEFSAAKMSDNLMDKVSAFGERLKITGTEVSKKMTAGMSSMSFKMKELFQGQTPADKIVEGATSEDLDGPDWNSNLEICDMINTEKVDSVELIRGIKKRIMLKDARVQYLSLVLLETIVKNCDKAFSEVAAERVLDEMVRLIDDPQTVVNNRNKALMLIEAWGESGDELRYLPVYEETYKSLKSRGVRFPGRDNESLAPIFTPARSVAEADVDASLPQQVFEDVHVHTYTAEETKEAFDVARNSVELLSTVLSSSPEQDALQDDLTTTLVQQCYQSQHTIQMIIETVGDNEAVLFEALSVNDEIQKVLSKYEEMKQPRASEHAEHVPVVIPIAAEHEDLNAVGNEDALVRKPAAARATSGGDDDILDDLDEMIFGKKGGSSSQEGPKKPDPKKDDLISF

SEQ ID NO: 23884 - protein, 450 aa, Sulfitobacter sp. EE-36
MTLPPKPESRPAKVSLWRYARLFRQDILSAQPARLYRAWMAEFKTPFFRSYLINQPDLIQTVLKTRPDDYPKSDRIGEGLRPLLGNSVFLTNGAIWKRQRRIIDPAFEGGRLRETFPAIWDAAEAAAARLAPHDGAPLEVEAQTSHAAADVIFRTLFSIPIEHHMAREVFDEFKTYQRSQPILNIAAFVPLPRWLPRLFRRDTKRSAAKIRRLITALTAERMEAIKAGTAPDDLATKIMTTPDPEDGSTFTTDEMVDQVAIFFLAGHETSASALAWAMYLVATHPDWQDRLAAEAQAIDQCDFAVMGKLKQSRDVFREALRLYPPVPMMVREASCPATFRDRTVARGAQVVISPWHLHRHERLWDNPDGFDPARWHSENGKKCQREAYLPFSAGARVCPGAGFAMVEGPLILSRILRDYRIEVVGEKPPIPVAHLTVRSKDGILLRFVRR

SEQ ID NO: 23885 - protein, 294 aa, Triticum aestivum
  misc_feature (24)..(24): Xaa can be any naturally occurring amino acid
  misc_feature (104)..(104): Xaa can be any naturally occurring amino acid
  misc_feature (122)..(122): Xaa can be any naturally occurring amino acid
  misc_feature (132)..(132): Xaa can be any naturally occurring amino acid
  misc_feature (146)..(146): Xaa can be any naturally occurring amino acid
  misc_feature (237)..(237): Xaa can be any naturally occurring amino acid
MAKDIEAAPPGGEYGAKDYSDPPXAPLFDAEELTKWSLYRAVIAEFVATLLFLYITVATVIGYKHQADPAGPNAADAACSGVGILGIAWAFGGMIFVLVYCTAXGVSGGHINPAVTFGLFLXARKVSLVRAXLYIIAQCLGAICGXVGLVKGFQSAFYVRYGGGANELSSGFSKGTGLAAEIIGTFVLVYTVFSATDPKRSARDSHVPVLAPLPIGFAVFMVHLATIPITGTGINPXQGSFGAAVIYNNEKAWDDHWIFWVGPFIGAAIAAAYHQYVLRASATKLGSSASFGRN

SEQ ID NO: 23886 - protein, 157 aa, Musa acuminata
MAGESCNLDKDEAEIFKPSPSSSPSPSPPSPPSSSQPPPPSSVLLKPSEESGIQRPEIPESPPAPTITFAASSTPKLDEEPSNPGEESPAPVRFSNRCSACRKKVGLTGFRCRCGDLFCGRHRYSDAHECSFDYKAAGREEIAKANPVIKAAKIIKI

SEQ ID NO: 23887 - protein, 894 aa, Musa acuminata
MNSVRSGFLIQAAFLVMISGSSNMGVSGLGSMSSIAVSYGENGPVFCGLSSDGSHLVACFGADASIVYGAPLRLPLLGLTAGDGFVCGLLLDTGQPYCWGSNIFVKMGVPQPMAEGASYSEISAGDDHLCALRKPAIDSRKGASLIDCWGYNMTASHEFDGSVAAITAGSVFSCGMFIHNRTAFCWGDETSSGVISLTPRNLRFQSISAGGFHVCGILENSQVFCWGRSLETQQLSLGHGDVKMVPMDPMVSVAGGRFHACGIKSLDHKAVCWGFMLQNSMPPPKDSRLYEIAAGDYFTCGVLAATSLRAVCWGTGVPWSIPMAVSPGICASNPCGQGYYEFSHTSWGNKVCKPADSRVCLPCSVGCPEGTYESTPCNLTSDHGCEFNCSSCASVECSSFCSSQKESKSKRLLSLQMPIFIAEIVFAIIFVSSVFLVACLYARHRLQSCRCLESAVTTSRKRTYSFHKEMVKVRPDLEELKIRRAQMFTYGELEKATSGFSEESLVGKGSFSCVFKGVLKDGTVVAVKRAIRVSDVKKNSKEFHTELDLLSRLNHAHLLNLLGYCEEGGERLLVYEFMAHGSLYRHLHGKDLCLRKRLDWVRRVTIAVQAARGIEYLHGYACPPVIHRDIKSSNILIDEEHNARVADFGLSLLGPVDSSSPLSEPPAGTLGYLDPEYYRLHYLTTKSDVYSFGVLLLEILSGRKAIDMQFEEGNIVEWAVPLIKAGDISAILDPVLKPPADLEALKKIAAMASKCVRMRGKDRLSMDKVTTTLERALALLMGSPCNEQPILPTEVVLGSSRLHNKASQRSSNRSCSENDTDDQIYEYRAPSWITFPSVTSSQRRKSSASEGDAEGKNSEGRSLGHGGAGDGLRCLEEEIGPASPQENLFLQHNF

SEQ ID NO: 23888 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITDIDDENEAIQSLFKGNVTVVIYTKGADGAAIYLKNGINHYHSGYKVKPVDTTGAGDAFIGAVISRILATDVLNLTQLFENEGEEILAFSNSVAAIVTTKYGAINSLPTLQEVEQAF

SEQ ID NO: 23889 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDATYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 23890 - protein, 263 aa, Physcomitrella patens subsp. patens
MASNFWTSSHCKKLLDQEEVSHVAQTDAERGLTPEDVKLMKIQFSAYIKLLGYHAKVRQRVVATAIAYFRRIYTRHALHLLHICIKSFSEFDPRLVAPTCLYLASKAEESTVQAKLLVFCTKKIRATFASHRYDVKDILEMEMRLLEALDYYLVIYHPYRPLIQLLQDGNMPTDMTQFTWSLVNDSYRTDLILMYPPFMIALACIYIASVLKEKDTRSWFEELRVDMNVIKNIAMEILDFYDNYREIPGERITAAVSKLPQRL

SEQ ID NO: 23891 - protein, 336 aa, Vibrio angustum S14
MAFNLRNRNFLKLLDFTPREIQHLLDLSAELKKAKYNGYEQPRLSGKNIALIFEKSSTRTRCAFEVAAFDQGAKVTYLGPSGSQIGHKESMKDTARVLGRMYDGIEYRGFGQAVVEELGQYAGVPVWNGLTDEFHPTQILADFLTMQEHGRGKQLHEITFAYLGDARNNMGNSLLVGAAKMGMDIRLVAPKAFWPEDELVAQCREIASETGAKITLTENVQEGVQGCDFLYTDVWVSMGEAKEAWAERIQLMLPYQVNMDLLKATGNPHVKFMHCLPAFHGEDTTIGKELAQEYPELAQGVEVTDEVIESKHSIVFDEAENRMHTIKAVMVATLGH

SEQ ID NO: 23892 - protein, 327 aa, Ehrlichia ruminantium str. Gardel
MKISILGAGSFGTAIAIALSAHGISVNLWGRDHRNITHINTYRKNLKYLPTYHLPDNIYATSNIDEVLSDNNTCIILTVPTQQLRTICTQIQHKQHMCKNTPMLICSKGIEITSLKFPSEIAEEILQYNPIFILSGPSFAKEIAEHLPCSIVLAGDNKELGESLIEKISNDVLKIIYHQDIIGVQIGAALKNIIAIACGIIAGKNLGNNAVATVITKGMNEIKTLYIAKNHSIDLHTLIGPSCLGDLILTCTTEHSRNMAFGLEIGKGRNINTLIDHNLKLVEGTSTVKPLISLAKKLNVELPICISIYNLLHENISLDKAISNILS

SEQ ID NO: 23893 - protein, 138 aa, Shorea ovalis
EKNIPVLLGLLSLWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEQLHK

SEQ ID NO: 23894 - protein, 642 aa, Saccharomyces cerevisiae
MSSQFFLKTSQDIELFQSYPTFEQSNTNSKDFPVISSVLSPCGRFLALSTKENVKVFTGPCLDNVLLTMKLSDVYDLHFSPAGNYLSTWERASIQDPNHKNVKVWYLNKPFKKDCVSEDIVPAYEYQAKSQSGWFLQFSKLDNYALRLFKHDLKIVKLSSANADKFDFQSPFAVLSDDETSQHFTTYLISPAEHPTICTFTPEKGGKPAQLIIWALSEGKITKKIASKTFFKADSCQLKWNPLGNAILCLAITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTSAPSAPASTNAPTNNKETSPEEKKIRSLLKKLRAIETLKERQAVGDKLEDTQVLKIQTEEKVLKDLEKLGWKDE

SEQ ID NO: 23895 - protein, 122 aa, Solanum tuberosum
MASKIQQLQSQACQASKFVAKHGTAYYKQLLEQNKQYIVEPPTVEKCNELSKQLLYTRLASIPGRYEAFWKELDSVKQMWKNRKELKVEDAGIAALFGLECFAWYCAGEIIGRGFTFTGYYP

SEQ ID NO: 23896 - protein, 138 aa, Shorea ovalis
EKNIPVLLGLLSIWNVSFLGYPARAILPYSQALEKFAPHIQQVSMESNGKGVAIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 23897 - protein, 534 aa, Vibrio campbellii AND4
MAIIKSKAKPTGELFLSNKTAMTELVQNLTANIQAIKQGGGQKAIDRQRQKGKLPVRERVQHLLDEGSEFLEVGLFAAWNVYEESIPCAGVVAGIGTIEGIQCMVIANDPSVKGGTYYPLTVKKHLRAQEIAQRCQLPCVYLVDSGGANLPHQADVFPDKEHFGRIFFNQARMSAQGIPQVAVVMGLCTAGGAYVPAMADVSIMVKEQGTIFLAGPPLVKAATGEIVTDEELGGADVHCRKSGVADYYAQNDQHALQLAREAISNTNQPTPIQSDNPILPPRYDAEEMYGIVNANLRLSFDVREIIARIVDDSDFDEFKALYGKTLVCGFARIQGSLIGIVANNGILFSESSQKGAHFIELCAKRKLPLLFLQNITGFMVGKKFEAEGIAKHGAKLVMAVACADVPKFTVIIGGSYGAGNYGMCGRSYDPTMMWMWPNARISVMGGEQAAGVLTQVRREVKKRRSEDWPEKEESAFRDSIIDLYESQGHPYYASARLWDDGIIDPKETRHVLTLALKAARTAPIPDSNFGIFRM

SEQ ID NO: 23898 - protein, 502 aa, Bordetella pertussis Tohama I
MSTDYLKRILTSKVYDVAVESPLERAPLLSQRIANNVLLKREDTQAVFSFKLRGAYNKMANLTPAARSRGVIAASAGNHAQGVALAATRLGCRAVIVMPTTSPQVKVDAVRRLGGEVVLAGDSFTDAYEHAQQLEKREKLTFVHPFDDPDVIAGQGTIGMEILRQHPGEIEAIFVAIGGGGLIAGVAAYIKQLRPEIKIIGVQTEDSDAMVRSVRAGRRVQLSDVGLFSDGTAVKLVGAETFRLARQYVDDFVVVNTDAICAAIKDVFQDTRSVLEPAGAMAVAGAKQYAAEHKLKGKTLVAVACGANMNFDRLRFVAERAEVGEMREAVFAVTMPEQRGSFRRFCELVGNRSVTEFNYRISDAERAHVFVGVQVSTPAEPEKIAANFRRHGFDTLDLTHDELAKTHLRHMVGGHSALARNELLYRFEFPERPGALMRFLNAMNPDWNISLFHYRNQGADYGNILIGIQVPPTDKKLFKTFVAELGYPHWNETDNPAYRLFL

SEQ ID NO: 23899 - protein, 427 aa, Bradyrhizobium japonicum USDA 110
MTAIIDIIGREILDSRGNPTVEVDVVLEDGALGRAAVPSGASTGAHEAVELRDGDKARYLGKGVTKAVGAVNGEIFEALSGLDVEQQAQIDQIMIDLDGTPNKSRLGANAILGVSLACAKAAANSLDMPLYRYVGGTSARLLPVPMMNIINGGVHADNPIDFQEFMILPVGASSFAEGLRYGAEVFHTLKSELKKAGHNTNVGDEGGFAPNLPSADAALEFVMNAIGKAGFKAGSDIVIGLDCASTEFFKDGKYVYEGEGKTRSISEQAKYLADLVARYPIVTIEDGMSEDDMDGWKELTDLIGKKCQLVGDDLFVTNVKRLAEGIKAGRANSILIKVNQIGTLTETLAAVEMAHKAGYTSVMSHRSGETEDSTIADLAVATNCGQIKTGSLARSDRTAKYNQLLRIEQQLGKQALYGGKAALKALA

SEQ ID NO: 23900 - protein, 450 aa, Silicibacter sp. TM1040
MASVIYPTTNFTATEQLCITHGEGIYVYDDTGKQYIEGLAGLWCTSLGYSNTEVVEAITEQLKRLPFQHTFGGKTHAPVMELAEKLKAMVPVEDAYFFFGNSGSDANDSHYKMLRYYFNAIGKPHKRKIITRERGYHGVTVAAGSLTSLPANLAHFDAPLEALSILRTDAPHYYTGRQGNETEAQFVERILQNLEDQILAEDPDTIAAMIIEPITGASGVIVPPEGYYEGLQALLRKHGILIWADEVICGFGRTGADFGCTTMGIKPDLMTFAKQLSSAYFPISASVIPGWMYKAMVDQTNEVGVFGHGYTYSGHPAACAAALKTLEIYERDKIFDHAAEVGTYLQEQLRATFTDHPLVGEVRGKGLIAALELVSNKTTGATIAGGKGGAAAVKACQTEGVILRAVAGNALAFCPPLIITKPEVDEMLKRTKAGVDAAYEALRSEGLLNS

SEQ ID NO: 23901 - protein, 497 aa, Vibrio campbellii AND4
MMRTVPLFINGEFRESLATDWLDVTNPATKDVIARLPCATNQEMKAAIESAKATFDCWKDVAVSERARLMLRYQHLLKEHHDELATLLSHETGKIFIDAKGDVWRGIEVVEQAANIASNMMGETVENVATDIDSYSLIQPLGVCCGITPFNFPAMIPLWMFPIAIASGNTFVLKPSEQVPLTSIRLAELFEEAGAPKGVLQIVHGRKEQVDFLLKHPDIQAVSFVGSVPVAQYIYTTATQNFKRVQAFAGAKNHMVIMPDANKNQVVNNLVGSSVGAAGQRCMAISVAVFVGSSKEWIADLKQEMAKVHPGAWDDENAAYGPLISAQAKQRVIGLIEEGKQQGAVCELDGRQCEVEGFPEGNWVGPTLFSGVTTEMSIYTQEIFGPVLVCIEVDTLPEAIELVNRNPYGNGTSIFTASGAAARKYQHEIQVGQVGVNVPIPVPLPFFSFTGWRGSFYGDLHAYGKQAVRFYTETKTVTARWFDDDILSGPNLTINLR

SEQ ID NO: 23902 - protein, 471 aa, Methanosarcina barkeri str. Fusaro
MAQEKTEEFEKAQGAEKPEKNKAMEKAMKAGQYFDFFEREAGMFNTIGPRAREIIEQDCKITSACTARPYPLVVDSAKGSVIRDVDGREYIDLIAGIAVMNAGYSNPEVKAAISAQLEKMTHCGYGDFFAEPPVKLAKKLEDLSGYSKVFYCNSGTEAVEAAIKLAFWKTKRQGLISFYNSFHGRTLGSLSLTCSKARQKEHFPVLHTAHSHYAYCYRCPFKLEYPSCGIECAKELENLIFRRELSPTDTAAVFVEPVQGEGGYIVPPPEFHKEVRRICTDNDVLLVADEVQAGCFRTGPFLAMENFGVRAEISCFAKALGGGLPLGAMLADRELMDWPQGIHSNTFGGNLLASAASLASLEFLEKENIEHRVKELGSQMKQRLRELQENFPCIGDVRGLGLMVGVEIVKPDKSIDPIQRDRILRKAFKEGILLLPCGDSVIRFSPPLVITDEELDSGLEKFQKALEKAGT

SEQ ID NO: 23903 - protein, 493 aa, Methanosarcina barkeri str. Fusaro
MVQEYKLFIGGEFKDSSTGETFEDINPATLENLATIQVAGAEDVDMAVEAAEAGFRLWNEVPAAKRAEVLFRAARILQERKEELSVLMTKEMGKVLPETRGDVQEAIDITNYAAGEGRRMLGETTTSELKEKFCMTILRPIGVVGLITPWNFPIAIPAWKVMPALVAGNAIVFKPASDTPLLAFKLIEVLSEAGLPPGVINLVTGPGGTVGKAVVQHPRIKAISFTGSLDTGKWIMEECSKTMKRVSLELGGKNPVIVMDDADLELALEGVLWGAFGTTGQRCTATSRLILHEKIKDEFIKRLLAKAKALSIGGGLLPETDIGPVINKAQLEKIERYVKIGKEEGATLLYGGNRIDPGLPGYFFEPTIFTDVRPDMRIAQEEIFGPVLGIFTVSDLEEAITLANSTKYGLSSAIYTGNIGNAFRAIEKVEAGITYVNAPTIGAEVHLPFGGVKGTGNGFREAGTEAVKEFSEVKAVYIDYSGMLQKAQIDSAE

SEQ ID NO: 23904 - protein, 816 aa, Physcomitrella patens subsp. patens
MATPAAEHAGESSDPKPASKKDFSTAILERKKAPNRLIVDEAVNDDNSVVALNMEIMEKLQLFRGDTVLIKGKKRKDTVCIVLADDTCDEPKIRMNKVVRANLRVRLGDVVSVHQCADVKYGKRIHVLPFDDSIEGVTGNLFDAYLKPYFLEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLAEDVDLEKIAHDTHGFVGADLAALCTEAALQCIREKMDVIDLEDETIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDGGGAADRVLNQLLTEMDGMNAKKTVFIIGATNRPDIIDSALLRPGRLDQLIYIPLPDEASRLRIFQAALRKSPLAKEVDLEALARYTQGFSGADITEICQRACKYAIRENIEKDIEREKRMAENPEAMEEDEVEEVAQIKASHFEEAMKYARRSVSDADIRKYQAFAQTLQQSRGFGSEFRFPDRAVGAGAPSAADTTPGFGVAAAADDDDLYS

SEQ ID NO: 23905 - protein, 624 aa, Bradyrhizobium japonicum USDA 110
MDTQPIRLPSVAGATRSAGYPTRPPLRRFLTDCHEEFRGDSSGELADYIPELKRANPDHFGIALVTIDGHVYEVGDSAVPFTIQSVSKAFVFALALETVGEERVSATIGVEPSGEAFNSIRLTNDNRPFNPMVNAGAIACSGLIYEVDGKGAFERVRSKLSEFAGRELGVDEAVHASETATGNRNRAIAWLLRNYAVLPDDVDAVLDVYFRQCAILVTARDLAVMAATLANRGINPVTGAQVITPHIVARTLSVMTSSGMYDYAGEWTYRVGIPAKSGVGGGIVAALPSQLGLGTFSPLLDNHFNSVRGLKVCEALSARFDLHMLNRNADVRTSVMADYDVYGISSRRSRQPHEQQILDERHSDIRIVELVGALNFGTIDYVTRRLTSEPPNAPLLIIDFRRVPDITAAGAELLGETLTALGNANVTTILSGLEEASAVWAAIAARTGDPRRLRRFALLDDAIEWAEDQVIYRFGGFTDVKESVHLGEQALLAELDTDEIAAIVKLSTTRHYTAGQRVIAAGAPANSLFFLQSGMVSVKLRSGVRLASLGPGMEFGEMAILERTRSADVFADTPVACLELPLDSFADYRRLHPETALKIMRNLAAILARRLVAANAKVDLLSAY

SEQ ID NO: 23906 - protein, 474 aa, Magnetospirillum magnetotacticum MS-1
MANKNVGTITQVLGAVVDVRFDGQLPAILSALHLEHQGKKLVLEVAQHLGESTVRTIAMDSTDGLTRGTEVVDTGAAIQMPVGPETLGRIINVIGEPIDERGPIGNKTTLPIHADAPDFVDQSTETEILVTGIKVIDLLAPYCKGGKIGLFGGAGVGKTVLIMELINNIAKAHGGYSVFAGVGERTREGNDLYHEMIESGVIKLDGPGSKVALVYGQMNEPPGARARVALSGLTVAEYFRDVEGQDVLFFVDNIFRFTQAGSEVSALLGRIPSAVGYQPTLATDMGALQERITSTKKGSITSVQAIYVPADDLTDPAPATSFAHLDATTVLNRQIAELGIYPAVDPLDSTSRVLDPRVVGNDHYQTARDVQRILQTYKSLQDIIAILGMDELSEEDKLVVTRARKIQRFLSQPFHVAEIFTGSPGKLVAIEDTIKGFKAIVAGEYDHLPEAAFYMVGGIDEVIEKAKKMAAEAA

SEQ ID NO: 23907 - protein, 254 aa, Frankia sp. EAN1pec
MSRAGLDKKPDQVAAMFDQVARRYDVTNAVLSAGLDRTWRTATARALALAPGLRVLDVAAGTATSSRAFAAAGADVVACDFSLGMLAQARRRLADAAARAGAGAGTGGAGTGGGRVLLAAGDGLRLPFADGSFDRVTISFGLRNVAEGDVCLAELLRVTRPGGVLAVCEFSRPVWRPVRTAYMEYLMRALPAVARAVSSSPDSYVYLAESIRAWPGQAALAETIRAAGWTRVGWRNLSGGIVAVHRAVRPGGDD

SEQ ID NO: 23908 - protein, 232 aa, Neisseria elongata
DQGAGVTYLEPSGSQIGHKESIKDTARVLGRMFDGIEYRGYGQEIVEELARYAGVPVFNGLTDEFHPTQILADLLTMREHCGKPLQQTAYTYVGDARYNMGNSLLLIGALLGMDTRIGAPKALWPSENIIAQAHSLAEKSGARLLLTDNPKEAVRGTDFIHTDVWVSMGEPKEVWQERIDLLRGYRVTADLMAAAGNPQVKFMHCLPAFHNRETKVGEWIYKTFGLDGVEVT

SEQ ID NO: 23909 - protein, 182 aa, Trichoderma atroviride
  misc_feature (56)..(56): Xaa can be any naturally occurring amino acid
QRQAEGKPTDKPNIIMSSAVQVCWEKAARYFEVEEKYVYCTPDRYTIDPQQAVDLXDENTIGIAAILGTTYTGHYEDVKGINDLLEEKGLDVSIHVDAASGGFVAPFVLPDLEWDFRLPRVVSINASGHKYGLVYPGVGWVVWRSHEYLPQDLIFNINYLGAEQSSFTLNFSKGASQVIGQY

SEQ ID NO: 23910 - protein, 327 aa, Trichoderma viride
  misc_feature (9)..(9): Xaa can be any naturally occurring amino acid
  misc_feature (33)..(33): Xaa can be any naturally occurring amino acid
  misc_feature (59)..(59): Xaa can be any naturally occurring amino acid
  misc_feature (79)..(79): Xaa can be any naturally occurring amino acid
  misc_feature (118)..(118): Xaa can be any naturally occurring amino acid
  misc_feature (128)..(128): Xaa can be any naturally occurring amino acid
  misc_feature (137)..(137): Xaa can be any naturally occurring amino acid
  misc_feature (139)..(139): Xaa can be any naturally occurring amino acid
  misc_feature (142)..(142): Xaa can be any naturally occurring amino acid
  misc_feature (146)..(147): Xaa can be any naturally occurring amino acid
  misc_feature (151)..(151): Xaa can be any naturally occurring amino acid
  misc_feature (178)..(178): Xaa can be any naturally occurring amino acid
  misc_feature (189)..(189): Xaa can be any naturally occurring amino acid
  misc_feature (232)..(232): Xaa can be any naturally occurring amino acid
  misc_feature (278)..(278): Xaa can be any naturally occurring amino acid
  misc_feature (282)..(282): Xaa can be any naturally occurring amino acid
  misc_feature (310)..(311): Xaa can be any naturally occurring amino acid
  misc_feature (321)..(322): Xaa can be any naturally occurring amino acid
  misc_feature (324)..(325): Xaa can be any naturally occurring amino acid
ENQLKRDKXMQRNEIKMLLLGAGESGKSTILKXMKLIHEGGYSRDERESFKEIIFSNTXQSMRVILEAMESLELPLQDXRMEYHVQTIFIQPAQIEGDVLPPEVGGAIEALWKDHGVXECFKRSREYXLNDSARYYXDXIVXIAGXXYMPXDQDVLRSRVKTTGITETTFIIGDLTYXMFDVGGQRSEXKKWIHCFENVTTILFLVAISEYDQLLFEDETVNRMQEALTLFXSICNSRWFIKTSIILFLNKIDRFKEKLPVSPMKNYFPDYEGGDDYXAACXYILNRFVSLNQHETKQIYTHFTCATDTXXIRFVMAAVNXXIXXDN

SEQ ID NO: 23911 - protein, 232 aa, Neisseria elongata
DQGAGVTYLEPSGSQIGHKESIKDTARVLGRMFDGIEYRGYGQEVVEELACYAGVPVFNGLTDEFHPTQILADLLTMREHSGKTLQQTAYTYVGDARYNMGNSLLLIGALLGMDTRIGAPKALWPSENIIAQAHSLAEKSGARLLLTDNPQEAVRGTDFIHTDVWVSMGEPKEVWQERIDLLRGYRVTADLMAAAGNPQVKFMHCLPAFHNRETKVGEWIYKTFGLDGVEVT

SEQ ID NO: 23912 - protein, 184 aa, Mycoplasma genitalium G37
MDKFLIDVIVEIPKNSKIKYEYDRQTGQIRVDRILFGSESYPQNYGFIKNTLDWDGDELDCFIFADQPFLPATVVPTRIVGALEMIDDGEIDTKLLGVIDCDPRYKEINQISDLPKHRIEEILIFLKTYKLLQKKTVIIKGLKDVCWAKKEYEICLQLMKDYGHLSKDQFIQKMQILHPEHYQK

SEQ ID NO: 23913 - protein, 144 aa, Burkholderia vietnamiensis G4
MAYSDKVLDHYENPRNVGSFDAGADDVGTGMVGAPACGDVMRLQIRVNADGVIEDARFKTYGCGSAIASSSLVTEWVRGRTLDEALAIKNTDIAEELALPPVKIHCSILAEDAIKAAVADFRSRHPGAGGETLAEQPVCTSTPN

SEQ ID NO: 23914 - protein, 110 aa, Zea mays
  misc_feature (15)..(15): Xaa can be any naturally occurring amino acid
  misc_feature (30)..(30): Xaa can be any naturally occurring amino acid
  misc_feature (81)..(81): Xaa can be any naturally occurring amino acid
TVGIGERYEQRGYKXLAAIKLVTASKEHPXTHYEDLVGEPFFPGLGAYKASGPICDMAWEGPDFVKTGRVLLGATNPLVSXPGTIRGDNDIHLGRNVGHGFYSVQICPEG

SEQ ID NO: 23915 - protein, 635 aa, Arabidopsis thaliana
MEGTLDEENLVFETTKGIKPIKSFDDMGMNDKVLRGVYDYGYKKPSEIQQRALVPILKGRDVIAQAQSGTGKTSMIAISVCQIVNISSRKVQVLVLSPSRELASQTEKTIQAIGAHTNIQAHACIGGKSIGEDIKKLERGVHAVSGTPGRVYDMIKRGSLQTKAVKLLVLDESDEMLSKGLKDQIYDVYRALPHDIQVCLISATLPQEILEMTEKFMTDPVRILVKPDELTLEGIKQYYVDVDKEEWKFDTLCDLYGRLTINQAIIFCNTRQKVDWLTEKMRSSNFIVSSMHGDKRQKERDDIMNQFRSFKSRVLIASDVWARGIDVQTVSHVINYDIPNNPELYIHRIGRAGRFGREGVAINFVKSSDMKDLKDIERHYGNEDEDHERAYEASQFSFATYSFRNLFSIFFFSSDITSLSVYLGGDTLSEQRRTMFIQTQSTPNPSSLMFSPGKPVMEIGSADFPNSRSAMSSPLAKAIFAIDGVVRVFYGSDFVTVTKSDDVTWDILKPDIFAVVMDFYSSGQPLFLDSQATAAKDTAIHEDDSETVAMIKELLETRIRPSVQDDGGDIEYCGFDTETGIVKLRMQGACSGCPSSSVTLKSGIENMLMHYVSEVKGVEQEFDGEEEGTSSGPME

SEQ ID NO: 23916 - protein, 557 aa, Cryptococcus neoformans var. neoformans JEC21
MTGTNEQFHHFNRPVRNVAIIGSGPSGTPAARQLRDAGLNVRVFERQNKPGGIWNWRPSVSLPLAVPTPPPSVGAFTPVIRGTGVYEDPGRVEREKFNPPNPCYWSLNNNVPTSTMAFKDFPYPPGTQSNVSHALISSYVQSYVKNYGIDQITSYNTRVERAEKIGDTWKLTLRKVVDEGEDRVREEYWTEEFDAVVAASGHYNAPYIPPFEGSDAWSAAWPQQLIHSQGYRKPEPYTGKTVLIVGIGTSGNDIAKDISPYASKIYMVGRNTLRGPQQYRELRKMQRHFAPPNSEILPEIRRFRLPSPGQAINEGSIELTNGRIITGVNEIIFATGYQYSYPFLPQYHQDSTMVNPAFPTVTPVVTNGDGVLNLYRDVFYIPDPTLTFLGLSVNTSAFSFFEYQALSIARVFAGTARLPDESSRWKAYRNLVREKGEGKFSHLLGKDGERSYVHETVQWLNRDAEWSGASKVEGHTIEWLTESDKIPLLIASKFGLDAAGLKALREKPSDIPEEDTAQPVETERSIGLFGDKFKTATEETNARTSEAFARKAALTSA

SEQ ID NO: 23917 - protein, 366 aa, Chlamydomonas reinhardtii
MQLMRQPTGAAPARASSRAPALPVLPHHRQQRLRHRGLHTCRTASGTTSDKVALESPASNAATDAAPAAAVAHAAAPEDARAIVDEVLKAIEGTDSGLSIDPATRKHVDGLLDKLEALGAAQQPRPLDSPLLWGNYNVAYTSVGRSQERGEPAGGRFRGKIGRALFRTAGLFQSVLQPDIATNKVEFKLFGMLPGFVGLRGRVVPQGDAGDTVQVLFEPPVLAIADKLFLCIAHTAGQGQPRLAVCVHTRRSRGRGGMDQVGLQRTSLTAAALFSAFFVSLFAAGWLLWATANPLGRAAAVAFWLLGAAVGGVVRQGGLVMDREDERMVAAAQAALAEKERKDKERKEEAGGGAEAGAGGVTPAAA

SEQ ID NO: 23918 - protein, 275 aa, Oryza sativa Japonica Group
MMDLSTTSVVAAKAYKYRAESLVKDYLLADCYVSYTAVLGGILMCKMVYDITHLISSLYYKGYGSLTKIQKLEWNNRGMSTVHAMFITLMSVYLVFFSNLFSDELDGPVTVRSSNLSNFTLGVSLGYFIADLAMLSWAYPSLGGMEYVLHHLLSIISLVYAIYSEEGQLYTYMVLISETTTPGINLRWFLDTVGMKRSKAYLVNGVTMFVAWLVARIILFIYLFYHIYFHIDQVKQMRTFSCILIFAVPTILLVMNTVWFVKILRGLKKTLAKRQ

SEQ ID NO: 23919 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 23920 - protein, 462 aa, Triticum aestivum
  misc_feature (380)..(380): Xaa can be any naturally occurring amino acid
  misc_feature (382)..(382): Xaa can be any naturally occurring amino acid
  misc_feature (389)..(389): Xaa can be any naturally occurring amino acid
MPAAHSLLHLAAPKSVAPTSTLSLAGAAHLRLLPSRRPQRLVASCSSAHPDLAAFPNPNGLLVAEPAAAAPIDIDVATEAELRENGSRSTRRTKLVCTVGPATCGPSELEALAVGGMNVARLNMCHGDREWHQKVISSVRMLNEEKGYAVAVMMDTEGSEIHMGDLGGAPAAKAEDGEIWTFSVRSFEAPLPELTVHVNYEGFAEDVRVGDDLLVDGGMARFEVVEKLGPDVKCRCTDPGLLLPRANLTFWRDGSVVRAKNAMLPTITSKDWLDIDFGIAEGVDFIAVSFVKSAEVINHLKSYIAARSRGNDIAVIAKIESIDSLTNLEEIIRASDGAMVARGDLGAQIPLEQVPSIQQKIVKLCRQLNKPVVVASQLLXIXDRVPIPXKAEVADVPKHPPMCGSLMLLAITWVSQASGPNMLLKDKWGGGEHMSTTSLFPINIRKVKEWLQAPAATPTNQE

SEQ ID NO: 23921 - protein, 497 aa, Glycine max
METSEWHIERRSSFGSESPLAREAGNVPETGSLSIVVLGASGDLAKKKTFPALFHLYLQGFLPPDEVHIFGYARTKISDDELRNRLRGYLVPKKGASPQQLEDVEKFLQLIKYVSGSYDSEDGFRLLDKEISEHEYLKNSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQIVFREDFGTDGRGGYFDQYGIIRDIIQNHLLQVLCLVAMEKPVSLRPEHIRDEKVKVLESVLPINDDEVVLGQYEGYKDDPTVPDESNTPTFATVVLRIHNERWEGVPFILKAGKALNSRKAEIRVQFKDVPGDIFKCKKQGRNECVIRLQPSEAIYMKLTVKQPGLEMSTVQSELDLSYGQRYQGVTIPEAYERLILDTIRGDQQHFVRRDELKASWQIFTPLLHRIDEGEFKPLPSTRENIKSPKKS

SEQ ID NO: 23922 - protein, 220 aa, Frankia sp. CcI3
MVAGAPRPTIDTAIDAAVPAVVDGTLLVSGQEVMQTWEAPLMRALAAEVTRPGGTVLEVGFGLGLSAGFVQEIGPARHTIIEANPATVRVAEQWARPAGRRGVEIVTGRWQETMPGLGRFDGILFDTYPLDETEVDEYFVRSSTFAEHFFAHAADHLADGGSFTYYSNEIDSVSRRHQRALLRYFRTFSVRVVDGLQPPADCSYWWAPSMAVIVARDPRR

SEQ ID NO: 23923 - protein, 181 aa, Solanum tuberosum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 23924 - protein, 873 aa, Ehrlichia ruminantium str. Gardel
MSERLIYYFSKNKCDGNLKLNHILGSKGANLAEMCNIGISVPPGFTISTAVCSHYNDNKLPDQISYLIQNAIEFLNNEVNLKFGDENNPLLLSVRSGSVSSMPGMLDTILNVGLNDKTVIGLAKKSGDLFAYDSYRRLIQMYAHTVLQVENSFFEEAIYKKKSVSTSKNEKISDPNIFKELIDEFKRIVKLHTNKDFPQDVNEQLYTAIYAVFRSWMNKRAITYRKIHNIPDNLGTAVNVQSMVFGNMSENSATGVVFTRNPSTGTKEIFGEFLISAQGEDVVSGTHSPLPLNKMKDLMPITHNELEQVCKKLELYYRDMQDIEFTIENGKLWILQTRSGKRSIQSAVKIATDMVKEKLISKEEAITRIDHKSFSKLFHPTLESSTNTDIIAYGLPASPGAATGQVVFTPSDAEQLKKEGKNVILIRQETNPEDINGMNSAVGIITLRGGMTSHAAVVARGMGKPCICSVNNIFIDKSEQFFYTNTGIKVYKGDNITINGCNGEVILGVIKTTLPKLDESFYDLMEWVDEIRTLKVMANADTPEDAEISMNFKADGIGLCRTEHMFFSDKRISIVQEMIVSDKKEERAVALEKLEIMQKEDFKKIFTHTLDKQVTIRLLDPPLHEFLPDNDDAIQEISSRTGKSLEKLKNRILYLLEKNPMLGHRGCRLAISYPEIYEMQVKAIFLAIKELQEETGIKEIIPEIMIPLIMSEEEIIVIKELVNNIAKQFDNPKYLLGTMIELPKAALIADKIAKHVQFFSFGTNDLTQTTLGVSRDDSASFIGTYRDLGIIKHDPFETLDTDGVGKLISIAVGLSKKESPDIKIGVCGEHGGNFESIQFFSRLNINYISCSPYRIPIARLIAAQCTIFNKDIN

SEQ ID NO: 23925 - protein, 138 aa, Shorea beccariana
EKNIPVLLGLLSIWNVSFLGYPARTILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 23926 - protein, 267 aa, Zea mays
MDRYQRVEKQREEAPIKENEIRITTQGRMRNYITYATGLLQDKGSDEVVFKAMGRAINKTVMVVELIKRRIVGLHQNTTTGSTDITDMWEPLEEGLLPLETTRHVSMITITLSKKELDTSSIGYQSPLPADEVKPLVKYDNDEDAHSPGGRGRGRGGRGRGRGRGRGRGGRGNGFNDYADAGWEEDHTPAYMGNGYARGRGRSFRGRGRRGGYNNQPEYQQDGGYYEEAPVHAPALGRGRGRGRGPFRGRGRGGNANGVMHAAADSA

SEQ ID NO: 23927 - protein, 690 aa, Xanthomonas campestris pv. campestris str. 8004
MLPGFDGLRFSHWQADMREDGVLVLSLDRQGAAVNAFSQDVLLELGDVIERLALDPPKGVVLRSAKANGFIAGADLKEFQEFDRRGTVNDAIRRGQQVFQKLAELPCPTVAAIHGFCMGGGTEIALACRYRVASDDGSTRIGLPETKLGIFPGWGGSARLPRLIGAPAAMDLMLTGRTVSAKAARAMGLVDKVAAPAVLVDVAAALALAGTTRPFKQRATAWATNTLLARKLLAPQMRKQVARKARKEHYPAPYALITTWERAGGGGIQARLAAERKAVVKLASTPAARNLIRIFFLTERLKALGGKDTGLPAIRHVHVVGAGVMGGDIAAWAAYKGFEVTLQDREQRFIDTALARGGELFGKRVKDETKRPAVAARLRGDLAGSGVAQADLIIEAIIENPQAKRDLYQSIEPHLKPDALLTTNTSSIPLTELRGHIQRPAQFAGLHYFNPVAMMPLVEIVQHDGLDPANVARLAAFCKALDKFPVPVAGTPGFLVNRVLFPYLLEASTAYAEGIPGPVLDKTAVKFGMPMGPIELIDTVGLDVAAGVGAELAPFLGLPIPAALATVEAGKRGKKDGQGLYKWENGRAVKPEVASGYEVPTDLEDRLILPLLNEAVACLHEGVVADADLLDAGVIFGTGFAPFRGGPIQHIRSVGADALLARLHALQARYGERFVPRPGWESPVLREPVA

SEQ ID NO: 23928 - protein, 867 aa, Oryza sativa
  misc_feature (294)..(294): Xaa can be any naturally occurring amino acid
SSKVASRQAVHQHTTDRSLDHLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEXPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVIL

SEQ ID NO: 23929 - protein, 177 aa, Zea mays
MAQPHLVLPSPRPLLPAAATPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTQNKSKLGANAILGVSLSVCRAGAGAKGVPLYKH

SEQ ID NO: 23930 - protein, 266 aa, Cucumis sativus
AKRLKAEAVKDSKSLVLSMDDNEEVIDEFQGVKIWWTSSKTVPKTQSISYYPTSEERRFYKLTFHRRHRETILDSFINHIMEEGKAVELKNRQRKLYMNHSGESWRHKSSWRHVPFEHPANFRTLAMDPKKKQEIVNDLVKFKKGKEYYEKVGKAWKRGYLLYGPPGTGKSTMIAAMANFMEYDVYDLELTSVKDNTELKKLLIEISNKSIIVIEDIDCSLDLTGQRKKKKKTEEEGDEAKEIEKKAKEEEKKESKVTLSGLLNFI

SEQ ID NO: 23931 - protein, 251 aa, Bradyrhizobium japonicum USDA 110
MTDAIRPLIAGNWKMNGLKASAAEFDAMLNGAADVATKADLLVCPPATLIAAFADKARGKKVAVGAQDCHPKASGAHTGDIAAEMLANAGATAIIVGHSERRADHGEGDALVRQKAEAAWRAGVTAIVCIGETQAQRDAGQTLDILRGQLDGSLPDGSTAANLVVAYEPVWAIGTGLTPTVQDVEQIHGFIREFLTSRFSVDGAKMRILYGGSVKPSNAAELMAVKNVNGALVGGASLKAADFLAIAKGCP

SEQ ID NO: 23932 - protein, 824 aa, Oryza sativa Japonica Group
MAPVFFLLLFSQIFLCTAVDTINSTTPLSGTQKIVSKGGRFALGFYTPPQGNNTASGTGNYYIAIWYNNIPLQTTVWTANSDVPVSDPTTASLSIGSDGNLVLLDQSKNRQLWSTNVSVASNSTVAVIQDGGSLDLMDATNSSIVYWRSIDHPTNTWLPGGKLGLNKTTGVSQRLVPWRNNANPSPGLFSLELDPNGTTQYFIQWNDSITYWTSGPWNGNIFSLVPEMTAGYNYNFRFINNVSESYFIYSMKDDSIISRFTIDVNGQIKQWTWVPASENWILFWSQPRTQCEVYGLCGAYGSCNLNVLPFCNCIKGFSQKFQSDWDLQDFTGGCKRNVPLQCQTNSSSAQTQPDKFYSMVSVRLPDNAQSAVAASSQACQVACLNNCSCNAYTYNSSGCFVWHGDLINLQDQYNGNGGGTLFLRLAASELPDSKKSKKMIIGAVVGGVAAALIILAIVLFIVFQKCRRDRTLRISKTTGGALIAFRYSDLQHVTSNFSEKLGGGAFGTVFKGKLPDSTAIAVKRLDGLSQGEKQFRAEVSTIGTIQHVNLVRLLGFCSEGSRRLLVYEYMPKGSLELQLFHGETTALNWAIRYQIALGTARGLNYLHEKCRDCIIHCDVKPDNILLDESFVPKVSDFGLAKLLGRDFSRVLTTMRGTRGYLAPEWISGVPITPKADVFSYGMMLFELISGRRNADLGEEGKSSFFPTLAVNKLQEGDVQTLLDPRLNGDASADELTKACKVACWCIQDDENGRPTMGQVVQILEGFLDVNMPPVPRSLKVLDESPDVINFFSDVSSSQTSQMHNSTASSQTKSSTSGGSQFQST

SEQ ID NO: 23933 - protein, 586 aa, Frankia sp. EAN1pec
MTSPARPPRAARPQSPSRPKGQGQWALGYSEPLNPNERMKKDQDGLAVRERILNEYPHTGFDGIDPQDLRGRFRWWGLYTQRRPGISGGRTAVLEPEELDDRYFMQRIRLDGGRMTSEQLRIIADISTRYGRDVADVTDRQNIQLHWIRIEDVPAIWGALEAAGMTTEESCGDTPRVILGCPLAGVDADEVIDATGVIDQVVERFVGDTTLSNLPRKFKSAMSGCPDQCTLHEINDIAFVGVVHPELGPGYDLWVGGGLSTNPKLGVRLGTFVTPERVPEVWHGVIQLFRDYGYRRMRTRARLKFLVADMGVEWVRSTLEKEYLDAALPDGPAPLPPRNEGRDHIGVHQQRDGFFAVGFAPRAGRLTGTTLTAVANLADRFGQGRIRATTTQKLVILDVPGEDLDALEAELAALDLVVRPSVFRRGTMACTGIEFCKLAIVETKGNARDLIVELERRLPDFDEPIGININGCPNACARFQVADIGLKGSLVPDDNGEMVEGFQVHLGGHLGTRSRLGRKSRGLKVTADGLVDYVVGLLETYQEHRADGDTFADWAERADEALLTGVGSGSASAGPAAGRRAEGGAT

SEQ ID NO: 23934 - protein, 232 aa, Neisseria elongata
DQGAALTYLEPSGTQIGHKESIKDTARVLGRMFDGIEYRGYGQEVVEELACYPGVPVFNGLTDEFHPTQILADLFTMREHSGKTLQQTAYTYVGDARYNMGNSLLLIGALLGMDTRIGAPKALWPSENIIAQAHSLAEKSGARLLLTDNPQEAVRGTDFIHTDVWVSMGEPKEVWQERIDLLRGYRVTADLMAAAGNPQVKFMHCLPAFHNRETKVGEWIYKTFGLDGVEVT

SEQ ID NO: 23935 - protein, 310 aa, Escherichia coli
  misc_feature (12)..(12): Xaa can be any naturally occurring amino acid
  misc_feature (46)..(46): Xaa can be any naturally occurring amino acid
  misc_feature (176)..(176): Xaa can be any naturally occurring amino acid
  misc_feature (223)..(223): Xaa can be any naturally occurring amino acid
  misc_feature (243)..(243): Xaa can be any naturally occurring amino acid
  misc_feature (275)..(275): Xaa can be any naturally occurring amino acid
SGRENLYFQGHXKPQVYHVDAFTSQPFRGNSAGVVFPADNLSEAQXQLIARELGHSETAFLLHSDDSDVRIRYFTPTVEVPICGHATVAAHYVRAKVLGLGNCTIWQTSLAGKHRVTIEKHNDDYRISLEQGTPGFEPPLEGETRAAIINALHLTEDDILPGLPIQVATTGHSKVXIPLKPEVDIDALSPDLNALTAISKKIGCNGFFPFQIRPGKNETDGRXFSPAIGIVEDPVTGNANGPXGAWLVHHNVLPHDGNVLRVKGHQGRALGRDGXIEVTVTIRDNQPEKVTISGTAVILFHAEWAIELGS

SEQ ID NO: 23936 - protein, 247 aa, uncultured archaeon GZfos26D8
MKEEIELIKDGKRLDGRGFDELRPIKIEVGVLKRADGSCYLELGDNKVIAAVYGPREMHPRHAQDAKMAVVKFRYNMAPFSTDDRKRPGPDRRSVEISKVCREAFDPVIMRELYPKTGIEVYVELLQSDAGTRTAGINAASIALADAGIPMKDLVSSIAVGKIGGEMVLDLNAAEDNNGEADMPIAMIARTNTITALQMDGRLTKEEFGRGLKLAMGACHQIYELQRTALVTRYNQNYESKSKREVE

SEQ ID NO: 23937 - protein, 384 aa, Burkholderia vietnamiensis G4
MIYLDHNATTAPAPAAIDAMLAVLTDVWANASSQHGAGQQAKRTLAAARATIAGALGCKAREVVFTSGATEANHLAVLGLGASATASAVRRRLVFGATEHAAQLKLAHALAAQGRPVDFIAVRPDGVLDLDSAARVIGPDVALVSVMAANNETGVLMPIADVKALAQAAGALLHVDATQLVGKLPFDFAALGADAVSLSAHKLHGPKGIGALLVRDGVPLAAQFPGSQERHRRGGTENLPAIVGFAAALERLADVLADAARIAALRDAFEAGLRAALPGVHVYGASAPRLPGTSCLRVGRLDADTVLQRCEQIGVCASSGSACSSGGSEPSHVLSAMGVPRDEALGAVRFSLGAATTARDIDYLLAALPPLLKPLLAEAAVQPT

SEQ ID NO: 23938 - protein, 126 aa, Arabidopsis thaliana
MGHHHHHHLEAEVHNQLEIKFRLTDGSDIGPKAFPDATTVSALKETVISEWPREKENGPKTVKEVKLISAGKVLENSKTVKDYRSPVSNLAGAVTTMHVIIQAPVTEKEKKPKGDPKMNKCVCSVM

SEQ ID NO: 23939 - protein, 441 aa, Cryptococcus neoformans var. neoformans JEC21
MAKSAKSAPAATVKVDKKDKKSKKDEKPVPAPAPAKAAKKDVKEKKEKKSKKAKTPTPPPESSTSESEDSEEDSSDSESSSSEDEKPAAKTAAPAAKAKEEEPSTEESSDSDSESEEEFKTETKKEVNEESESDSDSDSGSDSNSSEDEDEKVEETKEEAKPQANGNKRKAEEESIAPAKKARADGGDEEATTNVFVGQLSWNVDNDWLKSEFESCGEVVSARVVFDRDSQKSRGFGYVEFADLESSAKAIEKDGSEIDGRAIRVNYATQRKPNEAAEKRARVFNDKQSPPAETLWIGSLSFSVTEDQVYEAFGQHGDVQSVRLPTDRDTGAPKGFGYVQFSSVDDASAALKAMNGAEIAGRAIRVDFAPPKQDNGERGGFGGGRGGGGFGGRGGGRGGGRGRGGFDRGGRGGGRGRGGPPRGGARTGGIVKPEGQKVTFD

SEQ ID NO: 23940 - protein, 367 aa, Oryza sativa Japonica Group
PTQRRILRGRGARGESGERHDAGSARPARQRGPPSIQTKPPLRISSGPSFLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGFMAILLSHYRPSGTIFAFTDQERVRQRLALYQGVCPVQMEFSDDAEKTFGDALSYLLKHGMVKEGEEVALVQSGRQPIWRSQSTHNIQVRKV

SEQ ID NO: 23941 - protein, 817 aa, Oryza sativa
MLSVDVFIGLLLLSLHAPPYSAAVDDTLAAGQVLAVGEKLVSRNGKFALGFFQPSAIAISKSSNYTNALGWYLAIWFNKIPVFTTVWVANRERPITVPRLNSTWLKMSGDGNLYILDHATNSIIWSTDHVVNTTTETGMNTSATLLNSGNLVIRNPSGVVSWQSFDNPTDVVLPGAKFGWNKATGLNRLGISKKSLIDPGLGSYSVELDTTGARGLILKHRNPSMEYWSSDRALIIPVLKSLFEMDPRTRGLITPAYVDNSEEEYYIYTMSDESSSVFVSLDVNGQIKMYVWSRANQSWQSIYAQPVDPCTPSATCGPFTICNGNSTQTCDCMESFSVKSLWDWELDDRTGGCIRDTPLHCVSDKNMTSSTDMFQPIGLVTLPYDPQIMQDATTQGECAQACLSDCSCTAYSYQNSRCSVWHGKLLNVNKNDGIYINADNVLHLRLAATDFQDLSKNKRKTNVELVVGASIVSFVLALIMILLMIRGNKFKCCGAPFHDNEGRGGIIAFRYTDLAHATKNFSEKLGAGGFGSVFKGVLTNMATIAVKKLDGAHQGEKQFRAEVSSIGIIQHINLVKLIGYCCEGDKRLLVYEHMLNGSLDVHLFQSHAAVLNWITMHQIAIGVARGLSYLHESCRECIIHCDIKPENILLDISYFPKLADFGMATFVGRDFSRVLTTFRGTVGYLAPEWISGVAITPKVDVYSFGMVLFEIISGRRNSPEVHTSGNYDATYFPVRAINKLHEGDMSSLVDPRLHGDYNLDEVVRVCKVACWCIQDDEFDRPTMREVVRVLEGLQELDMPPMPRLLATLTNFSAVASM

SEQ ID NO: 23942 - protein, 379 aa, Cryptococcus neoformans var. neoformans JEC21
MFARSASKSVVSSLRTVQAPVGVRYYASAFNSSTPTSAFAGKKGADGNYTVTLIPGDGIGPEIANSVKQIFKAAQVPIVWEEVDVTPILKDGKTVIPDDAIKSIKKNTVALKGPLATPIGKGHVSLNLTLRRTFSLFANVRPCVSIKGYKTPYDNVNTVLIRENTEGEYSGIEHEIVDGVVQSIKLITREASERVARYAFHYASESGRNKVTAVHKANIMKMSDGMFLTACRDVAKEYPNISYDEDLLDRVCLRIASDPSPFADRVMVMPNLYGDILSDLSAGLIGGLGLTPSGNIGKDASIFEAVHGSAPDIEGKGLANPTALLLSSLMMLRHMSLYELADKIEKAALSTIAEGKAITRDLGGKAGTKEYTDAILSKL

SEQ ID NO: 23943 - protein, 304 aa, Salmonella enterica subsp. enterica serovar Paratyphi A str.
MDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRSVY

SEQ ID NO: 23944 - protein, 211 aa, Staphylococcus aureus
PSADMLFEPSFVNDIDVNENDVVHFCSVDLVDSPMRDAHYQLIIKTLNANGTVVFDPNVRLPLWDNAEDLRQTIHTFLPLAHIVKVSDEELEFITGIYDENEAIQSLFTGNVTVVIYTKGADGAAVYLKNGISHYHSGYKVKPIDTTGAGDAFIGAVISRILATDVLNLTQLFENEGEEILAFSNRVAAIVTTKYGAINSLPTLQEVEQAF

SEQ ID NO: 23945 - protein, 107 aa, Alstroemeria peruviana
GLAENQLSLDLVRDWLARNLKDSLMGGEHGGLGIGGLAAYQPFDGLMDLKMAVAGFMGQVMQGSISFNPSQIILTAGATPAIEILSFCLADPGNAFLVPSPYYPGFD

SEQ ID NO: 23946 - protein, 400 aa, Candidatus Pelagibacter ubique HTCC1002
MKIRPVILCGGAGTRLWPNSKNHQAKQFIDFGNWTLLGKTLERVKSSTFDVPIISTNLKYLKEVKKHLKKHKISKYKIVLEPAKRNTAPAILASALIKDIPNEQPLMFFAADHLIEKANIFNKAINKNKTNLTDQNIFIFGIKPTSPSSEYGYFLTKKVKGNINKVTKFIEKPKEAKAKQVIKQKGYWNSGMFFLRKDSIINNFKKYQPTMYKNCLNAVSKAKLKDNTYYLNKTSFEKATAKSFDYAILEKTKQINAIKLDIPWSDLGSWKEILKMYDKNKNKYYKKKNVYYRPWGRYVNLFEGKGFLIKELFVKPKGVLSLQKHHHRSEHWFVTQGTPKITLNKDSFFRKKNDHIFIPLEAIHRIENKGTKPVKIIEAQVGSILKEGDIVRFQDVYGRT

SEQ ID NO: 23947 - protein, 161 aa, Alstroemeria peruviana
RAENQLCLDLMEEWVKKNPEASICTAEGAPWFKAIANFQDYHGLQSLREAIAKFMQKVRGGRAAFDPDRIVMSGGATGAQELISFCLADPGDAFLIPTPYYPGFDRDFRWRTRVQLLPVHCHSSNGFKLTRTALESALKLAQDANIRVKGVLITNPSNPLG

SEQ ID NO: 23948 - protein, 480 aa, Frankia sp. CcI3
MADPTGFLKHRRELPKRRPVDVRITDWREVYESFPEEHLRTQASRCMDCGIPFCHEGCPLGNIIPEWNDLTRRGDWVDAIERLHATNNFPEFTGRLCPAPCEAACVLGIGDDPVTIKQIEVSIIDRAWADGTVVPVPPSLRTGKRVAVVGSGPAGLAAAQQLTRAGHEVVVYERADRIGGLLRYGIPEFKMEKRVLDRRLAQMAAEGTSFVTSCNVGLDISADELRSSHDAVVLAGGSTVGRDLPVPGRQLGGVQLAMEFLVPANRVAQGDLPESPISAKGKNVVIIGGGDTGADCLGTSHRQGALSVHQLEIMPRPPELRAPANPWPSYPIIYRVSSAHEEGGERVFAVSTERFLGDEDGNVRALRMHEVRLVGGKFEKVEGTDTELPCQLVLLAMGFTGPERSGLLTDLGVELDARGNVARDAGWASSVPGVFVAGDMGRGQSLIVWAIAEGRAAAAATDRWLMGRTDLPEPITPTRR

SEQ ID NO: 23949 - protein, 203 aa, Helianthus annuus
PYGFSVIEKFLAGARSIDQHFHSAPFESNIPVLLGLLSLWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 23950 - protein, 501 aa, Ashbya gossypii ATCC 10895
MESRLGWLTRLNYDTGSALRRTSIIGTIGPKTNNPETLVELRKAGLNIVRMNFSHGSYEYHQSVIDNARKSEELYPGRPLAIALDTKGPEIRTGTTVDNVDYPIPPNHEMIFTTDDQYAKSCDDKVMFVDYKNITKVIEKGRVIYVDDGVLSFEVLEVVDDKTLKVKSLNAGKICSHKGVNLPGTDVDLPALSEKDKSDLRFGVKNGVHMVFASFIRTAGDILTIREILGEDGKDIKIIAKIENQQGVNNFDEILKVTDGVMVARGDLGIEIPAPQVFAVQKMLIAKCNLAGKPVICATQMLESMTYNPRPTRAEVSDVGNAVLDGADCVMLSGETAKGIYPINAVKTMAETALIAEQAIPYVPTYDDLRNLTPKPTPTSETIAAAAVAATFEQKAKAIVVLSTSGDTTRLVSKYKPNVPIVMVTRNPRAARYCHLHRGVFPFVYEQEAADEWTDDVEARLNFGVEKSKELGILSEGDTIVTIQGFASGVGHSNTLRVLTV

SEQ ID NO: 23951 - protein, 297 aa, Fusobacterium nucleatum subsp. nucleatum ATCC 25586
MNDFQVYLKEKTDFFETELKKELKELSYPETIAKGMEYAILNGGKRLRPFLLFVTLELLNENINKGVKSAIALEMIHSYSLVHDDLPALDNDDYRRGKLTTHKVFGEAEGILIGDSLLTYAFYVLSQKNLELLSSKQIVNIISKTSEYAGIDGMIGGQMIDIQSENKKIDLETLKYIHSHKTGKLIKLPIEIACIIANLEKDKREVLEEYADLIGLAFQVKDDILDVEGTFEDLGKPVGSDVDLHKATYPSILGMEESKKILNNTVEKAKEIIKNKFGEEKGKVLISLADFIKDRKK

SEQ ID NO: 23952 - protein, 178 aa, Prochlorococcus marinus str. MIT 9211
MSDSKSQQSSEVPTLLVRDSNNSELLCFLEQIVPINNIEYVLLTPVDTPVCLFHLLDEGDPELIKTIEKKEPVLEVADVVLQEHDLRLIRSAVTLTVSGELEEPEPEELEEKDFDDESETYELLVSFKVEEEEYGLYIPLDPFFVVGKLEDGQATVVEGDEFDKIQPLIESELEERDN

SEQ ID NO: 23953 - protein, 270 aa, Methanopyrus kandleri AV19
MISYLGPPGTFTEEAAERFSEEELGGNGKLQSARTITAVFSRVERGEADYGVVPWENSLEGSVGETLDNFLHRSVRVFGELVLPIVHALMSGSEPDDREPVVYSHPQAYEQARETLRELLGNHEFVPTASTAEAAKLASKEGAYALGPPRLAERFGLDIMEEIRLENNETRFAIISRRDRAPTKEDKTSVVFSVTDRPGALREILGIFADRGINLTKIESRPAKRGLGDYVFFLDFEGHRMLYPGSEALAELRERTPFSKVLGSYPKVFP

SEQ ID NO: 23954 - protein, 151 aa, Leptospira interrogans serovar Copenhageni str. Fiocruz L1-130
MIQELKADLNGKGQKHCVIVSRFNEFITESLLKGALESFRMHGVEDVTVVRVPGAYEMPVVVSKAAASKKYDSIVCLGAVIRGATAHFDLVAGESAKIGSIGVQHSIPVIFGVLTTDTIEQAIERAGTKAGNKGAEAAATAVEMVNLLSLL

SEQ ID NO: 23955 - protein, 132 aa, Glycine max
MESEALIWGDKLILKGLSFHGFHGALPEERKLGQKFVVDVDAWMDLKAAGKSDHLSDTISYTDIYDIAKEILEGSPQNLLESVAQKIAVTTLTNHKQISAVRVKVEKPHVAVQGPLDYLGVEILRRRSDLSE

SEQ ID NO: 23956 - protein, 413 aa, Kluyvera cryocrescens
MAESSPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVELPKASMYVWAKIPDKYAAMGSLEFAKKLLQDAKVCVSPGIGFGEYGDTHVRFALIENRDRIRQAIRGIKAMFRADGLLPSEHKSRIDFCVA

SEQ ID NO: 23957 - protein, 257 aa, Oryza sativa Japonica Group
MLRPAAAAAGRAIRRAAYHSDGAPPPRKLRGPRFSPLNRHNHEAGQWGEAGEEVGAVAAAGVGGGCDGGEWRASASAAAATWEKGRASPHGRGGAEVVHGGERAGARPPVEEDLPRRRWCMPSAASDDATLGRHLACRLVQVGISDVFAVPGDLNLTLLDHLIAEPGLRVVDCCNELNTGYAANGYAWARGMGTCTVTFTVCGLLLHGRRHRSHWFWNQETGDEAGAAFRNQERASASPSLPSAVARRSGSVVVGGG

SEQ ID NO: 23958 - protein, 199 aa, Oryza sativa Japonica Group
MAAADTDTYVTEVAFGDAVITTTVTSSGAAVEGWLREVRAAYGPGLIVGLDVEWRPSYGPAQNPVALLQLCVDRRCLIFQLLYADYVPGSLRRFLAGAADCFVGVGVDKDAERLSDDHGLTVANTADLRPLAAQRLGRPELSQAGLQAVVRAVMGADLVKPQRVTMSRWDASCLSNEQIRYACIDAYVSFEVGRRLLRA

SEQ ID NO: 23959 - protein, 360 aa, Prochlorococcus marinus str. MIT 9211
MKTYNVVLLPGDGIGPEIMDVATKTIDYVAQKYNFGIEYEQKLIGGSAIDKYNDPLPEETLKACKSSDAVLLSAIGSPKYDALPREKRPESGLLNLRSGLGLFANIRPVKVWPALISESSLKQEIVQNVDLVVVRELTGGIYFGQPKGRLQSENGERAFNTMTYSTMEIDRIARVAFELATDRKKKLCSIDKANVLDVSQLWRERVIELSYNFPKVELNHLYVDNAAMQLIRQPDQFDVILTGNLFGDIISDEAAMLTGSIGMLPSASLRLEGPGLFEPVHGSAPDIANKDIANPMAMVLSAAMMLRVGLKENNAADDLENAIDKVLKDGYRTSDLMTNGKKVLGCREMGEQILMSLAAA

SEQ ID NO: 23960 - protein, 300 aa, Prochlorococcus marinus str. MIT 9211
MSKRHPVVAVTGSSGAGTSTVKRAFEHIFAREEIVPAVVEGDSYHRFERNPMKQAMADALAKGENFSHFGPEANLFDKLEELFKEYGQTGGGKKRYYLHSQEEADEHNARLGTELSPGQFTPWEEIPTGTDVLFYEGLHGGVVGDGYDVASLADLLVGVVPITNLEWIQKIHRDNAERGYSAETIVDTILRRMPDYINHICPQFSRTDINFQRVPTIDTSNPFICRNIPTPDESFVIIHFRKGAREKWGIDFQYLLGMINESFMSSPTSIVVNGGKMGFAMELILTPIIHRMIEEKSKAK

SEQ ID NO: 23961 - protein, 280 aa, Listeria innocua Clip11262
MTLSFSDTYRLNNGIEMPRHGFGVYKLTDEQRMRTALETAVDVGYRLFDTASFYHNEKELGDFFASSGLKRDEFFVTTKMWNTEQGYDETLRAFEKSQKKLQLDQVDLYLVHWPKQDTFFETWRAVEKLYDEGLVRAIGVSNFEAHHLDRLRTSANVLPVVDQLETHPHFPNQLLHRYLEELHIVHQAWSPLGRGGVLQEQILIDLAKKHGKSPAQIVLRWHLQNNISIIPKSETPSRIRENADIYDFELTEADMRQVERLNNGERVSHAPDVMYVRSEI

SEQ ID NO: 23962 - protein, 135 aa, Brassica napus
MQRLAPLMEEPMDQEEQERGGGSIRTKSWKKWIKTQLQSMIIHKKPDAKVLLSVLGCPLFPVPPLSKMSLQQVSSSAQYIIQHFAAATGCKKLERGIKNTFVTGKITMTMMNDLSGSATVNASPVSQKGCFVMWQ

SEQ ID NO: 23963 - protein, 202 aa, Triticum aestivum
MDRHGHGHGQHHRLVTMPREGEAASSYAGGGVDVVAREAAAQALGAVVQLHFDKTVEKKRSADAQKQELWRLFLAFFLFLALVLSAVSGGGRLQCRHLWAPAGLLSLAHLAFYAAVAHHLRCLNGFRYQRRCHKLTLALAADRLRMLKSAGEVVAAADVEVPYQEPHDTYLAKFKRSWAIHFAFLIATFAFSVAAAVAVLCF

SEQ ID NO: 23964 - protein, 409 aa, Zea mays
MASQGSSVFAALEQAPEDPILGVTVAYNKDPSPMKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLMEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCRSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 23965 - protein, 228 aa, uncultured cyanobacterium
HEVAGAGQHELGMKFAELIQAADNTMTYKYVVRNVAKKYGKTATFMPKPVFNDNGSGMHVHQSLWKGGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALETLNADHHYLMEGGVFTQ

SEQ ID NO: 23966 - protein, 228 aa, uncultured cyanobacterium
HHEVATAQHELGMKFAELIQAADNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 23967 - protein, 228 aa, uncultured cyanobacterium
HEVAGAGQHELGIKFAELIQAADNVMTYKYVVRNVAKKYGKTATFMPKPVFNDNGSGMHVHQSLWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 23968 - protein, 228 aa, uncultured cyanobacterium
QHEVATAQHELGMKFAELIQAADNVMIYKYVVRNVAKKYGKTATFMPKPIFADNGSGMHVHQSLWKASQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIENQIDPGAGVDVDLFELPADELAKIATVPASLNGALEALRADHHYLLEGGVFTK

SEQ ID NO: 23969 - protein, 190 aa, Glycine max
  misc_feature (33)..(35): Xaa can be any naturally occurring amino acid
  misc_feature (37)..(37): Xaa can be any naturally occurring amino acid
  misc_feature (39)..(40): Xaa can be any naturally occurring amino acid
  misc_feature (47)..(52): Xaa can be any naturally occurring amino acid
  misc_feature (59)..(61): Xaa can be any naturally occurring amino acid
  misc_feature (64)..(64): Xaa can be any naturally occurring amino acid
  misc_feature (67)..(68): Xaa can be any naturally occurring amino acid
  misc_feature (70)..(70): Xaa can be any naturally occurring amino acid
MLLLLLLLIHSLLITQSTPCRTSCGDIPMGGGXXXPXFXXHTNKNNXXXXXXTPPGRTXXXKNXGHXXSXADPHILITDPFMWNCDDGENYRPTRPFSLDTSTRFKLSPHNEYLFFNCSEDHVIVKPKPIFCERFPERCDSSCDSGSYLCRHMPGCSFAMSGSSCCSYSPRATESLRLMLKYCTSYTSVY

SEQ ID NO: 23970 - protein, 228 aa, uncultured cyanobacterium
HEVAGAGQHELGMKFAELIQAADNTMTYKYVVRNVAKKYGKTATFMPKPVFNDNGTGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQVDPGAPTNVDLFELSAERLSEIDTVPASLNGALEALNADHHYLMEGGVFTK

SEQ ID NO: 23971 - protein, 366 aa, Arabidopsis thaliana
MTTISDLPEDVVEEILPRVPLTSLSAVRSICKTWNTLSKNRVLCKAAVKKQFLGFIMMDYRVCSMKFHLRNDEGGDLVDDLSIKQVGILDQIEISEVLHCDGLLLFVTKDNSSLVVWNPYLGQTRLIQPSNNFHCSDRYAIGYDNNRNLKILRNFSDYGSSGSNKRGVSFKGNTYILAQGKIRVDSRWKIEAILLSFDFTTERFGPRLQLPFGFYYPQDLFSLSCVREEQLVVLHQSWMVSGELEIWITNKIDPGVVSWTKFLRSISCCRISIQAGSFFINEENQVAVVFDLDEYKGSETCRNQTAYIIGQDEYFKSVNIGEAPNLGRPEKYAPHIYCRPLVCSSYVPSLVPLQINQPDTRKESDD

SEQ ID NO: 23972 - protein, 262 aa, Nostoc punctiforme PCC 73102
MSDAYGGLSLRWTLRGKKALITGATKGIGLAVANEFLSLGAEVIIVARNSQDVDQQLIIWRELGLPAYGITADVATAEGRQAIFEQVGKTWDKLDILVNNVGTNISKKVLDYTAAEYQFIIQTNQISIFEMCRLFYPLLQNRENSSIVNISSVAGLVSNRTGAPYGMTKAAINQLTRSLSVEWACDQIRVNTVAPWAIRTPLTESVLDNQDFLKLVLSQTPMGRVGQPEEVAGLVAFLCMPAASFITGQCITVDGGFLAFGF

SEQ ID NO: 23973 - protein, 371 aa, Candidatus Pelagibacter ubique HTCC1002
MNSCFIILAGGESKRFNSNTPKPYTNYKGKPLLLHSIDKAKVFNKFNKIVLVVNKKHKNFIKKLNIKNIKIITGGKTRAESAYNALKSIKENNFKNVIIHDAARPNFSLKLLNKLMNELKSNDCVIPAIQTADTVKQKISNNVKNLKRENIYLIQTPQAFNYKKLYSLQNNKSKEVTDDANLFVRAGKKIKIIKGETTNNKITINSDIKFNNLIKFGIGFDVHRLVPNKKLYIGGIKIPSPIGTLGHSDGDPVLHAVTDAILGACSMGDIGEKFSDKNKKFKNIRSTILLSEIIKQTVKKGYLINNLDINIITQKPKIQKYKKQILNCIAKICNISPTQINIKGKTTEKLGVIGKEKAIACEVIASVIKND

SEQ ID NO: 23974 - protein, 211 aa, Staphylococcus aureus
PSADMLFEPSFVNDIDVNENDVVHFCSVDLIDSPMREAHYQLITKTLNSNGTVVFDPNVRLPLWDNAEDLRQTIHTFLPLAHIVKVSDEELEFITGIHDENEAIQSLFTGNVTVVIYTKGADGAAVYLKNGNNHYHSGYKVKPVDTTGAGDAFIGAVISRILATDVLNLTQLFENEGEEILAFSNRVAAIVTTKYGAINSLPTLQEVEQAF

SEQ ID NO: 23975 - protein, 207 aa, Chlamydomonas reinhardtii
MALQSLRGRSAFSSGRAAPKAFARVQRTCRAASVVASATAVKAPSLPYRVGHGFDLHRLAEGYKLIIGGIDIPHTKGCEAHSDGDVLLHTVTDAILGALCLPDIGQLFPDTDPKWKGARSDIFLKEAVRLMDEKGYVLGNLDCTIIAQKPKLSPHKENIRNNLSAILGADPSVVNIKAKTHEKVDSLGEERSIGCHAVVMLIRKDIA

SEQ ID NO: 23976 - protein, 589 aa, Burkholderia mallei ATCC 23344
MSLIEVKVPDIGDFSGVDVIEVNVKPGDVIEKEQTLITLESDKASMEVPSDVAGTVKEIKIKAGDKVSQGTVIAIVEASAGAAAPAPAKAPEAPKPAAAAPAPAAAPAPAPQAGSSSGSADIECDMLVLGAGPGGYSAAFRAADLGMKTVLVERYSTLGGVCLNVGCIPSKALLHTALVVEEAQALASHGITFGKPQVELDKLRDFKGGVVKKLTTGLAGMAKARKVEVVTGVGAFVDPYHMEVQGENGKKIVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAQAKEDGIYVTFEGEKAPAQAQRYDLVLVAVGRSPNGKKIGADKAGVAVTDRGFIEVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLLFDEETHRVIGGGIVGLNAGDLISEVCLAVEMGADAEDIGKTIHPHPTLGESIGMAAELYEGVCTDLPPQRKK

SEQ ID NO: 23977 - protein, 138 aa, Shorea rubella
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHR

SEQ ID NO: 23978 - protein, 529 aa, Burkholderia mallei ATCC 23344
MSQAIEVKVPDIGDYKDVPVIEVLVKPGDAVEPEQSLVTLESDKATMDVPSPSAGTVKEVKVKVGDAVSQGSLIVLLDGAQAAAQPAQANGAATSAAQPAAAPAAAPAPAAAAGGGTVDVKVPDIGDYKDVPVIEIAVKIGDTVEKEQSLVTLESDKATMDVPSPAAGVVKDIKVKVGDAVSEGSLIVVLEASGGAAASAPQAAPAAAPAPAQAPAPAASGEYRASHASPSVRKFARELGVDVSRVTGTGPKSRITKDDVTAFVKGVMTGQRAAPGAAAAPAGGGELNLLPWPKVDFSKFGPFEAKPLSRIKKISGANLHRNWVMIPHVTNNDEADITELEALRVQLNKEHEKAGVKFTMLAFVIKAVVAALKKFPTFNASLDGDNLVFKQYYHIGFAADTPNGLVVPVIRDADKKGLVDIAKEMAELSKAAREGKLKPDQMQGGCFSISSLGGIGGTHFTPIINAPEVAILGLSRGQMKPVWDGKQFVPRLTLPLSLSYDHRVIDGAEAARFNAYLGALLADFRRIIL

SEQ ID NO: 23979 - protein, 166 aa, Linum usitatissimum
EDKTEWGQRTGWIYGSVTEDVVTGYRMHNRGWKSVYCVTKRDAFRGTAPINLTDRLHQVLRWATGSVEIFFSRNNALLASSRMKFLQRIAYLNVGIYPFTSVLLIVYCFLPALSLFSGQFIVSSLNVTFLVYLLIITITLCMLAVLEIKWSGIELEEWWRNEQFWV

SEQ ID NO: 23980 - protein, 166 aa, Linum usitatissimum
EEKTEWGQRIGWIYGSVTEDVVTGYRMHNRGWKSVYCVTKRDAFRGTAPINLTDRLHQVLRWATGSVEIFFSRNNALLASPRMKLLQRIAYLNVGIYPFTSFFLIVYCFLPALSLFSGQFIVSTLNVTFLAYLLIITVTLCMLAVLEIKWSGIELEEWWRNEQFWV

SEQ ID NO: 23981 - protein, 166 aa, Linum usitatissimum
EDKTEWGDKIGWIYGSVTEDVVTGYRMHNRGWRSVYCVTKRDAFRGTAPINLTDRLHQVLRWATGSIEIFFSKNNPLLASSRLKFRQRIAYLNVGFYPFTSIVLVIYCFLPAWCLFTGSFIVQSLNIAFLCYLLVITVTLTLLSLLEVKWSGIELEELWSNEQFWV

SEQ ID NO: 23982 - protein, 471 aa, Chlamydia trachomatis D/UW-3/CX
MNKHKRFLSLVLLTFILLGIWFCPHSDLIDSKAWHLFAIFTTTIIGIIVQPAPMGAIVIMGISLLLVTKTLTLDQALSGFHSPITWLVFLSFSIAKGVIKTGLGERVAYFFVKILGKSPLGLSYGLVLTDFLLAPAIPSLTARAGGILFPVVMGLSESFGSSVEKGTEKLLGSFLIKVAYQSSVITSAMFLTAMAGNPIISALASHSGVTLTWAIWAKTAILPGIISLACMPFVLFKLFPPQITSCEEAVATAKTRLKEMGPLNQGERIILLIFSLLISLWTFGDSIGISATTTTFIGLSLLILTNILDWQKDVLSNTTAWETFFWFGALIMMASFLSAFGFIHFVGDSVIGSVQGLSWKIGFPILFLIYFYSHYLFASNTAHIAAMYPIFLTVSISLGANPMFAALALAFASNLFGGLTHYGSGPAPLYFGSHFVSVQEWWRSGFILSIVNLTIWLGLGSWWWYCLGLIR

SEQ ID NO: 23983 - protein, 458 aa, Oryza sativa Japonica Group
MSSDRSSKKVCVVGAGMAGLAAARELRREGLDVTVLEQLAGVGGQWLYDAATDAGDPLGMAGVHSSVFASLRINGPRESIGFSDFPFRPTNDAGGDARRYPVHGELLRYIRDFCDAFGLMDAVRLNTTVTRVAMAPPRRDGSLRWAVRSKRHGEAETEEVFDAVVVAIGHYSQPRLPTIDGMDRWRRKQLHSHSYRVPDSFAGEVVVIVGCSVSGAELALELRRVAKEVHLSTKSTEETITSAMSKSVARYENLHLRPQVEHLREDGTVVFDDGSFVVADAVIYCTGYNYSFPFLDTNGKVTVDDNRVGPLYEHVFPPELAPSLSFVGIPGKVVLPVFIEVQARWVAQVLSGRRTLPSPEEMQRAVEEHTRGMEAAGLPKRWTHDMFLNLERCDDYGERICGFPRMEQWKKEIFVSSLSDMVDDIENFRDGYHDSDLVRDALRRHGWTPAEEDDDAHK

SEQ ID NO: 23984 - protein, 375 aa, Neisseria meningitidis
MLECTINYCSGEIMSQTIDELLLPHRNAIDTIDAEILRLLNERAQHAHAIGELKGTGAVYRPEREVAVLRRIQDLNKGPLPDESVARLFREVMSECLAVERPLTIAYLGPQGNVYQQAAIKHFGHAAHTMACPTIDNCFKQVETRQADYLVAPVENSTEGSVGRTLDLLAVTALQACGEVVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 23985 - protein, 619 aa, Oryza sativa Indica Group
MAGTGLRFRQGAIFFSGAHAAAHPRTRTPHHHCSPQRTHDARGRCRLTAKSANGRPQISASFRDVAIDGAQSEDGAPEQGGSTVSITVVGASGDLAKKKIFPALFALYYEDCLPEHFTVFGYARSKMSDEELRNMISLTLTCRIDQRENCSDKMEQFLKRCFYQSGQYNSEEGFSELDRKLKEKETIVVEYTNLYEQIQNGYDCEAHANTYHQAGKVPNRLFYLSIPPNIFVDVVRSASRTASSQDGWTRFIVEKPFGRDSESSGELTRNLKKYLAEEQIFRIDHYLGKELVENLSVLRFSNLVFEPLWSRNYIRNVQLIFSEDFGTEGRGGYFDNYGIIRDIMQNHLLQILALFAMETPVSLDAEDIRNEKIYGTESMEAINLNQVKVLRSMRQLRLEDVVVGQYKGHSKGGKTYPAYVDDPTVPSGSITPTFAAAALFIDNARWDGVPFLMKAGKALHTRRAEIRVQFRRVPGNLYGRRRRSVGGGGTTATRELEKATNELVLRVQPDEAIYLKINSKVPGLGMRLDSSDLNLLYSERYPAEIPDAYERLLLDAIEGERRLFIRSDELDAAWAIFTPVLADLEANKVAPELYPYGSRGPVGAHYLAANHNVRWGDIS

SEQ ID NO: 23986 - protein, 432 aa, Xanthomonas campestris pv. campestris str. ATCC 33913
MTLWVLGLNHQTAPVDLRERAAFAGDALPRALDSLRILPQVREAALLSTCNRTELYAMADDPQTLVAWLDMHAPGLSGYLYQHRDAEAVRHLFRVATGLDSMVLGEPQILGQVKDAWAVARAHGALGSGLDRLFQQTFSVAKRARTDTRVGANPVSVASTAVRLAQESFARLNESTVLLVGAGETIELAAKHLSEGRVRRLLIANRTLAHAQTLATQHGGVALPLTELDRHLAEADVVFSATAAREPVVTRVQVEQALRTRKRKPMLLFDLAVPRDIEASVAELSDAYLYTVDDLERAVEDNRRSRREAADQAEAIIDLQVARYVETLQANERQAPLKRLRAFGDSTRDELLAKARQQLSNGKPADEVLEQLAHALTNRLLHPPTAALRDAALNNDLDLTSAADRLFPEKPGYRHPPVATPIVRTDDANPAP

SEQ ID NO: 23987 - protein, 835 aa, Thermococcus kodakarensis KOD1
MIFGKEDEKVDEIKLRVAEALKRDVGRGIVRFDRKYQRKLGVEPGDIVALKGERVTAAIVANAHPDDRGLDIIRMDGYIRRNAGVSIGDYVTVSRAEVQEAKKVVLAPAQKGVFIQIPGEIVKQNLLGRPVVKGDLVVAGGQNEAVYSPFDELLRGFFEAMPIGFGELKFVVVNTVPKGIVQITYNTEVEVLPQAVEVKEESIPEVTYEDIGGLSDAIQKIREMVELPLKHPELFERLGIEPPKGVLLYGPPGTGKTLLAKAVANEANAHFIAINGPEIMSKFYGESEERLREIFKEAEENAPSIIFIDEIDAIAPKREEVVGEVEKRVVSQLLTLMDGLKSRGKVIVIAATNRPDALDPALRRPGRFDREIEVGVPDKQGRKEILQIHTRGMPLEPDYDKEAVLRVLREIREKGNFDAERVDKIIAEVENAKNESEVKEALKKDAEIYSEVRNRLIDKMLDELAEVTHGFVGADLAALAREAAMVVLRRLIKEGKISPEQERIPPEVLQELRVRRDDFYEALKMVEPSALREVLIEVPNVRWEDIGGLEDVKQELREAVEWPLKYPKAFERLGIEPPKGILLYGPPGTGKTLLAKAVANESQANFIAIRGPEVLSKWVGETEKRIREIFRKARQAAPTVVFIDEIDAIAPARGSEGDRVTDRLINQLLTEMDGIQENSGVVVIGATNRPDIIDPALLRPGRFDRLILVPAPDEKARLEIFKVHTRRVPLAGDVDLRELAKKTEGYTGADIAALVREAALIAMRRIMRELPREVVESESEEFLERLKVSKKDFEMAMKKVKPSVTPYMMEYYRSFEENRKKQAGKERGGPDYYTF

SEQ ID NO: 23988 - protein, 319 aa, Xanthomonas campestris pv. campestris str. ATCC 33913
MQDQRNLLVFSGNANKPLAQSICKELGVRMGKALVTRFSDGEVQVEIEESVRRQEVFVIQPTCAPSAENLMELLVLIDALKRASAASVTAVIPYFGYSRQDRRMRSSRVPITAKVAAKMICAMEADRVLTVDLHADQIQGFFDVPIDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLSAAARTCPKIRQLSVAELLAETIHRIAFGESVSSLYVD

SEQ ID NO: 23989 - protein, 1368 aa, Vitis vinifera
  misc_feature (64)..(64): Xaa can be any naturally occurring amino acid
MTSEEGENFSMPSAGSTPITGSTSTTDGTLVSKRRKLTSVVWNDFDKIIEDGQDYAICKHCKGXLKADSKNGTKHLHVHIDRCMKRRNVDIRQQLLAVERKGHGKVQIGGSTFDQEISREKIARAIILHEYPLSIVDHVRFREFATSLQPLFKMVSRNTIKSDIMKIYEVEKDKMISYIEKLQSRIAITTDMWTSNQKKGYMAITVHYIDESWLLHHHIVRFVYVPPPHTKEVLSNVLMDFLLDWNMDRKVSTITVDNCSSNDRMINILVEKLSLSNSLLLNGKIFHMRCATHVLNLIVKEGLDVIEVEIEKIRESVAYWSATPSRMEKFEDAARQLRIPCNKKLSLDCKTRWNSTYLMLSIAITYKDVFPCLKQREKYYMVVPSKEEWNMAKEICGRLKLFYNITELFSGRNYPTANTFFIKVCEIKEALYDWLICSNDVVKTMASSMLQKFDKYWSGCHIVMAIAAIFDPRYKIKILEFYFPLMYGSEASNEIEKICGMCYELLSEYQSKSNLGQKTSSYGTSSDSTLLELNYDEQDPLSKFDLFVHSTIGESHTKSELYYYLEESILPRNSNFNVLSWWKTNVASESAFSTGGRVVSKHRSRLHPDTLEALMCAQSWLWKEKEGSGSGQPSPKAINRVGLDIPTIEVRFEHIIVDAEAYIGGRALPTVFNFSANMLESLYIHEMIVRAFKHILQAIIAVVVIPEKLAMSIGVALNLMLGVPGNRELNQSCNAHSLVWRWLEVGIELVPKDFDMDSPYPFQKLDVISLVPVHKVLAKLVSVCGPYHRMTAGAYNLFAVVLCHMGDFNQAADTFGGSELAIPGPNSVVFYLSFCYIFEKVYLQVSSMTLDKSKSPPQAKRLRSSDRASYRDAPYPKDSRVHRQDYLCNKCKRPGHFARDCPNVTVCNNCGLPGHIAAECNSTTICWNCKESRHLASQCPNDPVCHMCGKMGHLARDCSCPARDSLHINYGGANEIIKNNFGNIKYEGDIDGGGSASRNFIGTNWGFSSTGDFMDDDSDDEDKYIESNSSVLSMNHSVLYMTARKVPLSLTYFGFCLKNGDYNVCLHFAEIEFTDEEAYSKLGRRIFNIYIQVASYYIIRTYLSILRRIIDWDILLQGKLVWEDFNIMEKANGIGKEVIIQTNVTVTNNTLEIRLYWAGKRTTCIPKRGRYGPLISAISICPRFMINRGDPCQTRPLPFLAGAAIWGSSPSIDVRRNLVYVATGNLYSAPLSIRECQEQQNNQTVPTQPDQCIEPDNHSNSILAIDLDSDKIKWYRQLGGYDAWFLACNNLSTPNCPPGPNPDADFGEAPMMLSIYVNGTMRDIVIAVQKTAVAMTPFDSRFDPRQRRHLIRAHLVSQLIRVQLVLFD

SEQ ID NO: 23990 - protein, 348 aa, Thermococcus kodakarensis KOD1
MRFYICREKGEPKPFRIAIIGAGPAGLSAAGYLACRGYEVHVYEKMPEGGGMVAFGIPETRIPIRTVRGGVRDLERLGVNFHFRTKVVYDSPRELGDEWAEHFVSLERLLGEFDAILIATGAWRPRKLKVPGADLPGVYDALSLLHHIKMARIGYYSWEGIPDLKGKHIVVIGAGYTAVDVAIEGRLLGAEKITMVYRRGLEHSYAKTEIRKLIEEGVEFIEFATPVRIIGDERVQGVEFAKTRIEEGSVITTDERFILDADIVAYAIGQLPTSPIREVVCANEEILKEAGIFFAGDVVAPRNIGTAMREGKERAKEIEEWLLKKAPKKVFPVPVAARLISEVANGKC

SEQ ID NO: 23991 - protein, 535 aa, Hordeum vulgare subsp. vulgare
MAARMRARTRWSALAASALIQCFAGGSYCFGVYSPALKASQGYDQSALDAVAFFKDVGANVGVLSGLLAAWAPAGGRRRPWIVLLTGAALCAAGYLPMWLAVAGVAPAPLPLVCLYMLLAAQAQTFLNTADVVTAVENFPDRRGTVIGIMKGFLGLSGAILVQVQRTLLIDPGNFILMLAILPTAIALLLMYFVDVHSAHQRYNKKFLDAFSLMAVTVAVYLMVVIICDQVFMISSAGQSVCFAILLLLIMSPAAIVVMAQKTESKQREEPTLDERTGLLRGETAQQDSEDGSSSAALVGSGQDMPSDKENLNVVQAMCKLDFWLLFLAMACGMGSGLATVNNISQIGGSLGYTSRETSTLVSLWSIWNFSGRFGAGYVSDHFLRSRGVGRPFFIAATLLVMGVGHAIISSGFHASLYVGSVLVGLCYGSQWALMPSITSEIFGLNHFGTIFNTVAVASPVGSYVLSVRVVGFIYDKESPQGELACAGKHCFALSFMIMACVCLLGSAVAFVLFIRTRKFYRRVIYARLLSFVDK

SEQ ID NO: 23992 - protein, 752 aa, Oryza sativa Japonica Group
MDAAATRVSTRLRRSTQTHAAYTVHVADRRVIALVTAHPAYARRWVHTTRWLHHRLLRSGRLLVGLGVQWTPLRRPLHRGSPPPPPATLQLCVGHRCLVFHLAHADAIPAALRRFLADPRITFVGSGASNDRRMLSAYYDLHVASARELRAVAAMGNASMEAMADRFLGYPGIAKPTNVSMSAWHAPYLSIEQVEYACVDAYLAFRLAVHLCPAPARQPVLRAPPPPPPAPRAPVYHHPLPLGPRVAVLAAPAPRPARHAPVRARVAPPVYRAVARAEPAAAQTHWALVATAVDDDASESEYSSKITDNVRPRVAASDSDIEEEDDDGLSMIHSSSYASDDHVFSSDDFELVGHGLLSSDDEDGYEDFVLGMGALNIDIDDDDDYNGNTGSIGILTVQSYNEHSSIGILTVENYDMAGTEEMFVRNGVATLEELEEDDIVTGAGTVTVDEGGGGYEAFEGNSQAFDDVEEGGYVEDDCVFGSRSCSVACLRNQATSLGVLFAARAMAGKRPGDAPAGDTAAKRARTAARRQKTTVSARLRRSETKHDTYVVRVGASRVVATVTARPAVARRWVFSTRWRHGRRLRSGAGLTVAMGVQWTPPSRALAGGAEPRPGTLQLCVGSRCLVFQVAQGNAFPAALRRFLADGGVAAFVGYGIRSDCRKLAAHHGLHVACTRELRAVTGMGSSSMARMAEELLGLAGIKKPAAVGRSRWDAPKLSKKQVKYACVDAFLSHRLGVHVGAAPPSTSSSDSA

SEQ ID NO: 23993 - protein, 363 aa, Xanthomonas campestris pv. campestris str. ATCC 33913
MGIKCGIVGLPNVGKSTLFNALTKAGIAAANFPFCTIEPNVGVVPVPDPRLNELAEIVKPQKLIPTAVEFVDIAGLVAGAASGEGLGNKFLAHIREVDAITHVVRCFEHADIIHVNNKVDPIADIETIDTELALADLDSVEKALNRAERSAKGGDKEAAARKPVLAKLQAALADGKAGRSAGLDEEEKALVRDLFLLTLKPVMYICNVLEDGFENNPHLDAVRAHAATEGAEVVPVSAAIEEELSQLDDADRDTFLADLGLDEPGLNRVIRAAYKLLGLQTYFTAGVREVRAWTVKAGSTAPQAAAVIHTDFEKGFIRAETIAFDDFIKYRGESGARDAGRLRLEGKEYRVKEGDVLHFRFNV

SEQ ID NO: 23994 - protein, 230 aa, Brassica rapa
MVGTRVVGQWTLCVASPRLTPAICSSTSSPTTVNLRAELAAFRPQFRLFSRTSPSRRRLRASTSSAESGIFLPHLVASMEQVEETYIMVKPDGIQRGLVGEIISRFEKKGFKLIGLKMFQCPRELAEEHYKDLSSKSFFSSLIEYITSGPVVCMAWEGVGVVASARKMIGKTDPLQAEPGTIRGDLAVQTGRNIVHGSDSPENGKREIALWFKEGELCEWDSVLAKWLRE

SEQ ID NO: 23995 - protein, 213 aa, Mycoplasma genitalium G37
MDEKGILVAISGGSCSGKTTVAEMIYQLLSKKLKVAIICQDNYYKSYKNKPLLKRKTINFDHPDAFDWKLLRSHIEDLLNGSIVNVPLYDYINYTRAKKTAKIGPIDVVILEGLMPWFDEKLSRLSKLKIFIETNGEERLIRRIERDWQRGRNIDSIIKQWREIVAPMYEIFVEKMKRNADLILPWSQRREVSTSVLDVAIEHLFHKTVEKNN

SEQ ID NO: 23996 - protein, 163 aa, Xanthomonas oryzae pv. oryzae KACC10331
MSFNFRIGQGYDVHAFGPGEHVMLGGVRVAHSHGVLAHSDGDVVLHALCDAMLGALALGDIGRHFPPSDERWKDADSAQFLQHCDGLLRERGWRVGNADITVICERPKVGPHAVAMRERIAGLLAIELDAVSVKATTSEQLGFTGRGEGIAAQAAVLLGRIAA

SEQ ID NO: 23997 - protein, 228 aa, uncultured cyanobacterium
HEVAGAGQHELGIKFAELIQAADNVMTYKYVVRNVAKKYGKTATFMPKPVFNDNGSGMRVHQSLWKGGQPLFFGEGTYANLSQTARWYIGGILKHAPSFLAFTNPTTNGYKRLVPGFEAPVNLVYSEGNRSAAVRIPLTGPSPKAKRLEFRSGDALANPYLAFSAMMMAGIDGIKNQIDPGEGVDVDLFELPANQLANIATVPASLNGALEALNADKHYLMEGGVFSE

SEQ ID NO: 23998 - protein, 486 aa, Acidovorax sp. JS42
MKEFLNFINGEYVRNASGKTFQDINPVNGSVIGNIYEAGQAEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNQVGMPKGVYNVVHGFGPGSAGEFLTRHPGVNGITFTGETRTGTAIMKAAADGVRPVSLEMGGKNAAVVFADCDFQVTIDTLTRSCFENAGQVCLGTERVYVERPIFDKVVAALKERAEAMKPGLPFDHDTRIGPLISKKHQAKVLGLYKTAKDEGATIVTGGGIPDMPEELKNGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 23999 - protein, 215 aa, Hordeum vulgare subsp. vulgare
MIYAMVARGTVVVAEHTAYTGNFRDIAGQCLHKLPAGDSRFAYNCDGHTFTFLLHQGYAYCVVATESAGREVPLAFLERIKEDFNRRYAGGKAATATANSLTKDFGPRLKEQMKYCMDHPEEVSRLSKVQAQVSEVKGIMMENIDKVIDRGEQIDGLVTRTEQLHDHALDFRTEGTRIRRRMWYQNMKIKLIVVGIVVALILIIVLSICHKKDCN

SEQ ID NO: 24000 - protein, 339 aa, Salmonella enterica subsp. enterica serovar Paratyphi A str.
MKSIVIEKPNTLTIETRALPQPAPGEVRIKVKLAGICGSDSHIYRGHNPFAKYPRVIGHEFFGVIDAVGDNVNRDRIGERVSVDPVISCGHCYPCSVGKPNVCTSLVVLGVHRDGGFSEYAVAPARNAHRIPDNIADHHAVMVEPFTIAANVTGQVNPTEQDVALIYGAGPMGLTTVQALKGVYQVKTVIVVDRIEERLAMAKQSGADWSLNNGQHSLAEFLQQKALKPTLIVDAACHPAILQEAITLASPAARIVLMGFSSDPCEIVQQGITGKELAIYSSRLNVNKFPVVIDWLNKGLIDPDKLITHTFDYQHVIDAIELFEKDQRQCCKVLLTFAK

SEQ ID NO: 24001 - protein, 228 aa, uncultured cyanobacterium
HHEVATAQHELGMKFAELISAADNVMIYKYVVRNIAKKYGKTATFMPKPVFADNGSGMHVHQSLWKAGQPLFWGEGTYANLSQTARWYIGGLLKHAPSFLAFTNPTTNSYKRLVPGFEAPVNLAYSQGNRSAAVRIPLTGTNPKAKRLEFRSGDALSNPYLGFAAMLMAGIDGIKNQIDPGDGTDVDLFELSAEELAKISTVPASLNGSLEALKADHEYLLAGDVFTA

SEQ ID NO: 24002 - protein, 425 aa, Hordeum vulgare subsp. vulgare
MKPIVVHAAAVDRRWLLPLAVGSALSLFILVLLTTVPFPFVPSSTPSPALFVEHKLAPTPPASRVAGSLPRIAYVISGSARDAAALRRVLLALYHPRNLYVLHLDAEAPEADRRELAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYIAWDNPPKQHPHYLTMDDLDRMIASDAPFARKFHADEPVLDRIDEELLSRRAGPDAPTPGGWCAGTGDNGSDPCSVIGNTSFLQPGRGAVRLQRLVTSLLSEEKFHPRQCK

SEQ ID NO: 24003 - protein, 457 aa, Xanthomonas oryzae pv. oryzae KACC10331
MAMDRCAAIILQLVSGVLPPLLVTDRPMTTIAKILAREILDSRGNPTLEAEVTLDDGSFGRAAVPSGASTGTKEAVELRDGDKTRYLGKGVRHAVDNVNGTIAETLKNFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFYSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKHVQLVGDDLFVTNPKIFKQGIDSGTANAILIKVNQIGTLTETLEAIAMAHAANYASIVSHRSGETEDTTIADIAVATTATQIKTGSLCRSDRVAKYNQLLRIEQALGSDARYAGRDAFVSIKR

SEQ ID NO: 24004 - protein, 506 aa, Mycobacterium smegmatis str. MC2 155
MTKHQRLTSAVAASIVATAGVAVSQAPAPASTGTPTAHQTPTSTSTPRWLTVTSTPEGAPATPNALYGAILPSTSPGSVTSTGSGIGHREPGISGSPAFTAVRAVRPGSSTARLVFAPKTSTSGTALTVTPIAVGMVGNAKVTVAVDSSGRPMIGPGGWLIGNGIEPGQNGGLLIGNGADGGPGQKGGNGGFLLGNGGRGGDGLAGVNGGRAGDGGNAGLLGNGGDGGNSVGGVEGANGGNAGLIGNGGKGGDGSPNVISNGAHIANAGRGGNGGNGGLLVGSGGDGGRGGDGDGEGPETAGSHGADGGNGGAGGVFGNGGRGGDGGDANNGTVGTRNGNAAAGKGGNGGSTGIGTGGAGGNGGKATGTNAAYGGNGGNGGSGLAGGGNGGDGGDAQSSSNRARPGQGGQAGRGGFGRDGKTGNPGNATDRSATRENVSNRVTGRSTPTRSADKAGSRTSSSSESNSESNSESSSKTSSKAGGTKSSDTKSGGGAAGTGSDSKDSE

SEQ ID NO: 24005 - protein, 228 aa, uncultured cyanobacterium
HEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFSNPTTNSYKRLVPGFEAPVNLVYSEGNRSAAVRIPLTGPNPKAKRLEFRSGDALANPYLAFSATMMAGIDGIKNQIDPGAPTNVDLFELSAERLSEIDTVPASLNGALEALNADHHYLMEGGVFTK

SEQ ID NO: 24006 - protein, 418 aa, Candidatus Pelagibacter ubique HTCC1002
MSKILKIRARQVFDSRGNPTVEAEVYSKNLSASAICPSGASTGTYEAFEKRDDNNKKYLGKSVLGTVNLVNTKISKKLIGTNIHDQTRIDTILINLDGTRQKTNLGANAILAVSMAAKKLSAKIKNVPLYKTFLVKNNYKLPYPLMNIINGGAHANNGLRIQEFMIRPDKAKSFSEAMRICFVVINNLKKLIIKKGLSTSVGDEGGFAPMISNNEKALDLVVAAINKSSFKNGKDVSICLDVAANELMKKDKYSIHSKKFVSVDQSIKEYKKIINKYKIKSIEDPFGENDWMAWSKLMKNTNNVQIVGDDLYVTNLERLKKGFLNNSSNSILIKLNQIGTVSETLEVIKFAQIIGYKTIISHRSGDSEDTFIADLAVGTNSNQIKTGSLARSERVAKYNQLLRIEEELGKKASMSKIH

SEQ ID NO: 24007 - protein, 470 aa, Vibrio angustum S14
MKKTKIVCTIGPKTESVEMLTKLANAGMNVMRLNFSHGDFEEHGQRIRNLREVMANTGKELAILLDTKGPEIRTIKLEGGQDFSLVAGQDFTFTTDTSVVGNQNCVAVTYPGFAKDLTKGNTILVDDGLIEMEVLETTDTEVKCKVLNNGDLGENKGVNLPGVSVKLPALAEKDKADLKFGCEQGVDFVAASFIRKAEDVQEIRALLTANGGENIQIISKIENQEGVDNFDAILDASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDYVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVASGTTNTASVHVL

SEQ ID NO: 24008 - protein, 228 aa, uncultured cyanobacterium
HEVAGAGQHELGMKFAELIQAADNVMTYKYVVRNVAKKYGKTATFMPKPVFNDNGTGMHVHQSLWKGGEPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADQLAQIATVPASLNGALEALNADKHYLMEGGVFSE

SEQ ID NO: 24009 - protein, 260 aa, Rhodopseudomonas palustris CGA009
MPASPDLLPDEIARFGADPAAAFAANLTSVQERIAAACHRCGRSAGEVRLLPVTKTVPAGVLLRAYAAGISEFGENKLQEARDKRDILADLPIRWSIIGHLQTNKVKYLVRFAAEFHALDSPRLADELNRRLDAEGRDLDVFVQVNTSGEASKYGLAPCDLVPFIERLSDYPRLKPRGLMTLAIFSAETGRVRGCFRLLRELRDRAIRVHPDLTELSMGMSGDFEIAIEEGATVVRVGQAIFGARPTTDRFYWPHASVDR

SEQ ID NO: 24010 - protein, 228 aa, uncultured cyanobacterium
HHEVATGGQCELGIRFGKLVEAADWLMIYKYCIKNVAKQYGKTVTFMPKPLFNDNGSGMHTHQSIWNGGQPMFAGDRYAGLSQMALWYIGGILKHAPALLALTNPTTNSYKRLVPGFEAPVNLAYSQGNRSASVRIPLSGDNPKAKRLEFRCPDATSNPYLAFAAMLCAGIDGIKNQIDPGDPLDVDIYDLSPEELAKIPSTPGSLLDALKALEADYEFLTSTGVFTP

SEQ ID NO: 24011 - protein, 166 aa, Linum usitatissimum
EDKTDWGVNVGWIYGSVTEDVVTGFRMHEKGWRSVYCMTKRDAFRGTAPINLTDRLHQVLRWATGSVEIFFSRNNALFAGSRLKFLQRVAYLNVGIYPFTSLFLLLYCFLPALSLFANKFIVNSLDVNFLTYLLIITVTITLLAVLEIKWSGIALEEWWSNEQFWV

SEQ ID NO: 24012 - protein, 357 aa, Arabidopsis thaliana
MEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 24013 - protein, 166 aa, Linum usitatissimum
EDKTEWGDRVGWIYGSVTEDVVTGYRMHNRGWHSVYCVTKRDAFRGGAPINLTDRLHQVLRWATGSVEIFFSRNNAFLASRKLMFLQRLFYLNVGIYPFTSIFLIVYCFLPALSLFSGSFIVESVTITFLVYLLVMTFCLIGLAILEVKWSGIALEEWWSKEQFWV

SEQ ID NO: 24014 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTANSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 24015 - protein, 393 aa, Streptococcus mutans
MAEKVSFEEGKLQVPDKPVIPYIEGDGVGQDIWKNAQIVFDKAIAKVYGGHKQVIWREVLAGKKAYKETGNWLPNETLEIIKTHLLAIKGPLETPVGGGIRSLNVALRQELDLFACVRPVRYFKGVPSPLKHPEKTAITIFRENTEDIYAGIEWNAGTAEVQKVINFLQDDMQVKKIRFPKSSSIGIKPISIEGSQRLIRAAIEYALANNLTKVTLVHKGNIQKFTEGGFRKWGYELAKREYAAELASGQLVVDDIIADNFLQQILLKPERFDVVALTNLNGDYASDALAAQVGGIGISPGANINYQTGHAIFEATHGTAPDIAGQDLANPSSVLLSGCMLFDYIGWSKVSDLIMKAVEKAIANGQVTIDFAKELGVEALTTCQFSEVLLTYL

SEQ ID NO: 24016 - protein, 391 aa, Yersinia pestis CO92
MIKSALLVLEDGTQFHGRAIGAEGTAVGEVVFNTSMTGYQEILTDPSYSRQIVTLTYPHIGNVGTNASDEESSAVHAQGLVIRDLPLIASNYRNEEGLSEYLKRHNIVAIADIDTRKLTRLLREKGAQNGCIIVGELSDAALALEKAKAFPGLKGMDLAKEVTTKEMYQWLQGSWTLEGDLPAAKQPEDLPFHVVAYDYGVKRNILRMLVDRGCRLTVVPAQTPAEDVLKLNPDGIFLSNGPGDPEPCDYAITAIKRFLETDIPVFGICLGHQLLALASGAKTVKMKFGHHGGNHPVKDLDASCVMITAQNHGFAVDETSLPSNLRTTHVSLFDGSLQGLHRTDKAAFSFQGHPEASPGPHDAAPLFDHFIELIEAYRASSVSLNCSNSHK

SEQ ID NO: 24017 - protein, 290 aa, Ehrlichia ruminantium str. Gardel
MTFIKIRYSKLLIQYVHYTVMHLFCFGYGYTASFLAQKLLPLKWKISGTSFHKKKTQDKNVNILDYNFPLPESIFSDVTHVLISIPPEGDNILEKYHLLLKNIHWLGYLSATNVYGDHNGNWVNETSITNPSTSSGIHRLNKEKLWLNSNLPTHIFRLSGIYGPHRNVLRNLIQNNVRYIISDIMFSRIHVDDIANILFTSIHQPNPNSIYNCSDDLPDSYSNVIKYGAQLLNIDPPKPVTFEDLPDSMKRFYTENKLVSNLKIKHELDVSLKYPTYIQGLQSLINTEKF

SEQ ID NO: 24018 - protein, 286 aa, Arabidopsis thaliana
MEGKEEDVRVGANKFPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVVVIRAIPFKSRS

SEQ ID NO: 24019 - protein, 420 aa, Coccidioides immitis RS
MARLSPYTKKHKVTVVGSGNWGSSISKMVAENVAANPDLFEPVVNMWVYEEQIEIPKTSRHYNPSSPLCNSLQSLSDVINQLHENVKYLPNITLPDNLRANPSLEDSVKDSSILVFNLPHQFIVGICQKLKGHILPYARGISCIKGVSVTDEGVSLFSEVIGRELGIYCGALSGANIASEIAKGLYSETTIAYDPPHLDSKAPTPQNMSPVSSMVNVNDIVHFQHRDSSGSYSKVKLRPLPAEYPPVDHVFIKTLFHRPYFHVRVVHDVAGVSLGGALKNIVALATGFVDGKGWGDNAKAAIMRVGLLEMVKFGKKFFGETVNPQTFTEESCGVADLITSCNGGRNHRCAKLAVERGLTVEEVEKTELNGQMLQGTLSAREVHAFLKKQGLEDEFPLFTAVYGILEGKVKVDDIPSLIEQ

SEQ ID NO: 24020 - protein, 242 aa, Chlamydia trachomatis D/UW-3/CX
MSKQPENSFSSDKFFPIKQKLALEAVALVEPGMCVGLGSGSTAREFILALGDRVRTERLVITAVASSRISQLLAEAVGIPLSDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 24021 - protein, 476 aa, Frankia sp. EAN1pec
MSLLAVGLNHRTAPTSLLELAAVSADDAPKVLHDLVGADHLSEAVLLSTCNRTEIYAEVETFHGGLADISDQLSRVCGVPLTDLASHLYVHHEARAVSHLFSVVCGLDSMLVGETQILGQVRAAFRLAQAAEVTSGTLANLFQTALRVGKRAHTETSIDAAGASIVSVGVRMAAFDLQARRPDMLVAPVASPGCDPGDAVEALLRPELTAPVEVAGPAPLAGARVLIIGAGAVGSLAAQTVRRAGAGDVVVANRTAARAARVADLHDARAVGLAEIAHEVGRADLVISSTGASGLVVGHDAVRASLAGRGARPLVFLDLALPRDIDPAVRELPGVTLIDIEALRVALDGAQVAHDVEAVRALVTTEVAGFLDRRRAERVAPTVVALRAHAAAVVRDELERLRTRLPDLDNREWDMVSGTVRRVVDKLLHAPTVRVQQLAEAPGGDSYAEALRELFDLPRDVPAIVSAPDLDLVERT

SEQ ID NO: 24022 - protein, 215 aa, Campylobacter jejuni RM1221
MYVAPSLLSANFLKLEEEVKAIEAAGADLLHIDVMDGHFVPNLTFGPCVIEKISTISKLPLDVHLMVKDVSKFIDLFIPLKPKFISFHMESEVHPIRLCEYIRSQGIHPAIVLNPHTPIDSIKHMLEFVDMVLLMSVNPGFGGQKFLPLVHEKIKELRQMIDKKNAKVFIEVDGGVNGLNASDLEESGADILVAGSYIFSSNDYKTAISSLKLEF

SEQ ID NO: 24023 - protein, 437 aa, Candida albicans SC5314
MYKTQLIKSSTQARFLAVRQLSSTSQLLKWNDIPLAPPDKILGISEAYNNDSNPQKINLGVGAYRDNSGKPIIFPSVKKAEEILLGKETEKEYTAIVGSKNFQSIVKNFIFNNSNKDANGKQLIDDGRIVTAQTISGTGSLRVIADFLNRFYSNKKILVPKPTWANHVAVFKDAGLEPEFYSYYETSKNDLDYANLKKSLTAAPEGSIVLLHACCHNPTGMDLTSEQWDEVLQIVQDKKFFPLVDMAYQGFASGKPFEDIGLIRKLTKLANENKIPSFALCQSFAKNMGLYGERTGSISIINSSGEASKAVESQLKKLIRPIYSSPPIHGSKIVEVIFDESSGLLPQWLDELDKVVGRLNTVRSKLYEKLDKSNYNWDHLLKQRGMFVYTGLSPEQVIRLRNEYSVYATEDGRFSISGINDNNVDYLANAINEVIKN

SEQ ID NO: 24024 - protein, 457 aa, Nocardioides sp. JS614
MAATASSYSITMRLHTAPDHGVVGAVATAISAAGGIVTAIDVADSSHARLVVDVTCSASDAEHAERLHAAAESVEGVAVHRVSDRTFLLHIGGKIEVTSKVPLRNRDDLSMAYTPGVGRVSMALAESPGDVPRLTVKGNSVAVVTDGSAVLGLGNIGPGAALPVMEGKAALFKRFADIDAWPICLASQDTDEIVRAVEMIAPGFGGINLEDIAAPRCFEIERRLRESLDIPVFHDDQHGTAIVVLAALTNALRVVKKDITDVRIVVSGGGAAGTAIVTLLLAAGAPDIVVWDREGCLSRDDDTLPPAKRQLAEMTNPRLVRGDLRAGLDGADVFIGVSGPGVLDAEWIKDMAPDPVVFALANPDPEVDPAEAEKYAAVVASGRSDYPNQINNVLAFPGVFRGLLDARASEITLDMLLRAAEAIALVVKDEELNPAFIIPTVFHPDVQRKVAAAVRGV

SEQ ID NO: 24025 - protein, 357 aa, Bifidobacterium breve
MEKVKAFADWLTKWFTVIVIVWAVFNYFVPAASLWGKAYTGYMLGIVLFGMGLTLTLDDFKRILTQPLMVIVGTIAHFIIMPLIAVALCAIFHLSGPLAVGVILVGCCPSGTSSNVMSYLSRGDVALDVSIGILSTLCAPFMIPLLMQLLASQYVSVPVESLFLNAVKVVLFPIALGVICHMIFGKKIEKITVALPIVSQVAILLIIGVVVAANGPKLFVASSLMAIPVVILHNLCGYSLGFGFSKLMYKIYPKGFRYAQQKAITFEVGMQDSALGETLALTSFASNPIAAVPSTFFSVWHNISGSILSSWWRNHDDKHEIHWDSDNGEKGSAKNVATGDHPFDADKKATADAKVEG

SEQ ID NO: 24026 - protein, 650 aa, Leifsonia xyli subsp. xyli str. CTCB07
MSILESVHGPRDLDRLTERELDQLAAEVRAFLVANVAKTGGHLGPNLGVVETTIAIHRVFDSPRDAIVFDTGHQSYVHKLLTGRQDFSRLRQKGGLAGYPQRSESEHDIVESSHASSSLSWADGISRAFEMTGQDDRHVVAVVGDGALTGGMTWEALNNISDDNNRRLIIVVNDNGRSYAPTIGGMARFLNTVRTRRSYRSLYLTSRKAFEKLGGPGQSLYRGIRGGLHGFLSRFSDNEALYSNLDIKYIGPVHGHDIGAMEEALRQAKNYGAPVIVHAITQKGRGYEPALRDIADQFHAVGQIDPETGDPIGSPAKPNWTGVFAEEIVALAEENPKLVGITAAMLRPTGLHRFAERFPDRVYDVGIAEQHAVTSAAGLAFGGLHPVVAIYATFMNRAFDQVLMDVALHKAGVTFVLDRAGVTGPDGPSHHGIWDLAILQVVPGIRLAAPRDATRFREELAEAVAVADAPTVLRFPKGSVPADIEAVRRRDDGVDVLHESDQKDVLLVTVGPMAGLGLRVAEALAAQGIGATVVDPRWVVPVPRSVLDLAAGHRIVVTMEDGIRVGGIGTRVRQDLREAGIDTAVDELGLPDEFIDHATRDEILDDAGLTPQKIARDLVAQVLGSRVPIARPLPVEEFTEPSPERKKRRA

SEQ ID NO: 24027 - protein, 712 aa, Leifsonia xyli subsp. xyli str. CTCB07
MTDYSKIDFSPLADLTDDEVVTHSYVKDVSLPSGKTLALVTLDNGRDHTRPNTMGPATLIKLGKTFDTLTERAGRGEIDAVAVTGKPFILAAGADLSRVGDIPSVEVAKLLPQLGHYVLGKQASFGVPSFVFTNGLALGGGVEIGLNADYRTIDRNAAAFALPEVFLGLIPGWGGATILPNLIGIENALKVVIENSLKQNRMLKPQEVFDLGIADAIFDSANFLEDSLKWADQVLTKQVEVKRPNVPGKVERMVKWDAAVGIARKMLESSIGTVPASPYKALDLLKAAKSNDRAAGFEREDDALAELISGDQFQASIYAFNLVQKRAKRPAGAPDKKLAKKVTKVGVIGAGYMASQFALLFVRRLRVPVVITDLDQAHVDKGVASIHDEIGKLREKGRISPDEANHLRALVTGTTDKADFADCDWVIEAVFEELNVKQEVFAEVEQYLSDEAVLATNTSSLSVEQIGAKLKRPERLVGFHFFTPVAVMPLIEVVKTTNTDDATLSTAMVTAAALKKNAVITADTPGFVVNRVLAKILGEAMHAVDDGTPFETVDRAFAPLGLPMAPSALLNLVGLKVGAHVLDTHHTAFPDRFYRSKNLHHLAEHGTLLEKDATGKVKGLDKGAAKILAGGKNPWNEADILRRLEDGIADEIHRMLVDDRVVEAPEDIDLCMILGAGFPLQMGGITPYLDRAGASERVFGNTFHHPPIAGVA

SEQ ID NO: 24028 - protein, 472 aa, Prochlorococcus marinus str. MIT 9211
MSKAHFGLVGLGVMGENLVLNAERNGFSSVVYNRTYSKTESFLLGRGLGKSISGAKDLKELVNKLERPRRILMMVKAGPATDAVISQISPYLEEGDLLIDGGNALFSDTERRVEELESKSFGYIGMGVSGGAKGALEGPSMMPGGTKSSYESVEQLLTKMAAQVDDGPCVSYIGPGGSGHFVKTVHNGIEYGIEQILAESYDLMKRMCGMTGDQMADVFAYWNSTEELSSYLVEITETCLRTKDSVDGTDLVEKIMDKAGQKGTGLWTVISALELGASVPTIYASLNARVMSSLKSQRVYASTLLKEPLIGSYELGTPSDGMSPIMDAVVLSTIASYAQGMEIMRIASHEYNYDLHMPSIAQIWKGGCIIRSRLLVHIQNAFQKDPQLKNLLLDSWFLNQVDKRIAGLAKVVSYASQAGIPVPCFSSTLDYINSYRTSRLPQNLVQAMRDCFGSHTYERTDKEGFFHTEWLN

SEQ ID NO: 24029 - protein, 431 aa, Prochlorococcus marinus str. MIT 9211
MKRVLAIILGGGKGSRLYPLTKMRAKPAVPLAGKYRLIDIPISNCINSNIHKMYVLTQFNSASLNRHISQTYNLSSPFAQGFVEVLAAQQTPESPSWFEGTADAVRKYQWIFQEWDVDEYLILSGDQLYRMDYSQFVNHHRTTGADLTVAALPVDSSQAEAFGLMRTDGEGNIKEFREKPTGDSLKAMAVDTSRFGLTAQSAKERPYLASMGIYVFSRATLFDLLNKHPNYKDFGKEVIPEALNRGDVLKSYVFDDYWEDIGTIGAFFESNLALTQQPKPPFSFYDEKFPIYTRARYLPPSKLVDAQITDSIVGEGSILKACSIHHCVLGVRSRIESDVVLQDTLVMGSDFYESGEERIALRSGGGIPLGVGQGTTVKRAILDKNARIGENVAIVNKDNVEEADRPEEGFYIRNGIVVVVKNATISDGTII

SEQ ID NO: 24030 - protein, 435 aa, Prochlorococcus marinus str. MIT 9211
MNIAVVGLSHRTAPVEVREKLSISDDNIPSAFNTLNTNDQIIEVSILSTCNRLEIYSFVKNSDNGVKAIKDFLCKHSGLGIDELDPHLFSYDQAEAVKHVMRVAGGLDSLVLGEGQILSQVKKMVRLGQENHSMGPILNRLLTQAVSTGKRVRSETNLGTGAVSISSAAVELAQLKLGQSEGKDELMSLEREKVSIVGAGRMSRLLIQHLQSKGCSKLKLINRTFQRAEALALDFPDVDIHCQLLDDLDESLRNSTLIFTSTAAENPIIDAARLKEVVRDETLRLIDIGVPRNISSDVKGLTGFEAHDVDDLQEVVSRNQEARQQIALEAEALVDEEGRIFLEWWASLEAVPTINLLRSSLESVRKEELQKALSRMGPDFSARERKVVEALSKGIINKILHTPVTNLRAPQTSSNRKISLEVIETLFELGVSESE

SEQ ID NO: 24031 - protein, 221 aa, Prochlorococcus marinus str. MIT 9211
MKSLAIAPSILSADFSRLGEEVKAVDEAGADWIHVDVMDGRFVPNITIGPLIVEALRPVTKKPLDVHLMIVEPEKYVADFAKAGADHIYVQVETCQHLHRNLAQIKDLGKKAGAVLNPGTKIDTLEYCLELCDLVLIMSVNPGFGGQSFIENQVDKIRDLRTICQERGLDPWIEVDGGIKAGNAWKVIEAGANAIVSGSGIFNQPDYAQAIKGIRESKRPQ

SEQ ID NO: 24032 - protein, 312 aa, Leptospira interrogans serovar Copenhageni str. Fiocruz L1-130
MNGDIAVFAGNSNKQIAEEICTHLGIQSGKINLKKFSDGEISVKIEDNVRGKEVFIVQSTSAPANDHLMELILIMDALRRASVSSISVVIPYYGYGRQDRKVEPRVPISARVVADLIEVVGLDRILTMDLHADQIQGFFRVPVDNLHFAPVLAEYVNTKKIDDLVIVSPDSGGAERARAFGKKVNGSLAIIDKRRPKANVSEVMNVIGEIEGKNCILLDDMIDTAGTICKAADVLLKHGAKSVYCAATHGVLSGEAVDRINSTQFSEVVLANTIAIPESKKINKLKSLSVAPLFANAIQRIHTNQSVSTLFD

SEQ ID NO: 24033 - protein, 228 aa, uncultured cyanobacterium
HEVATGGQCELGFRFGKLIEAADWLMTYKYVIKNVARKYGKAVTFMPKPIFGDNGSGMHCHQSIWKDGQPLFAGDKYAGMSEMGLYYIGGILKHAPALLAITNPTTNSYKRLVPGYEAPVNLAYSQGNRSASVRIPLSGGNPKAKRLEFRCPDATSNPYLAFAAMLCAGIDGIKNKIHPGEPLDKNIYELSPEELSKIPSTPGSLELALEALENDHAFLTESGVFSED

SEQ ID NO: 24034 - protein, 220 aa, Triticum aestivum
  misc_feature (183)..(183): Xaa can be any naturally occurring amino acid
  misc_feature (204)..(204): Xaa can be any naturally occurring amino acid
MGRKLALLVGINYPGTKAELKGCHNDVDRMHKCLVDRFGFDEDNITVLLDRGSSGPQPTGANIRHALAKLVGDARRGDFLFFHYSGHGTRLPAETGQDDDTGYDECIVPSDMNLITDQDFRDLVQKVPDGCIFTIVSDSCHSGGLLDKAKEQIGNSTKQNQTQSRESEEERSHSGGGFRSFLXETVRDAFESHSRHGGEDQDEXQLGDGLTKNRSLPLST

SEQ ID NO: 24035 - protein, 429 aa, Bradyrhizobium japonicum USDA 110
MGGALRRGDKPVKWCYSAAIKIKARPGRTPMTVHTGRHFLQIPGPTNVPDRVLRAMDMPTLDHRGPEFAELGFGVLAAMQRVFRTKQPVIIFPSSGTGAWEAAMVNVFSPGDKVLMCETGQFAVLWRGIADKFKLDVDFIPSDWRHGADLAEIEQRLAADKQHTIKAVCVVHNETSTGCVTPPLEVRKLLDRVKHPALLMVDTISGLGSMEYEHDAWGIDVSVAGSQKGLMLPPGLGFNAVSEKALAVAKANPGMRSYWDWQEVISFNKLGTFPYTPATNLLYGLREAVKMLEEEGLENVWTRHKRHSAATRAAVKVWGLETQCADPAAHSPALTGVRVPDGHDADAFRKVVLENFDMSLGTGLNKVKGKVFRIGHIGHFNDLMLMGTLAGVEMGLDLAKIPHRSGGVLAAMDVLKGRDVVPMAKAQVA

SEQ ID NO: 24036 - protein, 221 aa, Brassica napus
  misc_feature (173)..(173): Xaa can be any naturally occurring amino acid
MAMVVAVGVLHNHLLSASSRIVCLSSCSRPPLSVSSGVAKVVLKKGKTQLFKDGSPMVYSGAVDRIIGKPPPQTGDVVIVADGTENPIGWGLYNSVSMFCVRLMQLQHESTRDPSCALNIEKLLQTRITQAVQLRNSWGLPSDYYTNAYRLVNSEGDRLSGLIVDVFGDIAVXVASSAARLEKYRSHVEACLRSSIQGINHINWRPSLDVLKEDGFDISSL

SEQ ID NO: 24037 - protein, 228 aa, uncultured cyanobacterium
HHEVATGGQNELGIRFATLVSAADYLMTYKYVIKNVAKKYGRTVTFMPKPLFNDNGSGMHTHMSIWKEGQPQFWGEGYANLSPMALHAIGGILKHAPALLALTNPTTNSYKRLVPGFEAPVNLAYSQGNRSASVRIPLSGGNPKAKRFEFRCPDATCNPYLAFAAMLCAAVDGIKNEIAPGDPLDVDIYDLSPEELSKIPSTPGSLEAALEALEKDRTFLTDTGVFTQ

SEQ ID NO: 24038 - protein, 483 aa, Cryptococcus neoformans var. neoformans JEC21
MATTHVIGSSNPGGHLTSAGSHSSSSSNIVGVHYKVGKKIGEGSFGVIFEGTNLLNSQTVAIKFEPRKSDAPQLRDEYRSYKILSGCLGIPQVYYFGQEGLHNILVIDLLGPSLEDLFDMCGRKFSVKTCCMTAKQMLSRVQTIHEKNLIYRDIKPDNFLIGRPSSKNANLIHVVDFGMAKQYRDPKTKQHIPYRERKSLSGTARYMSINTHLGREQSRRDDLEALGHVFFYFLRGGLPWQGLKAATNKQKYEKIGEKKQTTPIAELVEGYPNEFSIYLNYVRKLTFDETPDYDFLRGLFDLALSNSGEMDDGVYDWMMLNNGQGWEASGRQSAAQAEIARHNTRGRDREYRDRVDKLRNGSAANQPSPGKPRKSGSALPNVSNQAMVGVSAPSPLPQSRRQSQQGGHPFASSKVLPGERNETYDASNIAVQSQAGLQPISPMNVNSRGGNTAANSQQLGEGDYHQENKGNGFIRFITCGCFR

SEQ ID NO: 24039 - protein, 228 aa, uncultured cyanobacterium
HHEVATGGQNELGIRFATLVSAADYLMTYKYVIKNVAKKYGRTVTFMPKPLFNDNGSGMHTHMSIWKEGQPQFWGEGYANLSPMALHAIGGILKHAPALLALTNPTTNSYKRLVPGFEAPVNLAYSQGNRSASVRIPLSGGNPKAKRFEFRCPDATCNPYLAFAAMLCAAVDGIKNEIAPGDPLDVDIYDLSPEELSKIPSTPGSLEAALEAVGEGSHFPDGYGVFTQ

SEQ ID NO: 24040 - protein, 355 aa, Chlamydomonas reinhardtii
MSTFRRKHRHPADASQPVQTSRFLTSKAVCSHLRHMLFRYDALRSIAPRGDAEYDAWLAVRSRDLVAYNQLYALLAPSLLLCAGLCLLRVAFVRGVLMWADAGWGFSGRSSSTATAKGGEVERPGATVASAEKDGANMATPGAAAAADLELRWAEGFWTATGGTVLLVWSWRCVVTSNGGCPGLPGLLDTSTCLAGWPLLPVEPAVRRYYSAELAWYLHLLLKHRLGVGLHDSGLMVAHHVATVYLLLLSYCFSLTRAGVLLLALLNLSSPLLHVSKIAHAAGLKRLALVSFASFAAVFAASRVVLFPLIFLPLGLVSSQRHIGRLLQLYPLTFGIVNTLLVALVAMQWGWFVAI

SEQ ID NO: 24041 - protein, 362 aa, Vibrio angustum S14
MAGSYNIAVLPGDGIGPEVMQQAHKVLNAIEAKFNLTFNRTEYDVGGIAIDNHGSPLPDATLKGCEQSDAVLFGSVGGPKWEHLAPNDQPERGALLPLRKHFQLFCNLRPAQIHRGLEKFSPLRADISERGFDIAVVRELTGGIYFGQPKGREGEGAQEKAFDTEVYYRYEIERIAKIAFESARLRSKKVCSIDKANVLQSSILWREVVEEIAKDYPDVTLTHMYIDNATMQLIKDPSQFDVMLCSNIFGDIISDECAMITGSMGMLPSASLNQDKFGMYEPAGGSAPDIAGKNIANPVAQILSAALMLRYSLGEETAARAIEQAVSQALEAGELTADLASDKPALTTSEMGDKIAAYIQQA

SEQ ID NO: 24042 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFANPTTNSYKRLVPGFEAPVNLVYSKGNRSAAVRIPLTGPNPKAKRLEFRPGDALANPYLAFSAMMMAGVDGIKNQIDPGDGFDEDLFELSAERLASIPTVPASLNGALEALNADKNYLMEGGVFTE

SEQ ID NO: 24043 - protein, 506 aa, Pseudomonas aeruginosa UCBPP-PA14
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 24044 - protein, 337 aa, Nostoc punctiforme PCC 73102
MIRVAINGFGRIGRNFARCWVGRENSQIDLVAINDTSDPRTNAHLLKYDSMLGKIKGAEISADDNSIIVNGKTIKCVSDRNPEKLPWRDWGIDLIIEATGVFTSKEGALKHVNAGAKKVLITAPGKNEDGTFVVGVNHHDYDHNIHNIISNASCTTNCLAPIAKVLNDKFGIIKGTMTTTHSYTGDQRLLDASHRDLRRARAAAINIVPTSTGAAKAVALVIPDLKGKLNGVALRVPTPNVSMVDFVVQVEKRTITEEVNQALKDAAEGPLKGILDYSELELVSSDYQGSDASSIVDSSLTLVMGNDLVKVMAWYDNEWGYSQRVLDLAELVAEKWQ

SEQ ID NO: 24045 - protein, 228 aa, uncultured cyanobacterium
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSASVRIPLTGPSPKAKRLEFRSGDALANPYLAFSAMVMAGLDGIKNQIDPGDGEDRDLFELPAEELAKIATVPPSLNGALEALNADRGFLTAGGVFSD

SEQ ID NO: 24046 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRDAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 24047 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRDAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRYEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRI

SEQ ID NO: 24048 - protein, 657 aa, Clostridium acetobutylicum ATCC 824
MIGTVLSNRYKIEEEIGVGGTAVVYKAMDTLLNRHVAVKVLKHEFTEDEEFVFKFKREASAAARIANANIVNIYDVGADGNVNYIVMEYVAGKTLKKLIKENGKIEFNKIIDYATQIAKALNFAHKNGIVHRDIKPHNIMVTDDDIIKVTDFGIAKASNESTITTTNKVVGSAHYLSPEQAQGIPVDCRTDIYSFGIVLYEMATGKVPYDADTPVSIALKHIQDAAVPPNELNKDIPIALNKMILRCIEKKPENRYQNANEILDELSNVKNNYVNDDEEFTRVMDPAQIQNESNPNNKLDNDDTYYNGEPYNKEQPQEEPQEENEEPKNKIKGNNMLSGKAKKALVASIIVVLILAGSALAFSMGSGIFKPNSNSVSKVKVPKIIGLSESDAKGKVEDAKLKFQVVDRVKSSKPKGTVVTCYPNEDTEVDSGTVVRVDISSGDTDQTLPSLVGLPESAARAQIKQYGCNVGSVTQEYSDDVAQGNVISQSPSEGSQIKKGMTIDLVISRGPEVKKATVPSVYGKTSDSASSILQNAGFGVNVQNKDVTNADQNGIVIEEYPNGYVNKGTTVTIVIGRFNSTAVQPPNNNNGNGNQNQNQNKTPDTNHDDSKAPTGGNNDNQNQNNTTNPNGTQPAGGNVTGTGNGNVTNTPNGTGQK

SEQ ID NO: 24049 - protein, 216 aa, Clostridium acetobutylicum ATCC 824
MIKLAASILSADFSKLGEEVRTLDEAGADFIHIDIMDGNFVPNISFGIPVVRDIRKHTKLTFDVHLMIEEPSKYVEQFVKSGADIITVHYETDRHIDRTLNYIKSFGVKAAVAINPGTPVNMIKNLLTTADMVLIMSVNPGFGGQKYIDYSYDKIREVKKYADEIGRDILIEVDGGVDSTNIKKVVEAGANVVVAGSAVFKNGDIKKNIELLKGSI

SEQ ID NO: 24050 - protein, 297 aa, Frankia sp. EAN1pec
MVAVGCGGHRSEGKCSVVGSSVVAIVGAGRLGGALMSGLLRAGRTPSEVVAAERDPGRAAEITRRYGVEVVDPATAAAKAGVVVLATKPQDMGTVLAQLAPHVAPGALVVSVAAGITSAFVAERLAPGTPVVRVMTNTPLLVGEAMSAVCAGPGAGDEHVAAVEEMLRPVGRVVRVTETQLDAVTALSGSGPAYFFYLIEAMIEGGVLLGLPRALAAELVVQTAAGSARMLRDPGAGDSDGAGGAAGEHPSLLREAVTSPGGTTVAALRQLDRGGVRAAVLDAVVAAWTRSRELGAS

SEQ ID NO: 24051 - protein, 326 aa, Aspergillus oryzae
MTEQEHEVYRHADADGHFRRKASVFRSSVSSDPAAEFPAEKDRYVLYLGYGCPWAHRTNIVRSLKGLEEIIQLVVLDPELGPDGWFFSGRWGSAEKDPLYGFTQLRQLYFKANPAYEGRYTIPVLWDKKKGTIVNNESSEIIRMFYTEFDHLLPDELREINRPGGGFYPQPLRKDIDEMNDWVYHQINNGVYKTGFATTQEAYKENIYPLFEALDRIENHLAQPGHQPYLFGENITEADIRLYTTIARFDVAYYLIFKCNLKMIRHDYPRIHDWYRRLYFDESKRTRGGAFKKTTYFDIAIGKRTGSSQLIIPAGPSPDILPLEDQ

SEQ ID NO: 24052 - protein, 156 aa, Glycine max
LKMESDVEESLRKRPRKYPFSADSSSRKQFEQYSGRTFAFTGEVNFMQDDDNRLEITRTKFGSLLKRHGDLTERLARDSDKIIFERLQKEFEAARASQTEEICLDGEEWNDGLLATIRERVHMEADRKAMHGDADILACPQDKITYKIGNKVICCW

SEQ ID NO: 24053 - protein, 355 aa, Aggregatibacter actinomycetemcomitans
MLKTILVTGGAGFIGSAVVRYIIENTQDSVVNVDKLTYAGNLESLEAVKNNPRYIFEQVDICDAKALARIFEQHQPDAVMHLAAESHVDRSIDGPATFIETNIVGTYILLEAARAYWSSLIDEKKAGFRFHHISTDEVYGDLDGTNNLFTETTPYSPSSPYSASKASSDHLVRAWLRTYSLPTIVTNCSNNYGPKVFPEKLIPLIILNALDGKPLPVYGNGQQIRDWLFVEDHARALYKVVTEGKIGETYNIGGHNEKANIDVVRTICALLEELVPDKPAGVTKYEDLITYVKDRPGHDVRYAIDATKISRELGWKPQETFESGIRKTVEWYLNNRKWWSRVLDGSYNRERLGSQ

SEQ ID NO: 24054 - protein, 449 aa, Escherichia coli
MSEIVVSKFGGTSVADFDAMNRSADIVLSDANVRLVVLSASAGITNLLVALAEGLEPCERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACAVGKEVFGVLEPFNIRMICYGASSHNLCFLVPGEDAEQVVQKLHSNLFE

SEQ ID NO: 24055 - protein, 417 aa, Bradyrhizobium japonicum USDA 110
MQNSRQSRPEPADREVFMHQGRHFLQIPGPSPVPERVLRAMDMPVIDHRSAEFGELGRTVLEGSQKIFQTAGPVVIFPSSGTGAWEAAIVNTLSPGDRVLMVETGHFATLWRQMAGRFGIEVDFVPGDWRRGADPAVIEAKLTEDKARAIKAVMVVHNETSTGATSRIAEIRAAIDRTDHPALLMVDTISSLGSVDYRHDEWKVDVSVSCSQKGFMLPPGLGFNAISEKARVAAKTNKMPRSYFDWEEMLKPNAKGFFPYTPATNLLYGLREAIAMLLEEGLDNVFARHQRLAAATRAAVNHWGLEVLCQEPSEFSPVLTAVLMPPGHDADQFRQIVLENYNMSLGSGLSKVAGKVFRIGHLGECNALTLLGALTGVEMGLSVAGVPHRPGGVDVAMKLLEQRPQGNASPHLKVVGT

SEQ ID NO: 24056 - protein, 598 aa, Prochlorococcus marinus str. MIT 9211
MTKEALSLPDIDDSPLSPCVANGQDRTKFEQFKADSDYLKEPLRTELQNNSDHFSNDAVQLLKFHGSYQQDNRDTRQKGVEKDWQMMLRLRSPGGHIPPELFVALDHLSDQLGNGTLRATTRQAFQMHGIKKESLKTVIETIIRSMGSTLAACGDINRNVMAPAAPFTYGDYPVARRLANQIADVLSPSYAEKTYLELWVDGDISYKISPSNEVKKVRKNQYKEGVYSGDIKEPLYGSTYLPRKFKCAVTVPGDNSVDLLTQDIGLVVFTNAKNKLIGCNVYVGGGMGRTHNNEETFARSAEPIGFVSAEYVLELVQSILALQRDYGDRKVRRHARMKYLINDKGIEWFIDKLKNNYFKYPIKSLRKEPTSKLLDYLGWHKQSHDLYFVGIPLLSGRLSGEYKKAICKLVNKFKLDIQLTPNQDLLLCNIGSYQRSSIKKELSNIGIIKPDSPEPIQRHALACPALPLCGLAVTEAERILPEILDRINTQLSDLRIQKTLLFRMTGCPNGCARPYMAELALVGSGLDQYQLWLGGSPNLQRLAKPFIQRMPLTSLEETLKPLFISWKNSKKEISFGDHMNELGDQNIMELLSLKDKEP

SEQ ID NO: 24057 - protein, 459 aa, Cryptococcus neoformans var. neoformans JEC21
MATTHVIGSSNPGGHLTSAGSHSSSSSNIVGVHYKVGKKIGEGSFGVIFEGTNLLNSQTVAIKFEPRKSDAPQLRDEYRSYKILSGCLGIPQVYYFGQEGLHNILVIDLLGPSLEDLFDMCGRKFSVKTCCMTAKQMLSRVQTIHEKNLIYRDIKPDNFLIGRPSSKNANLIHVVDFGMAKQYRDPKTKQHIPYRERKSLSGTARYMSINTHLGREQSRRDDLEALGHVFFYFLRGGLPWQGLKAATNKQKYEKIGEKKQTTPIAELVEGYPNEFSIYLNYVRKLTFDETPDYDFLRGLFDLALSNSGEMDDGVYDWMMLNNGQGWEASGRQSAAQAEIARHNTRGRDREYRDRVDKLRNGSAANQPSPGKPRKSGSALPNVSNQAMVGVSAPSPLPQSRRQSQQAVQSQAGLQPISPMNVNSRGGNTAANSQQLGEGDYHQENKGNGFIRFITCGCFR

SEQ ID NO: 24058 - protein, 476 aa, Mycoplasma genitalium G37
MIKKENLTYGKVHQVIGPVVDVIFSESKQLPRVYDCLSVQLKKSELFLEATQLIGDDIVRCIALGPTEGLARNVKVTNYNHPIEVPVGKNVLGRMFNVLGEPIDGKEPLPKKPKLSIHRNPPAFDEQPNTVDIFETGIKVIDLLTPYVRGGKIGLFGGAGVGKTVLVQELIHNIAKEHSGLSVFAGVGERTREGNDLYYEMIQGGVIDKTVLVFGQMNEPPGARMRVALTALTMAEYFRDHDNQNVLLFIDNIFRFTQAGSEVSALLGRMPSAVGYQPTLAIEMGKLQERIASTKTGSITSVQAIYVPADDLTDPAPATTFTHLDAKTVLDRNIAALGIFPAINPLESTSRLLDPSVVGINHYKVALGVQNILQRFAELQDIIAILGIDELSDEDKIIVERARRIRNFLSQPFFVAEKFSGIAGKYVSLNDTVQSFKEILEGKHDHLPEQAFFYVGTIQEAVEKAKRLNQEFDKTK

SEQ ID NO: 24059 - protein, 287 aa, Arabidopsis thaliana
MGQKRLLFLLAVFTFLVSSSYGRGVLKLKSDDDRPVYNHTLAVTLVEYASAVYESDLTKLFTWTCERCNGLTKDFEVIEVIFDVEHCLQAYVGVAKDLNAIIIAFRGTQEHSIQNWVSDLFWKQLDLNYPDMPDAMVHHGFYSAYHNTTLRPAVLDAITRVKKVYGANINIIVTGHSMGGAMASFCGLDLVVNEGEENVQVMTFGQPRVGNAAFASYYSLLVPNTFRITHDRDMVPHLPPYYYHFPQKTYHHFPTEVWVKDFSFSNFVLFGLEKVCDNTGEDPTCSR

SEQ ID NO: 24060 - protein, 228 aa, uncultured cyanobacterium
HEVAGAGQHELGMKFAELIQAADNVMTYKYVVRNVAKKYGKTATFMPKPVFNDNGTGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSD

SEQ ID NO: 24061 - protein, 228 aa, uncultured cyanobacterium
HEVAGAGQHELGMKFAELIQAADNVMTYKYVVRNVAKKYGKTATFMPKPVFNDNGTGMHVHQSLWKGGQPLFFGEGTYANLSQTARWYIGGILKHAPAFLAFTNPTTNSYKRLVPGFEVPVNLVYSEGNRSAAVRIPLTGPSPKAKRLEFRSGDALANPYLAFSAMMMAGLDGIKNQIDPGDGEDRDLFELPSEELSKIATVPASLNGALEALNTDRGFLTAGGVFSD

SEQ ID NO: 24062 - protein, 228 aa, uncultured cyanobacterium
HEVAGAGQHELGMKFAELIQAADNVMTYKYVVRNVAKKYGKTATFMPRPVFNDNGTGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAAAFSAT

SEQ ID NO: 24063 - protein, 480 aa, Salmonella enterica subsp. salamae
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAARQHTDSDPLMLVLAADHAIANEEAFRDAVRSAMPYADAGKLVTFGIVPDLPETGYGYIRRGDVVPGATDVVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 24064 - protein, 458 aa, Mycoplasma genitalium G37 [sequence omitted]

SEQ ID NO: 24065 - protein, 228 aa, uncultured cyanobacterium
HEVADAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLAFSAMLMAGLDGIKNQIDPGDGEDRDLFELAAEELSKIATVPASLNGALEALNADRAFLTAGGVFTD

SEQ ID NO: 24066 - protein, 480 aa, Salmonella enterica subsp. salamae
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAARQHTDSDPLMLVLAADHAIANEEAFRDAVRSAMPYADAGKLVTFGIVPDLPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 24067 - protein, 372 aa, Ralstonia solanacearum GMI1000
MIVFKLPDLGEGLQEAEIVQWHVQAGDTVEADQPLVSVETAKAIVEIPSPQAGRIARLFGQPGDIVHLGAPLVAFEGAGGGEADAGTVVGQMQVGQQVVREAPAVLAAAPGAAAGGIKATPAVRALARKLDVDLSMATPSGPDGVITAADVERVAKVFSELGPPEVLRGVRRAMAQNMARAQSEVAAATVIDDADIHAWPPGTDVTIRLIRALVAGCRAEPGLNAWFDGHAGRRHVLEKIDLGIAVDLPDGLFVPVLRNVAHRDAADLRAGLDRMRADIRARKIPPEELRGNTITLSNFGMIAGKYAAPVVVPPTVAILGAGRIHEQVVAAAGAPAVHRVLPLSLTFDHRVVTGGEAARFLAATIADLEAAH

SEQ ID NO: 24068 - protein, 228 aa, uncultured cyanobacterium
HEVAGAGQHQLGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEGLSANRAFLTEGGVFTD

SEQ ID NO: 24069 - protein, 480 aa, Salmonella enterica subsp. indica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRSAMPYADAGKLVTFGIVPDLPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLSCPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLIGENESIYIPLGATHCLENPGKIPLDLIEVRSGSYLEEDDVVRFEDRYGRV

SEQ ID NO: 24070 - protein, 189 aa, Glycine max
MATTDPENKSPTLPLPPAEVDYSKVDVILRFLLLAASVVALAVIVSSDQTEQVLFQDVLLPQPAKFKYSPAFVYFVAAFSVSGLYALVSALASISVIQKPGFKLKFLLHFIFWDALILGITASATGAAGSVAYIGLKGNSHVGWIKVCNIYDKFCRHLAGSIAVALFGSIVTVLLIWLSAFTIHSRVPK

SEQ ID NO: 24071 - protein, 84 aa, Glycine max
TFLIPHIPNLNIAAVNLTFINEHSQKELLNILNNVRRKKCLVIDPNLRDSLSLIIQTSILQDHDIELLHLSGHPIKTYLLKVNL

SEQ ID NO: 24072 - protein, 165 aa, Methanopyrus kandleri AV19
MRRLKIEGRAYIHPTATVLGEVELGQDASLWPGAVVRGDLEPVRIGRESNIQDNAVVHVSKGYPVEIGDRVSVGHGAVVHGATIEEDCLIGMNATVMNGAVIRRGSIIGAGAVVTEGTEVGPYEIWVGVPAKRIGTTDEERVDEIRENARRYLKLAREELPEWRG

SEQ ID NO: 24073 - protein, 245 aa, Frankia sp. EAN1pec
MPTLVLLRHGESTWNRENLFTGWVDVDLSEKGLKEATRGGELLQEAGVLPDVVHTSLLTRAIRTAWLALDAAGRTWVPVRRSWRLNERHYGGLQGLNKAETLAKFGDEQFLLWRRSYDTPPPPIEPGQPSGVDERYADLAPDVIPLTECLRDVVVRMLPYWYDSIVPDLRSGATVLVTAHGNSLRALVKHLDGISDTDIANLNIPTGIPLRYELDDDLKVLDSGYLDPAAAETAAAAVAAQGKKK

SEQ ID NO: 24074 - protein, 465 aa, Aspergillus oryzae
MGSIEELSTTRREGQGNEGLRIAQPAGSHDGSLLPTHNEKASLRRNRLFRIDTAGESGRSGIHPIHFLRVCLKSTCTLSMLVNVLWPFVPAAIVIHFARPDLHIWIFALNYIAMVPSANLLGFAGGELAKKLPKVLGVLLETTLSSVVEIVLFMVLIHNDINGNLIPVIQAAILGSVLANLLLCLGLCFFFGGMGREHQSFHEAVSEVGTGLLLVAGFGLLIPSAFFSALSANSSKTTITQEALSQSTLVISRATAVILLVAFLMYLVYNLHSHHSIFDEVLELDEHKDEDREEELKRAKLTLVECFVAISVSIACVCMSAVFLVQEIEHIVHERGVSDNFMGLILVPLVEKAAEHLTAIDEAWDNQINFALFHCLGPSIQTALLNAPLAVLVGWGLDKEMGLNFEIFMIVLVVLSILVVGNFLRDGKSNWLEGGLCVLIYVIIAVTTWYYPQIEAEGVSIHHEA

SEQ ID NO: 24075 - protein, 422 aa, Pseudomonas aeruginosa UCBPP-PA14
MSFDTISVIGLGYIGLPTAAVFASRRKQVIGVDVNSKAVETINQGKIHIVEPDLDMLVHAAVTNGYLRAVSVPEPADAFLIAVPTPFKEQHEPDLRYIESACKAIAPVLKAGDLVILESTSPVGATEQMSAWLSAERPDLTFPQSHGDASDIRIAHCPERVLPGHVLRELVQNDRVIGGMTATCSAAAASLYKIFVEGECVITNARTAEMCKLTENSFRDTNIAFANELSIICDKLDINVWELIRLANRHPRVNILQPGPGVGGHCIAVDPWFIVSKTPGEARLIRTAREVNDGKPLWVLNKIKMAVAEFLQANPERTAKDVTIACFGLAFKPDIDDLRESPAVSIAQNVKMSHPGTVLVVEPNIAELPEKLAERLDLVSINSALERSEVIVLLVDHKEFKEFSPCDLGAYKVIDTRGVWNA

SEQ ID NO: 24076 - protein, 339 aa, Aspergillus oryzae
MSCITTPAIPPVALESITQHIGNTPLVRLNRLPRSLGIEATVYAKLEYFNAGGSVKDRIALRMIEEAERSGRIKPGDTLIEPTSGNTGIGLALVGAVKGYKTIITLPEKMSAEKVAVLKALNATIIRTPNEAAYDSPESHIGVAKRLEKELPNAHILDQYGNENNPLAHELGTAEEVWTQTKGQIKAIVAGAGTGGTITGLSRGLKKHNPAIKVIAADPHGSILALPPSLNEDHVNEPYKVEGIGYDFIPQVLDQQAVDQWYKTGDKDSFQYARRLIAEEGLLVGGSSGSAISALAQAAKDYNFGKDDVVVVILPDSIRSYLTKVIELPNGWLRTCCAN

SEQ ID NO: 24077 - protein, 333 aa, Clostridium acetobutylicum ATCC 824
MDLIESIWECAKQDKKRIILAEGEEKRNLIAADKIIKEGLAELVLVGDENKIKEKASELNLDISKAEIMDPETSLKTETYARDFYELRKHKGMTIEKSEKMVRDPLYFATMALKDGYVDGMVSGAVHTTGDLLRPGLQIIKTAPGVKIVSGFFVMIIPDCDYGEEGLLLFADCAVNPNPTSDELADIAITTAETARKLCNVEPKVAMLSFSTMGSAKGEMVDKVKNAVEITKKFRPDLAIDGELQLDAAIDSEVAALKAPSSNVAGNANVLVFPDLQTGNIGYKLVQRFAKAKAIGPICQGFAKPINDLSRGCSSEDIVNVVAITVVQAQRGI

SEQ ID NO: 24078 - protein, 604 aa, Ustilago maydis
MAQPAVRQPTVTRSRISRPGGIPASRSGDRIHLTEAASTSHLAKAKSTKLVGPSTAGKLRADSRSMPQRAALSDVSNRAGVARANALADGAVKLAPGHNGLRSQHTKSMTRLRDARSRSTSEQRLSGPTRSVSEQRDCAPAAAESMHVEASQLLPPFQSSASVKVGISDEAGSSRLHEDADIRDLAGSQHSDHVEEDEMSDVASTSSSDDDTAEDIGVDKANWLDSERLDAGARPESVTSAEDGDMLDFNIDPEGLVSLHPELEEAARRKVALIKSRYQEEVIQPRAARAQAQHAEAVAAGQLSAELAAHEDELIVMGLDPEEVRDTSMVAEYSNEIFSYMARCERETMANPNYMEFQSEIHWHMRATLVDWLLQVHMRYHMLPETLWIAINVVDRFLSVRVVSLAKLQLVGVTAMFIAAKYEEILAPSVKEFVYMTEGGYSQEEILKGERIILSTLGFNISSYCSPYSWVRKISKADDYDIRTRTLSKFLMELALLDHRFLRARPSLVAAVGMFLAKKMLGGEWDDAFVYYSDFTEEQLVPGANLLLERLLDQGFEEQFVYRKYSNKKFLRASVFARDWAFQNHSALLAAAAAAAGSTQAGQP

SEQ ID NO: 24079 - protein, 170 aa, Physcomitrella patens subsp. patens
MVTANKPNRSEEIGTPEEQGQRAQEVRAYLDANAPRRPLKPSRSDAADMLAQVESNHTVVSDPPEQKKFLQLLANGVPLEMLGNAEVDEDYTESEYYQYKSAIDKAHHTTGSGFIKIEKTPQGFHLSTNPQSYHTREHHRCNPAMNDWEPAPNSSESISNKPLRSESMDS

SEQ ID NO: 24080 - protein, 248 aa, Chlamydia trachomatis D/UW-3/CX
MSGLLVNKTAIVTGGSRGIGFSIAKLFAEQGANVQIWGINGEAGQAAAQTLSEQTGRQVSFALVDVSKNDMVSAQVQNFLAEYNTIDVIVNNAGITRDALLMRMSEEEWSSVINTNLGSIYNVCSAVIRPMIKARSGAIINISSIVGLRGSPGQTNYAAAKAGIIGFSKALSKEVGSKNIRVNCIAPGFIDTDMTKSLNDNLKNEWLKGVPLGRVGMPEEIAKAALFLASDGSSYITGQVLSVDGGMA

SEQ ID NO: 24081 - protein, 507 aa, Ashbya gossypii ATCC 10895
MSKNAEGNNKENGSESDLSVTIKLPNGVEYEQPTGLFINNEFVRSKLGGMMEVIAPATEEVVTRVYEGTSEDVDIAVSAAQKAFKSGKWFGADPMVRVKALSKLADLIEEDLEVIASIEFLDNGKVFSHARFDIGMVVNYLRCCAGLADKVDGRSIDTGSSHLTYTRREPIGVCGQIIPWNFPLLMWAWKVGPALATGNTVVLKTAEFTPLSALYVSNHVRKAGIPAGVVNIISGYGKTVGEAIIRHPGVKKIAFTGSTATGRHIYEVAAKDLKKVSLELGGKSPNIIFADADLKKAAQNVLNSIFFNGGEVCCAGSRMYIEEPIYEEFLQEIKAVAESVKVGDPSWKDTFQGAQTSQMQLDKILSYIEIGKQEGARVVTGGERLGEKGYYVKPTIFADVREDMRIVKEEIFGPVVTVTKFTNIDDLLEMANDTQYGLAAGVYSSSMKKAIDVANRLDAGTVWINTYNDFHCSVPFGGYKGSGFGREMGAEVVENYTQVKAVRALLL

SEQ ID NO: 24082 - protein, 417 aa, Prochlorococcus marinus str. MIT 9211
MQDLKINRLALRSGAECISTSMPESALTCIDLWCKAGSSFEDSDEKGMAHFLEHMIFKGSSKLREGEFDLKIEALGGSSNAATGFDDVHFYVLVPSEGVEQAIKLLIELVLCPSIMKNAYSLEREVVLEEIAQQSDQPDEKVFQMVLEGCWSNHPYGKSILGNASSLNASTPNRMKLFHQRLYKPENCVLSIAGKSPRNLLKILSEGELGKQVDKSNPNNSKPNSKKLNFNIGRKIVEVKRLESARLVMAWPVPPASEQFIIMGYDIATTLLGEGRRSRLVNNLREEQQIVESIEMDLTALEQGGLVLLEACCIEKNLNKVEDSINQILIESINSPPSERETKRAKELVRNGFCFSLEHPAQVAAITGTQTLWNRHQPLLEPLKDIDGWSSSMIQEEIFSCLQPSQCFTLIAKPLSS

SEQ ID NO: 24083 - protein, 228 aa, uncultured cyanobacterium
HEVAGAGQHELGMKFAELIQAADNVMTYKYIVRNVAKKYGKTATFMPKPVLNDNGSGMHVHQSLWKGGQPLFFGEGTYANLSQTTRWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGVDVDLFELAADELKKIATVPASLNGALEALNSDHHYLLEGGVFTK

SEQ ID NO: 24084 - protein, 394 aa, Vitis vinifera
MQKPQGESVSGVHTESETTGKVITCKAAVVLGPGQPFVIEEIQVDPPQKMEVRVKILYTSICHTDLSYWKGESEAYRVYPRILGHEAAGIVESVGEGVVDMRKGDHVIPIFNGECGDCVYCKCDKTNLCERFRVHPLRSVMVNDGNCRFSTKDGKPIFHFLNTSTFTEYTVLHSACVVKIDSKAPLKKMILLSCGVSSGLGAAWNTAKVQAGSSVAIFGLGSVGLAAAEGARTRGASKIIGVDINPNKFIKGKAMGLTDFINPNDSKNPVHEIIQEMTGGGVDYSFECAGNLDVLREAFLSTHEGWGMTVLLGIHPTPRMLPIHPMELFDGRRIIGSVFGDFKGKTQLPHFAQQCMRGVVNLDEFITHELPFEKINEAFQLLADGKSLRCVLHL

SEQ ID NO: 24085 - protein, 325 aa, Chlamydomonas reinhardtii
MAAAEAPPATPQLSAADVEAEMAAHVSGIKPQLQNVVATVNLGTKLDLKEIAMHARNAEYNPKRFAAVIMRIREPKTTALIFASGKMVCTGAKSEDDSRTAARRYAKIVQKLGFPATFKEFKIQNIVGSCDVKFPIRLEGLAYAHSLFASYEPELFPGLIYRMKQPKIVLLIFVSGKVVLTGAKTRGEIYQAYMNIYPTLIQYKKGDAVVPTLPNNLMGPPRALPAAKQGGQADVGEPQQAQEQDGAGPSGSGAQAQAQAQQQYQQQAAAGMMPPPPVAATPAPDPNLPPPTPMHHHLPPPTPRHPGLAATPSLSHHLPPPSPRR

SEQ ID NO: 24086 - protein, 211 aa, Staphylococcus aureus
PSADMLFEPSFVNDIDVNENDVVHFCSVDLIDSPMREAHYQLITKTLNANGTVVFDPNVRLPLWDNAEDLRQTIHTFLPLAHIVKVSDEELEFITGIHDENKAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 24087 - protein, 797 aa, Zea mays
MHLLAVLCGVIFSLLQLHTPTRSAATDTLSRGGSLAGDETLVSSNGKFALGFFETKSNNSTHNASNSYLGIWFHKVPRLTPVWSANGNNPVSSTASPELMISDDGNLVIIAATGTKVWSTQANITANISVVAVLLADGNLVLRSSTNSSDVFWQSFDHPTDTLLPGAKLGRNKATGLDRRFVSRRNSNDQAPGVYSIGLAPDGVDESMRLSWRSSTEYWSSGEWNGRYFNGIPEMSDPSYCNYMFVSSGPEFYFSYTLVNESTAFQVVLDVSGQWMVRVWDWDRNDWITFSYSPRSKCDVYAVCGAYAVCSSNADPVCSCMKGFSVRSPEDWEMEDRTGGCIRDTPLDCNATSMADRFYPMPFSRLPSNGMGIQNATSAKSCEGSCLSSCSCTAYSYGQGGCSLWHDDLTNVAPDDTGETLYLRLAAKEVQSWKHHRHGMVIGVAVGVSAVTATLVFIFLIWRRSSRRSSHPADSDQGGIGIIAFRYADIKRATNNFTEKLGTGGFGSVFKGCLGESVAIAVKRLDGAHQGEKQFRSEVSSIGIIQHVNLVKLVGFCCEGDRRLLVYEHMPNRSLDVHLFHQSAHGSGTTGLRWDIRYQIALGVARGLAYLHHSCQDCIIHCDIKPQNILLDASFVPKIADFGMAKFLGRDFSRVLTTMRGTVGYLAPEWISGTAITSKVDVYSYGMVLLEIVSGRRNAGREASTDDDCCHAKCCFPVQVVDKLLNGGVESVVDASLGGDVNLDDVERVCRVACWCVQDNEYDRPTMVEVVQFLEGLSEPDMPPMPRLLHAIAGGSP

SEQ ID NO: 24088 - protein, 77 aa, Clostridium acetobutylicum ATCC 824
MVFEKVKDIIADQLGIDATEIKMESSFIDDLGADSLDIVELIMALEEEFDIEMPDEEAEKVSSVGDVVNYIKAHTEE

SEQ ID NO: 24089 - protein, 393 aa, Aspergillus oryzae
MATKTLESRFEHLSVKDENVSNNSCSTYAKNKGSLSTAVSVSGLGTTAQLNNSANRSNLLKLALQNTNDNKVNSINVSSSPTKGTLSHRNVDENGDQRHQTSLYDQPAPKKLHLGMFEIGKPLGKGKFGRVYLAKERSSGFVCALKVLHKSELQQGGVQKQVRREIEIQSNLRHPNVLRLYGHFQDSKRIFLILEFAGRGELYKHLRKEHRFPEWKAAQYIAQMAAALKYLHKKHVMHRDIKPENILVGIHGEIKISDFGWSVHAPNNRRQTMCGTLDYLPPEMLKPGSQDNYYSEKVDLWSLGVLTYEFLVGEAPFEDTPVMTQRRIARADMTVPSFVSPEAKDLIKRLLVLDPEKRISLDEIQKHPWILKHCLKDDRATKRSSGSSKEGKA

SEQ ID NO: 24090 - protein, 450 aa, Physcomitrella patens subsp. patens
MPPSVVQDSFPSTPGKVKVERSSYFGRVASRWHSTASARLLVFSAFLLAVTIFICFRIAANGFVDVYIGGTAYSSTNGGTIRSAYRSDHLWDKKVRQSCTPKRENGLVVLVTGAAGFVGSHVSLALKKRGDGLVGIDNFNDYYEVSLKRARQEMLLKQGIFVIEDDINDAALWSHLFEMVRFTHVMHLAAQAGVRYAMQNPMSYVHSNVAGLVTLFEACKNANPQPAVVWASSSSVYGLNTKVPFSESDRTDQPASLYAATKKAGEEIAHTYNHIYGLSITGLRFFTVYGPWGRPDMAYFSFTRDILKGKPINIYQGPHDKDLARDFTFIDDIVKGCVGALDTAGESTGSGGKKKGPAMLRLFNLGNTSPVTVPVLVELLEKHLKVKAVKQFIKMPRNGDVPFTHANVSLAQAQLAYKPTTNLDTGLKKFVTWYLKYYNVQSTKSTRRLL

SEQ ID NO: 24091 - protein, 604 aa, Physcomitrella patens subsp. patens
ELASGLDVINNLGLDTLTFLGATVLVVPAFKAVKQSPILGFLLAGVVLNQLELIRSVTDVKALAELGILFLLFEMGLELSLARLKALAKFAFGIGLAQVVLSTLAFTAFELPPNKAIGTQILEFLFHARPDLVNIRTVDEAVVIGAALSLSSSAFVLQLLAEKGELPTRFGSATLGILLLQDIAVVPLLVILPILETGNIADSNLWPVLASESLKALLGLGLISLGGRLFLRRLFEIVANSRSSEAFVAMCLLTVTGTSLLTQKLGFSDTLGAFLAGALLAETNYRTQVEADIRPFRGLLLGLFFVTTGTSIDIQLLTREWPNVLALLAGLIAIKTAIITAIGPRVGLTLSESVRTGLLLSQGGEFAFVVFSLANRLGVLPLELNRLLIIVVVLSMALTPLLNEVGRKAAEYIEREFEDVSPTDSNFEANEPVVIIGFGQMGQVLANFLSTPLATGLGGDAAGWPYVAFDLDPGRVKAACKLGFPVLYGDGSRPLVLQTAGITQPKAVMVMYTGRQKSVQSVERLRQAFPQVPIYARAQDLGHLLELKHAGITDCILENAETSLQLGSVLLRGLGVMSDDVRFLRRMMRESMELRAQETVEKKE

SEQ ID NO: 24092 - protein, 482 aa, Prochlorococcus marinus subsp. pastoris str. CCMP1986
MLEILSHQYLKRFIRSHDIDWDHIYSFGRIISKCLQTNETYLINSEIFSTNIWQPALLISIFLFEENSTFVLSQDKINFLKNNYLGELKRLGLNFILENDQIIFSNHRVSFISLEKLLGDVNIFNARNHRIIFSGIENIKEDLKNYFRISFLKKNWFHNFEQASSKSQKIISTYNLLKKKFFLRKVLDSRSIFLDKEEINFLSNFFFENSSYSDQFLRVSNALSAGWACWVTLDDINFEWNFYLEPMDELSQIKHLLINNKFVFLSALREDNFFQKYLKKESLNIDLVMNFRSNFIENKILIYVPPRQMLPNNPMFTKNILDKSKKLIIFSKGLTLFLSDDVDLKLKFATELASIYGKRVLLENIPLFNNEILCASYTWWINNSYCIQSPEQIIIPLLPIPSIKEPINKLTISHNRNLSKDWFREFLLPEAIKKLERSISPLRKNAGKLIILDGRAHKRKWGRLILKSIQPSKQINYMLPYD

SEQ ID NO: 24093 - protein, 292 aa, Prochlorococcus marinus subsp. pastoris str. CCMP1986
MQKIPHIELNEICYQLGEGSPKSIKQVFGGDIHESWQIEFKNAKFFLKRNAREGRFLEFEKSCLNNLQKYLNYENLIVPKIISYLEVNNVELLLLEWIDMKNSDQEKLGRGLGEMHIESNKFNQPNFGYPIHGFIGTTNQIKGWEKDWIKCFINLRIEPQLAILEKDFLEIDIKNKIKSKIESVLLDHEPMKSLVHGDLWSGNIGVTLMNKGVIFDPASWWADCEVDIAMTRLFGNFRNEFYQNYHKIIPIKKGSERRTIIYNFYHILNHANMFGGSYCHQVQSYIRNILSM

SEQ ID NO: 24094 - protein, 429 aa, Chlamydia trachomatis D/UW-3/CX
MVSLLKMPKLSPTMEIGILVKWHKKAGDEIHFGDVLLEISTDKAVLEHTASEDGWLLEILVEEGTKTPIGTPIAVFSTEQNAQYDLKQLLPLEGTVVTDAATEASPKNSAQTDSQYTSGPSITMMGFRPEPPLAIPLTIKHSNDPVLASPLAKKLAKEQNLDLSGVTGSGPGGRIVKKDLEKAPPLRIAGFGYPEAPNVNPGSYIEEPLSPVREVISKRLQAAKTFIPHFYVRQRIYASPLLALLKELQEQNIKLSINDCIVRACALALKEFPEINSGFNSVDNKIIRFSTIDISIAVAIPDGVIAPIVRCADRKNIGMISAEIKGLATKAKQQSLAEEEYKGGSFCVSNLGMTGISDFTAILNPPQAAILAVGSVEEQPVVLNGELAVGLTCMLTLSVDHRVIDGYPAAMFMKRLQRLLEAPSVLLLN

SEQ ID NO: 24095 - protein, 528 aa, Physcomitrella patens subsp. patens
MPHSLLLLKEPFKLDSILEPAPPGPFTTLTKIVGTLGPKCRSVEMLERLLRAGMSIARFDFTWGSDAEHQETLNNLRTAIKNTRRLCAIMLDTVGPELSINNAANQAIELKQGDVVTLSPDKKEVASSKILPINYADLSYQVKPRDEIFVGQYLYTGSETTSVWLEVQDTHGSVVDCLIKNTATLTGTLFTAVPAGIRIGLPTLSEADRSTIETWGVRNQIDFVSLSYTRHANDVRTTRGFLSRLGDLKQTHVYAKIENKEGLEHFDEILREADGIILSRGNLGIDVPAEKVFVFQKAAIKKCNYAGKPVIITRVVDSMVDSPRPTRAEATDVANMVLDGADCIMLGAETYRGNYPVESVTTVRLICGEAEKVFNQAMHFKKMCKFVGEPMAHLESIASSSVKAAIKVNASVIVVFTSSGKVARLVSKYRPSMPVLVVVIPRLSTDKMRWTFTGAIQARQCLISRGLFPMLADPRHPADTSSNCTNESILKVALEHGKAAGIINVKDRVVICQKIGDSSIVKILEIES

SEQ ID NO: 24096 - protein, 583 aa, Oryza sativa Indica Group
MPSRMMQAFAQEASDFDRQMGCMAGMFQIFDRRRLLTARQRGGARGTAPPGHVLPNSNSNVSIQNPVASNNTLVYDDDARDGAIGFPMAVQAGTPATPISPQVISGAFVQQYYHILHETPDQVYKFYQDASIVGRPDSNGVMKYVSTTADINKIILSMDFSNYLTEIETADAQLSHQDGVLIVVTGSLTSEGICRRFTQSFFLAPQESGGYVVLNDIFRFIVERPPVAISQVSQENENNQNTATLPETDPNPAGDGMISEPVAVENNVAEGEVTNSTVDGTSIENNATAAVEPPVQMTKEEPRKISVAAPPPPAQKDVTKKSYASITLTMIALQVKVMKEVSLTPVVKPKPAPKHVVKTVEASEKPSVKSSQTVEITPNDNNDAENNTSNDEQGYSVFVKSLPHNVTVQTVEEEFKKFGAIKPGGIQVRNNKIDRFCFGFIEFESQQSMQAAIEASPIHMGGKEVFVEEKRTTTRVVNGVVITRGDNGNAGGGGRYQSGRGGYRGDNFRGRGGGYANSGNYRGGDNFSRRNDLRNRNEFSGRGRGPPPGNGYQNNGFHPARPFQNGNGRFTRVNGPRQTPVAA

SEQ ID NO: 24097 - protein, 405 aa, Zea mays
  misc_feature (53)..(53): Xaa can be any naturally occurring amino acid
MRKKGRAVPEWLNSPIWSATPPAPAQPDPYGADLAPPPPPKPPPPPATASPVXSDFKAALSKKVVNMGELRRLACLGVPDGGTGVRPVVWKRWWFLLLGYLPTDRSLWTYELEKKRSQYSAYREEFLLNPSEKLRMIEETKLSRKKDTSIERIGFLSRFEVTNEEHPLSSGKSSLWNQYFQDSELLEQIDRDVKRTHPDISFFSSKSNQESLRRILIIFSKLNPSIRYVQGMNEVLAPLFYVFKNDPDPSNSASAEADAYFCFVELLSGFRDNYCKHLDNSSVGIRSTLSKLSQLLKRHDEELWRHMEVTTKVYPQYYAFRWITLLLTMEFSFNVCIHIWDAILGDPEGPSDTLMRICCAMLILVRKRLLAGDFTANVQLLQHYPATNIDHLLHIANRLRGTVPG

SEQ ID NO: 24098 - protein, 547 aa, Corynebacterium diphtheriae NCTC 13129
MSFDVTTTEPWATLSERYTAMKATTLRDLFASNPNRAQELSFEAAGLHVDLSKNLIDAETVAAFTALAKASGMREKIKAMFDGEHINNTEDRAVLHTALRLAVDAELNVDGQDVAADVHEVLGRMRDFATSLRNGSWRGYSNHTIKTIVNIGIGGSDLGPAMATKALRTYATAGINAKFVSNVDPADMHAVLDELDPESTLFVVASKTFTTQETLANAHAAKRWLVAAAGGDESAVAKHFVAVSTNAEKVAEFGIDTKNMFGFWNWVGGRYSVDSAIGLSLMSVIGPMDFMRFLDGFRAMDEHFRTADFESNIPVLMGMLNVFYNDFFGAETHAVLPYSQDLGRFPAYLQQLTMESNGKSVRHDGSAVTTNTGEIYWGEPGTNGQHAFFQLIHQGTKLIPADFIGFARPKEDLPTASGEGSMHDLLMSNFFAQTKVLAFGKTAEEIAAEGVSPELVAHKVMPGNRPTTTIMAEELTPFALGALIALYEHIVFVEGVIWDINSFDQWGVELGKQQANDLAPAVAGEVAVDSGDSSTDALISWYRSHRG

SEQ ID NO: 24099 - protein, 366 aa, Prochlorococcus marinus str. MIT 9211
MPERLLLGPGPSNSNPSVLKAISLQPVGHLDPFYINLMAEVQSLLRYCWQTKNRLTLPMSGTGSAAMEATIANVVEEGDTVLIGIKGYFGNRLADMAGRYRANVKTIEKDWGEAFTLDEIEAALIEHRPSVFALVHAETSTGVCQPMEGIGDLCRKYDCLLLLDTVTSLGGVPLFLDEWKVDLAYSCSQKGLSCPPGLGPFTINERAEAKLNRRSDKVPNWYLDISLLNKYWGSDRVYHHTAPVNMNFGMREALRLIHEEGLENSWARHRTNAESLWNGLEDLGLELHVDKDIRLATLTTVRIPSGVDGKAFTSHLLNNFGIEIGGGLGSLAGNVWRIGLMGYNSKVENVEKILEIFDSELPKFKS

SEQ ID NO: 24100 - protein, 363 aa, Vibrio fischeri ES114
MTNKTYKIAVLPGDGIGPEVMEQAHKVLDAIEKKHAISFSREQHDVGGIAIDNHGCPLPESTVKGCEESDAVLFGSVGGPKWEHLPPNDQPERGALLPLRKHFQLFCNLRPAQIHKGLENFSPLRADISERGFDIVVVRELTGGIYFGQPKGREGEGPQEKAYDTEIYHRYEIERIAKIAFESARLRNKNVYSIDKANVLQSSILWREVVEEVAKGYPDVTLNHMYIDNATMQLIKDPSQFDVMLCSNIFGDIISDECAMITGSMGMLPSASLNESNFGLYEPAGGSAPDIAGKNIANPVAQILSAALMLRYSLGEEEAAQSIEAAVSKALSAGELTADLAGDKPALTTSAMGDKIAEYILNS

SEQ ID NO: 24101 - protein, 521 aa, uncultured bacterium
MNHDRILILDFGSQVTQLIARRIREAHVYCEVHSCDVSDEFIKEFKPSGIVLSGSHMSAYEESTDRAPKAVFEIGVPVLGICYGMQTMAEQLGGKVENGAQREFGYAEVREHGHTKLLKNISDFTDKDGKSYLKVWMSHGDKVTEMPPGFKLMCSTPTCPIAGMADEGRGFYAVQFHPEVTHTEKGREILETFVLKICKANPDWVMGNFAQEAVEKIRHQVGKDEVILGLSGGVDSSVTAALIHRAIGDQLTCVFVDNGLLRLHEREQVAQTFRDNMGMKLIVVDASDRFMDALAGVTDPEAKRKIIGRLFVEVFQEEAEKLQNAKWLAQGTIYPDVIESNGAKTKKAQTIKSHHNVGGLPDTLHLKLLEPLRELFKDEVRELGIALGLPAEMVYRHPFPGPGLGVRILGAIKREYADLLREADAIFIEELRNAGWYDKVSQAFVVFLPVKSVGVMGDGRTYDWVVSLRAVQTSDFMTAKWAHLPYDLLGKVSNRIINEVKGINRVVYDVSGKPPATIEWE

SEQ ID NO: 24102 - protein, 191 aa, Zea mays
GGEGSSDPAVAVKKLLHEDPYTAGEIEKITGEGLTSVFQGSQTSLDVIKAAKPYKLFQRATHVYFEARRVYAFRDTVFSKLSEEGKLKKLGDFMNESHYSCSVLYECSCPELEELVKVCRDNGALGARLTGAGWGGCAVALVKEPIVPQFILKLKEMYYKSRIDRGVIKQGDVGLYVFASKPSSGAAILRL

SEQ ID NO: 24103 - protein, 464 aa, Salmonella enterica subsp. enterica
MSNIILPVVMAGGAGSRLWPLSRALYPKQFLSLTSTNSMLQETIIRLEGIEHEYPLFICNEEHRFIVAEQLRQLSIDHSGIILEPDGRNTGPAIALAAFHALNNGYDPVMLVLAADHEIQERKNFIDSIEIAKQFAENDKLVTFGIVPASPETGYGYIKVGEKIGPDGYKVAAFVEKPHRLLAEEYINSGKYLWNSGMFMFKASVFLNELKKFRPDIYSICETSLLKSESDLDFIRVNGKVFNCCPSESIDYAVMENTMQAVVVPLDAKWSDVGSWTALWDISKKNENGNIIRGDVIAKDTDNCYLHSESRLIGTVGVKDLVIVETKDAVLVAHKNNVQDVKNIVEQLKIQNRQEYLHHREVYRPWGSHDAVADGERFRVKHVTVLPGHAISKQVHYHRAEHWVIVSGTARVYIGDENFLLGENESTFIPVGTVHSIENPGKIPLEIIEVQSGTYLHEDDVERS

SEQ ID NO: 24104 - protein, 572 aa, Mycoplasma genitalium G37
MKKIIGIGVSDGIAVAKAFIIQTPQFDVKKYTNVKMTPTQAKKLLSSAFQKAKKDLEEIKTITVKNINQEAGMIFDAHIQILNDPTITEQLEQQLNKNIHPVIAVDNVFQQTALMFSEMDDKYFKERASDILDLHQRLLSYLTGVKLNDLIRIKSDVIIVANDLTPSQTATLNKKYVKGFLTESGGKTSHAAIMARSMEIPAIVGLKNITSKVEDGKTVGINGRKGIVGFDFSSKDITQWKQEKELESNFQNELKQYTNKLVKTLDGYEVIVASNIGNVKDMDLAVEYNTNGIGLFRTEFLYMSSQDWPDESVQFEAYKTVLQKAKNDLVIIRTLDIGGDKKLNYFQFPHEDNPFLGYRAIRLTLDKQAVFKTQLRALLRASDYGNLGIMFPMVATLDELVQVKQLLTKVQQEFNETKKFKLGIMIEIPSAALAADCLGKHVDFFSIGSNDLIQYSFAADRMNKNVSYLYQPLNPALLRLIKLVVEGGKLNNVWTGMCGEMASDQYAIPLLLGLGLTELSMSASSMFKARMVIAKITINECKSLVEKALKLTSDSAVRKLVENFFKKKNIFI

SEQ ID NO: 24105 - protein, 211 aa, Staphylococcus aureus
PSADMLFEPSFVKDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 24106 - protein, 548 aa, Mycobacterium tuberculosis
MTSVTDRSAHSAERSTEHTIDIHTTAGKLAELHKRREESLHPVGEDAVEKVHAKGKLTARERIYALLDEDSFVELDALAKHRSTNFNLGEKRPLGDGVVTGYGTIDGRDVCIFSQDATVFGGSLGEVYGEKIVKVQELAIKTGRPLIGINDGAGARIQEGVVSLGLYSRIFRNNILASGVIPQISLIMGAAAGGHVYSPALTDFVIMVDQTSQMFITGPDVIKTVTGEEVTMEELGGAHTHMAKSGTAHYAASGEQDAFDYVRELLSYLPPNNSTDAPRYQAAAPTGPIEENLTDEDLELDTLIPDSPNQPYDMHEVITRLLDDEFLEIQAGYAQNIVVGFGRIDGRPVGIVANQPTHFAGCLDINASEKAARFVRTCDCFNIPIVMLVDVPGFLPGTDQEYNGIIRRGAKLLYAYGEATVPKITVITRKAYGGAYCVMGSKDMGCDVNLAWPTAQIAVMGASGAVGFVYRQQLAEAAANGEDIDKLRLRLQQEYEDTLVNPYVAAERGYVGAVIPPSHTRGYIGTALRLLERKIAQLPPKKHGNVPL

SEQ ID NO: 24107 - protein, 203 aa, Arabidopsis thaliana
  misc_feature (128)..(128): Xaa can be any naturally occurring amino acid
  misc_feature (152)..(152): Xaa can be any naturally occurring amino acid
  misc_feature (161)..(161): Xaa can be any naturally occurring amino acid
MARGRKLTMSQSERYLGSSYSYGDSNGNSATDESELTEEDIWSHAVDHSPEMLESHGAWNTRDAVVRNGRVGGGLSLAFEDASSSPRIVHQIRGGGEGGGGGGGGGRVERQLASSAPVNVPDWSKIYXRVNSVESIHESDEEEEEDSGMMMXPPHEYLAKXQQRRSRKSGGGGSVFEGVGRTLKGRELRRVRDAIWSQTGFYG

SEQ ID NO: 24108 - protein, 523 aa, Corynebacterium glutamicum ATCC 13032
MSLQTNHRPVLVVDFGAQYAQLIARRVREAGIYSEVIPHTATADDVRAKNAAALVLSGGPSSVYAEGAPSLDAEILDLGLPVFGICYGFQAMTHALGGTVANTGKREYGRTDINVAGGVLHEGLEACHKVWMSHGDAVSEAPEGFVVTASSEGAPVAAFENKERKMAGVQYHPEVLHSPHGQAVLTRFLTEIAGLEQNWTAANIAEELIEKVREQIGEDGRAICGLSGGVDSAVAGALVQRAIGDRLTCVFVDHGLLRAGEREQVEKDFVAATGAKLVTVDERQAFLSKLAGVTEPEAKRKAIGAEFIRSFERAVAGVLEEAPEGSTVDFLVQGTLYPDVVESGGGSGTANIKSHHNVGGLPDDVEFKLVEPLRDLFKDEVRAVGRELGLPEEIVGRQPFPGPGLGIRIIGEVTEDRLETLRHADLIARTELTEAGLDGVIWQCPVVLLADVRSVGVQGDGRTYGHPIVLRPVSSEDAMTADWTRLPYEVLEKISTRITNEVPDVNRVVLDVTSKPPGTIEWE

SEQ ID NO: 24109 - protein, 503 aa, Burkholderia xenovorans LB400
MSATAAIATVKLLINGEFVESKTTEWRDIVNPATQQVLARVPFATTDEVNEAIRSAHAAFKTWKDTPIGARMRIMLKYQALIREHMPRIAKTLSAEQGKTIPDAEGDIFRGLEVVEHACSIGTLQQGEFAENVAGGVDTYTLRQPIGVCAGITPFNFPAMIPLWMFPMAIVCGNTFVLKPSEQDPLSTMQLVELALEAGVPKGVLNVVHGGKEVVDALCTHELVKAISFVGSTAVGTHVYRLGSEHGKRVQSMMGAKNHAVVLPDANREQTLNALAGAGFGAAGQRCMATSVVVLVGAAQQWLPELVAKAKTLKVNAGNEPNTDIGPVVSRAAKQRILGLIETGVKEGATLALDGRDVKVPGYEQGNFIGPTLFTDVTTEMEIYRQEIFGPVLVVLSVATLDDAIELVNRNPFGNGVGLFTQSGAAARKFQSEIDIGQVGINIPIPVPVPFFSFTGSRGSKLGDLGPYGKQVVQFYTQTKTVTARWFDDDTVNDGVNTTISLR

SEQ ID NO: 24110 - protein, 474 aa, Skimmia anquetilia
LAKKNLGHIVQIIGPVLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVDTRTTSPIHKSAPAFIQLDTSLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALAMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKAT

SEQ ID NO: 24111 - protein, 476 aa, Escherichia coli
MAKYNINPVILCGGNGTRLWPLSRGLYPKQFLNLDDTSSMLEKTINRLEGLDVSLPLVICNEQHRFIVAEQLRTLKKLNRNILLEPIGKNTAPALALAALYNINFNSNSLLLVLAADHVINDNQSFVTSIKKAIPYAIEGKLVTFGIEPTKPETGYGYIKKGNECSSIAIGDGYHVERFVEKPNFSSACDYISSGEYLWNSGMFLFEPHKYLSELRKYQPDIYNACVDAFKYDLIDNDFIRVDPLSFSQSPSLSVDYAVMEKTSDAVVVPMNAEWSDVGSWAALWEISNKDDDGNVLHGDVISLSTKNSYIYSESELVTTIGIENLAIVQTKDAILVSNLASTQDVKKLVEILQLNGRTEHYVHQERYRPWGKSDTIDTGDSYQVKMLTIMPRENLSMQVHYKRAEHWVVLSGCARIVIDGFESILNENESVHIPVGVKHYLENIGNTPLRIIEIRSGSYLEEDDIIRFSDNDGYV

SEQ ID NO: 24112 - protein, 124 aa, Burkholderia mallei ATCC 23344
MAIAKEDILAAVEGMTVLELNELVKAFEEKFGVSAAAVAVAGPAAGGAAAAAEEKTEFTVVLAEAGSNKVAVIKAVREITGLGLKEAKDLVDGAPKPVKEGVDKASADEAKKKLEDAGAKVELK

SEQ ID NO: 24113 - protein, 249 aa, Bradyrhizobium japonicum USDA 110
MTISDDNDLTRLKEIGRIVANTLEAMGKALEPGMTTSELDQIGRRFLETAGARSAPELAYAFPGATCISVNEEIAHGIPGDRRIARGDLVNIDVSAEKNGLFADTGASFAVPPVTRAIERLCRDGRRAMWTGLRQVGAGKPIAGIGQAIGTFARKNGYSLVRNLASHGVGLSLHEEPTEIATWPDSSERRIMSDGLVFTVEPFLSLAAEWAENGDDPWTLYSSPEAPTVQYEHTVVATRHGPLIVTMAG

SEQ ID NO: 24114 - protein, 494 aa, Corynebacterium diphtheriae NCTC 13129
MTHTTQTLDDRIHELLQRIPTELFIAGQFQPAHNGATLSVTNPSDGSELATVASASEKEARAALDAAEKAQPTWAATPARERSEILRRAYDLVIEHKDDLAMIQSLELGRALPDSEAEVTYAAEFFRWFAEEAVRIRGDYRHNPTGNARIITHQQPVGPCLAITPWNFPLAMGARKLAPALAAGCTMILKPASKTPLTMLYLAQLLAEAGVPHGVVSVLPTANASVVSDLLHDARIRKLTFTGSTAVGQKLAAMAAEHSAAVSLELGGNAPYIVLDDADIDTAAQAVAVAKMRGAGQVCIAANRFLVHSSIAEEFTQRVVNIMRGFTQGPATAPGVDFGALSGDDQVSTVTTLVDDALSRGATKLLGDLPKGLPEHGSYYPATVLVDVPEDADIHCEEIFGPVVVISTFDDDDEAVARANDTKFGLAAYVFGSDLQRVLNVAERVDAGMIAVNKGALSDPAAPFGGVKESGLGREGGFEGIGEFLETKLISLPL

SEQ ID NO: 24115 - protein, 479 aa, Campylobacter jejuni RM1221
MTTYLNYIDGKFIPHNGEFIEVLNPATKEVISRVASASLEDTKRAIEAAKKAQKVWEAKPAIERANHLKEIASLIRKNANFLTEVLMQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSVYDEFVDKFVKAMSKVSVGNTLKGDFDMGPLVNQAGVDNALAMLQRATAKGAIVECGGKIIDTSGYYFPASVLTNVKHEDEIMQKEIFAPILPIAKFDTLDEAIDMANDCEYGLTSSIYTQNLDIAMRASREIKFGETYINRENFEAMQGFHAGFRKSGIGGADGKHGLEEYLATHVVYLQYNTNKQ

SEQ ID NO: 24116 - protein, 125 aa, Azoarcus sp. BH72
MAISKDDILEAVGSMTVMELNDLVKAFEEKFGVSAAALAVAAPGAGGAAAPAAEEKTEFDVILTAAGEKKVEVIKVVRAATGLGLKEAKDVVDGAPKAVKEGIAKADAEALKKQLEDAGAKVEIK

SEQ ID NO: 24117 - protein, 517 aa, Triticum aestivum
  misc_feature (169)..(169): Xaa can be any naturally occurring amino acid
  misc_feature (189)..(189): Xaa can be any naturally occurring amino acid
  misc_feature (232)..(232): Xaa can be any naturally occurring amino acid
MVSDASKKKAAQKKAAAAAKRGAKVPASSSASSSASANKTGAKAAADALAAVQLSDRTCTAVLTSHPLSRDIHIESLTLTFHGHDLLVDTELELNYGRRYGLLGLNGCGKSCLLKAIGCRELPIPDHMDIYHLSHEIEASDMSALGAVISCDEERVKLEKEAEVLAAQXLEACVWLEETLKKFDRTLVXDFLNGVCTNIIHMQNRKLKLYTGNFDQYVQTRSELEENQMKQXRWEQDQIASMKEYIARFGHGSAKLARQAQSKEKTLAKMERGGLTEKVARDRILTFRFANVGKLPPPVLQFVEVTFGYTPDNLIYKKLDFGVDLDSRVALVGPNGAGKSTLLKLMTGELVPLDGMVRRHNHLRIAQFHQHLAEKLDLDLSALQYMLNEYPGNEEERMRAAIGRFGLSGKAQVMPMRNLSDGQRSRVIFAWLAWREPQMLLLDEPTNHLDIETIDSLAEALNEWDGGLVLVSHDFRLINQVAQEIWVCEKQAVTRWEGDIMEFKEHLKSKSGGMSDD

SEQ ID NO: 24118 - protein, 877 aa, Phaeosphaeria nodorum
MSAAIDNEDLEELSISMPHPRRGGPSTTKAVDFTTPPVAPPTVMQASKSRDSKASQRLGQYTIVKTLGEGSFGKVKLATHQVSGQKVALKIINRKRLVTRDMAGRIEREIQYLQLLRHPHIIKLYTVITTPTEIIMVLEYAGGELFDYIVNNGRLQEDKARKFFQQIVCAVEYCHRHKIVHRDLKPENLLLDDQYNVKIADFGLSNIMTDGNFLKTSCGSPNYAAPEVISGKLYAGPEVDVWSCGVILYVLLVGRLPFDDEYIPTLFKKIAAGNYSIPSYLSPGAVSLIKKMLMVNPVHRITIGEIRMDPWFTKDIAPYLEPPVQEFFDSGVDPHKAIDPTAIAPAIPAPVVQKLHDTVVTKLGKTMGYAEHDVQEALARDEPSAIKDAYLIVRENQMMKVNPLMTQESQLAPFLAQSPPTHHESYLGSSIPQILNSSSPPKGIPSQAQDQHERARHGSNASSQLASVRSPVSTVAILPSSLTEYHKAYMKGHPRPPFKPEHDGLPPTPDQTEEQRQISARRLKPNFRALPDTTRNRPEPMTSLPAKKPRPTKWQFGIRSRNQPAEAMLAIFKALKAMGADWEVPKIRKAGGKGGSRSPTGSHASQERSRSRSRSRSRSPGSSVSSHDSGDEKKTGSDSPTHEPLTVRNADSGEQRGRQRKHYNHTNDWGYHIPEDPWVINARFRKDGMFPPGVAHPSSTHSSRVDLANDPSGLRRRSSTNTSTTSLSHHIDSMTITDRPNSISGEDHPEADEAVYIYVSIQLYSIDREFFVVDFKCAGYERLVSNLVREVKAASSSSPQHQHEDGWDDEAGVWRRLDEGEPLPDDLAKELRDGGKGVLRERTEEVGAGRKEGEKVVTSPFPFLDVASTLILQLSGE

SEQ ID NO: 24119 - protein, 421 aa, Ehrlichia ruminantium str. Gardel
MLPNITQLSNSFTIITDTMPYVESVSINIWVNVGSRHENTNIAGISHFLEHMAFKGTKTRTALDIAQIFDNIGGNFNAHTDREHTVYHVKILKRDIKIAIEVLADIILNSQFPQEEIDREKGVVLQEIYQTNDSPTSIIFDKYIEAAYPNQVFGKSILGTPESVSNLSKENLHTYMQEHYHAGNMLLSVAGNITHNEVIDLATQYFSQIKKSTPQETNKSVYISGEYREERDLEQVHIVIGFPSSSYKDDQFYVIQILDSILGNGMSSRLFQKIREQLGLVYSISSFNSSYSDNGIFSIYTATDKNNLPQLLDAIAAEVQSIYINLEENEVIRAKDKLTSEILMSRESTTARAESLGYYYSHYNRYITKEELLKKISEITMEDILNCISRLLRSNNKITLAAIGQIETLPSYKDICQMFHI

SEQ ID NO: 24120 - protein, 536 aa, Listeria innocua Clip11262
MTIVAMNDVVKSFTGDIILEKVSLQLEEGERVGLIGRNGEGKSTILKILKGTEGVDSGIVTSKKGAKIGLLEQLSTVDPNIIVEQYLRTSFGELEDLEKELRALEEEMATNSSEKLMNRYGDKMALFGELGGYEMDANLSKVVNGLGIGALLPQKWGDLSGGEKTKAALAHLLLQKTDLLLLDEPTNHLDLMAVEWLTTFLQHYAGTVLVVSHDRYFLDEVVQKMVELENRELIVYHTNFSGYLKEREERLLREFQDYKDQQKKIKKMQQAIKRLRQWAMQANPPNDAMFRRAKNMERALERMEKVKRPVLTQKQMQLQFDEASRSGQDVVVMENLNKSFGEKEIVQGVSLQIRQGERVAIIGENGAGKSTLLKIIEGKVEPDNGMVKVGASVKIASLSQQMEELNEEMTVLEAFRDKVAVTEGEARQMLAGFMFYGEMVFRKVANISGGERMRLRLAQFINMPVNTLILDEPTNHLDIASREVLEEAIRTFTGTIITVSHDRYFIDQLCSKVIWLENKQLTVYEGHYSYAISKRG

SEQ ID NO: 24121 - protein, 303 aa, Aspergillus oryzae
MDQTMNSTLLSAPPETYWGQFEEISKYNTHLNVLERLWTAWYAWMQNDVLATGIMSFVMHEIVYFGRSLPWIFIDSLGLLKGYKIQSNKIPSLREQWDCAKFVLLSHFTVELPQIWLFHPMAQFFGLSTSVPFPTFWTMAYQIAIFFVLEDTWHYFSHRALHWGPLYKAIHKIHHQYSAPFGMAAEYASPIEVMILGFGTVGCPILWCAVTGDLHIFTMYVWIVLRLFQAIDAHSGYEFPWSLHHFLPFWAGADHHDLHHEKFVGNYSSSFRWWDYLLDTEYSPEAIKRRRENKAGGDARKDQ

SEQ ID NO: 24122 - protein, 1145 aa, Cymodocea nodosa
MAAVEHGPLSYRMFLEEVNGTVTGEVKSESSPQDGIIFVGVSLVLGIASRHVLRGTRVPYTVALLLLGVGLGALEYGTSHGLGKLGSGIRIWANINPDLLLGVFLPALLFESSFAMEVHQIKRCIVQMILLAGPGVLTSTFCLGSLLKLTFPYNWDWKTSLLLGGLLSATDPVAVVALLKDLGASKKLSTIIEGESLMNDGTAIVVYQLFYRMVLGEKFGVGSIIKFLSEVPLGAVAVGLAFGIVSVLWLGFIFNDTIIEITITLAVSYIAFYTSQEAIELSGVLTVMTVGMFYAAAARTAFKGESQESLHHFWEMVAYIANTLIFILSGVVIGESVMRNESNFESDGATWGYLILLYAYVQLSRVAVVAILFPLLRYFGYGLEFKEALILIWAGLRGAVALSLSLSVKRASDSLDSPSLKQEVGTLFVFFTGGIVFLTLIINGSTTQFLLHFLAMDKLSAAKIRILNYTKYEMLNKAIEAFEDLGEDEELGPADWPTVKKYITCLNDLEGEKEHPHTITESENHLHHINLSDTRVRLLNGVQAAYWEMLDEGRITQTTGILLMQSVDEAMDTVSHEPLCDWKALKSYVHFPKYYKFLQMSRIPQRLVTYFTVERLESACYISAAFLRAHRTARRQLHEFIGESEIAAAVINESNAEGEDARNFLEDVRISFPQVLRAVKTKQVTYSVLKHLSEYVQTLEKVGLLEEKEMLHLDDAVQTDLKKLLRNPPLVKMPKVRELLDTHPLLGVLPKQVRVPLENSTKETMKIKGTTLYKEGSKPNGIWLISNGVVKWASKTLSNRQSLHPTFLHGSTLGLYEVLVGKPFICDMITDSLVHCFFIEAEKIVPLLRSDPDIEEFLWQESSIVIAKLLLPPVFEKLSLQEVRGLIAERSRMNIYISGEFIEIPHNSVCILLEGFLKTQDAHKSLIASPAVLLPSNVELSFLSLESSGIAAASFCHRGNSYMAEARARVILFEIGATEPPSPLQRRQSSWMSHSIEPQKLQEHGGLMSWPENLQRARSHQILKDSDHHANNMSTRAMELNIFGSMVEGTHKHHAGVPKTSLDFSKSYHRIPSETSPLPLVSTRSEGESLGKRLGQREKPKLLPPPPKPVTGASESKPAEDNSSDESGAEEEIIVRIDSPSHIDI

SEQ ID NO: 24123 - protein, 424 aa, Candida glabrata CBS 138
MFSEPVKRIYDSQGAYYFQSSEAIRRLEGAIVKYTDLVESRDVADLELSGVVGGVVKVLDRLDQLVSETPPIPGPRRYGNMACRDWHEKIEREIPGLLEDLISSHFPSELQCVVELRYYLANSFGSATRLDFGTGHELSFLATVAALDMLGASFDGDQVLYIFDRYYSLVHRLILSYTLEPAGSHGVWGLDDHFHLAYILGSSQWCNRKKLAMEPNDLSDPVLVEQYSRTNIFCKTLNFVFTVKSGAFREHSPMLFDISRSVRTWAKVRKGLWKMYKDEVLNKFPVIQHFWFGTGFYPWVDYKNGKPLPNYENSPDIDETNDLKTQAQANMDGTRVVESRFLSPGNETFVRRPQLPQDSGVGTMRSSTPESRLMNVTTRSTRSTAGPGQGRMGPPTSMGIVQTRMPSSTTSQAHASRLMNTPRQ

SEQ ID NO: 24124 - protein, 164 aa, Xanthomonas campestris pv. campestris str. ATCC 33913
MSLIATFDTSRGPIVVELYPEKAPLTVANFVNLARRGFYNGLSFHRVIADFMIQGGCPEGSGRGGPGYRFEDEANNGVGHERGVLSMANAGPNTNGSQFFITHTATPWLDGKHTVFGKVTQGLDVVDSVAQGDTINTLTIEGDTDAVLAAKADRVAEWNKILAA

SEQ ID NO: 24125 - protein, 550 aa, Vibrio fischeri ES114
MLKNINPTETQAWADLTAHFETAQDFNLSDLFAADAQRFDKFSATFGQDILVDFSKNLITEETMKKLFALAEQTELSSAITAMFSGEKINKTEGRSVLHTALRNRSNTPVMVDGEDVMPAVNAVLEKMKGFTERLISGEWKGYTGKEITDIVNIGIGGSDLGPYMVSEALAPYKTRLNMHFVSNVDGTHIVETLKPLNPETTLFLIASKTFTTQETMTNAHSARDWFLAEAGDQAHVAKHFAALSTNAQSVSEFGIDTDNMFEFWDWVGGRYSLWSAIGLSIALAVGFDNFIELLEGAHEVDKHFAETDLENNVPVILALIGLWYNNFHGAESESILPYDQYLHRFAAYFQQGNMESNGKCVDRNGNPVDYQTGPIIWGEPGTNGQHAFYQLIHQGTKLIPCDFIAPAISHNQVGDHHQKLMSNFFAQTEALAFGKTEETVKAEFAAAGKTEAEVAELVPFKVFEGNRPTNSILVKQVTPKTLGNLIAMYEHKIFVQGVIWNIFSFDQWGVELGKQLANQILPELADDKAVTSHDSSTNGLINAFKAFQA

SEQ ID NO: 24126 - protein, 279 aa, Streptococcus ratti
MQNTLLLQPTLGIGTWFLGENPDSEKEELAALQYALDKGVTIIDTAEMYGHGLAERLVGKAIKPFEREKLYLISKVLPTNANKKRMETSLDTSLKALQTDYLDLYLYHWRGSTPLAETVAELEKLKAKGKIRSWGVSNFDLEDMQELLALPDGKNCQANEVLYHLGSRGIEYCLKPFQDQHSIPTIAYCPLAQAGTLQRKLLDNKELAELADELNINIYQLLLVFTLAQPNMISIPRTGQLKHMKELVACRDIHLSPNQLERLNQLFPAPKHRVSLDIE

SEQ ID NO: 24127 - protein, 105 aa, Alicyclobacillus acidocaldarius subsp. acidocaldarius
ATMTLTDANFQQAIQGDKPVLVDFWAAWCGPCRMMAPVLEEFAEAHADKVTVAKLNVDENPETTSQFGIMSIPTLILFKGGRPVKQLIGYQPKEQLEAQLADVLQ

SEQ ID NO: 24128 - protein, 328 aa, Vibrio fischeri ES114
MSSYPLQRFSVAPMLDWTDRHCRYFHRQLSEHALLYTEMVTTGAIIHGKGDFLAYNEEEHPVALQLGGSNVKDLVHCAKLAAERGYDEVNLNVGCPSDRVQNGRFGACLMAEPDLVAECVAEMKAVVDIPVTVKTRIGIDDQDSYEFLTKFVSTVHEKGGCDQFTIHARKAWLSGLSPKENREIPPLDYPRAYQIKKDFPQLIIAVNGGIKTLSEAKEHLEHLDGVMIGREAYQSPYLLAEVDQQLFGSDKPIKKRREIVESMYPYIERQLENGAYLGHITRHMLGLFQSMPGARQWRRYISENAHKPGAGIEVVKTALAKIPSELDV

SEQ ID NO: 24129 - protein, 244 aa, Mycoplasma genitalium G37
MRTRYLIGNWKTNKNLKDAVSFVEQFQQNKLNYNAKIGIAPVYVHLTEIKKIISDSLLLFAQDANFIESGSYTGTVSFTQLQDIGVNNSIIGHSERRKYYNETSAVINQKLFACLKASMQVVLCIGEALGQEISFLKTDLTNCLDTIDKSLIKNLVIAYEPLWAIGTGKTATPEVANQTIKTIREYINDLYDENVANNISILYGGSVDHNNIQKLAIMEQIDGFLVGKASLEIKNFLEMARVYA

SEQ ID NO: 24130 - protein, 248 aa, Triticum aestivum
MSSSSSSKLFHSACKAARSFLASSPASASAPRAASSVLADGRNAALATLANLGRNSTLPAAYAHHTNAAASSHGYAWIAAIPAAVYMLQDQEVHAAEMERTFIAIKPDGVQRGLISEIVSRFERKGYKLVAIKLVVPSKQFAEKHYHDLKERPFFSGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 24131 - protein, 462 aa, Exiguobacterium sibiricum 255-15
MSLLRKKDVSVMMDQKSHSKLARHLSGFDLVLLGIGAIIGTGIFVLTGTGALYAGPALPVAFIISAIVCALAALCYAEFSSMIPVSGSVYTYTYATIGELVAWIIGWCLILEYGLASSAVATGWSGYFQSLLSGFGISLPTALTAAPGAVPGSETFFNLPAFLILMVITLLLSMGIKETKRVNNIMVLVKVAVVVLFIVVGIWYVEPGNYTPFAPFGISGVLQASAIAFFAYLGFDAVTSAAEEVKDPGRNLPIGILGSLAIVTVLYVVVSAIMVGIVPFKQFEGVDSPVSLALKVAGQDWVAGFVDLGAIVGMTTVILVMTFGLVRLLFAMSRDGLLPKIFSDVNEKSHTPVKATWILGTTAGLIAGFVPLGTLAELINIGTLAAFALISIAVVILRKTRPDLKRAFKVPWVPFLPILSVLACIMLMLNLQTFTWIAFFIWTAIGLLVYFGYGRSRSKLQQ

SEQ ID NO: 24132 - protein, 576 aa, Vibrio fischeri ES114
MSELIDVKTILSGTELGPLADNERLKRESKYLRGTIVEDLQDRITGGFTKDNFQLIRFHGMYQQDDRDIRAERAKQKLEPLHNVMLRARMPGGIITPKQWLAIDKFAEEHTSYGSLRLTTRQTFQFHGVLKPNIKLMHQTLNSIGIDSIATAGDVNRNVLCTTNPVESELHQEAYEWAKKISEHLLPKTRAYAEIWLDGEKLETTDEEPILGSNYLPRKFKTTVVIPPQNDVDVHANDLNFIAIADNGKLVGFNVLVGGGLAMTHGDTATYPRKADDFGFVPLDKTLDVAAAVVTTQRDWGNRSNRKNAKTKYTLDRVGSDVFKGEVEKRAGVQFEKSRPYELTERGDRIGWVEGIDGKHHLALFIENGRLLDYPGKPLKTGVAEIAKVHQGDFRMTANQNLIVAGVPSEQKDHIEQIARAHGLIDDTHSEQRKNSMACVAFPTCPLAMAEAERFLPEFVTEIEGVLKKHNLPEEDNIIFRVTGCPNGCGRAMLAEIGLVGKAPGRYNFHLGGNRSGTRVPKMYKENITDRQILTEIDQLVGRWATERNENEGFGDFTIRAGIVDEVKVSKRDFHA

SEQ ID NO: 24133 - protein, 526 aa, Vitis vinifera
MGTQVESLWVLALAAKCRAFSSETVLVFGFALCLVWFAVVLSHWAYPGGQAWGRYWSKRGSKAEAIIPGPRGLPVVGSMSLMVNLAHHNLAAAAERLGAMRLMAFSLGETRAIVTSNPDVAKEILNSSAFADRPVKECAYSLMFNRAIGFAPYGVYWRTLRRIAATHLFSPKQITASETQRSEIAAQMVSLVGSCIGDIRVRDILKRASLHHMMSSVFGSKYRLGSSNSETDELSRLVEEGYDLLGKLNWSDHLPWLAGLDPQKIRFRCSKLVPRVNRFVNRIITEHRAQPGPTTRDFVDVLLSLQQPDKLLDSDIIAVLWEMIFRGTDTVAVLIEWILARMVLHPECQSRVHDELDRVVGKSRPVKESDIPAMVYLAAVVKEVLRLHPPGPLLSWARLSITDTTVDGYHVPAGSTAMVNMWAITRDPRVWSDPLDFTPDRFVTTPADVEFSLFGSDLRLAPFGSGRRTCPGKTLGLTTATFWVASLLHEFEWVPSDPNPVDLSEVLRLSCEMAHPLTVRVRPRRI

SEQ ID NO: 24134 - protein, 451 aa, Pseudomonas aeruginosa UCBPP-PA14
MSFDFDLFVIGAGSGGVRAARFAAGFGARVAVAESRYLGGTCVNVGCVPKKLLVYGAHFSEDFEQARAYGWSAGEAQFDWATLIGNKNREIQRLNGIYRNLLVNSGVTLLEGHARLLDAHSVEVDGQRFSAKHILIATGGWPQVPDIPGKEHAITSNEAFFLERLPRRVLVVGGGYIAVEFASIFNGLGAETTLLYRRDLFLRGFDRSVREHLRDELGKKGLDLQFNSDIARIDKQADGSLAATLKDGRVLEADCVFYATGRRPMLDDLGLENTGVKLTDKGFIAVDEHYQTSEPSILALGDVIGRVQLTPVALAEGMAVARRLFKPEEYRPVDYKLIPTAVFSLPNIGTVGLTEEEALSAGHKVKIFESRFRPMKLTLTDDQEKTLMKLVVDAHDDRVLGCHMVGAEAGEILQGIAVAMKAGATKQAFDETIGIHPTAAEEFVTLRTPTR

SEQ ID NO: 24135 - protein, 467 aa, Escherichia coli
MLLPVVMAGGSGTRLWPLSRTLYPKQFLSLTSRLTMLQETLRRLEGVEHRPALVICNEVHRFIVAEQMRNEHLANSGILLEPKGRNTAPAVALAALKAVSSGEDPILLVLAADHDIQDQERFISSILAAKEFAEEGKLVTFGIVPTKPETGYGYIKTGENLNEYGFKVSAFVEKPELDVAKKYLEDGGYLWNSGIFMFRASVFIDELNKFRPDILKICQQALKSSTQDLDFIRIDNDSFSCCPEESIDYAVMEKTTEAVVVPLNAHWSDVGSWSALWEISSKDKSGNAIRGDVLIHDSSDSYLYSQHRLIGVVGVKDLVVVETKDAILVAHKDKVQKVKNIVEQLKVNNRAEYQQHREIFRPWGSHDSIAEGSRFQVKHVVIHPGHKTAKQIHYHRTEHWIVVSGTAKVHYEDEIFLVSENESTYIPIGVPHFIENPGKIPLEIIEVRSGVYLDEDDVVRILNDDGY

SEQ ID NO: 24136 - protein, 538 aa, Oryza sativa Japonica Group
MADDFLSSQPQPWPPLLQLSAAVLFFLLPLLYLLFLRGSNGEVRGRQGNSASAPSLPGPCRQLPVLGNLLQIGSRPHRYFQAVSRRYGPVVQVQLGGVRTVVVHSPEAAEDVLRTNDVHCCSRPPSPGPRMLSYNYLDVAFAPYSDYWREMRKLFVVELTSVSRVRSFAYARAAEVARLVDTLAASPPGVPVDLSCALYQLLDGIIGTVAFGKGYGAAQWSTERAVFQDVLSELLLVLGSFSFEDFFPSSALARWADALAGVERRRRRIFRQVDGFLDSVIDKHLEPERLSAGVQEDMVDALVKMWREQQDRPSGVLTREHIKAILMNTFAGGIDTTAITAIWIMSEIMRNPRVMQKARAEVRNTVKNKPLVDEEDSQNLKYLEMIIKENFRLHPPGNLLVPRQTMQPCLIGGYNVPSGTRVFINIWAMGRGPMIWDNPEEFYPERFEDRNMDFRGSNFELVPFGSGRRICPGVAMAVTSLELVVANLLYCFDWKLPKGMKEEDIDMEEIGQISFRRKVELFIVPVKHEQYQLMGHIN

SEQ ID NO: 24137 - protein, 461 aa, Escherichia coli
MLLPVVMAGGSGTRLWPLSRTLYPKQFLSLTSRLTMLQETLRRLEGVEHRPALVICNEVHRFIVAEQMRNVNLANSGILLEPVGRNTAPAVALAALKAISSGEDPILLVLAADHEIQDQKRFISSILAAKEFAEEGKLVTFGIVPTKPETGYGYIKTGENLNEYGFKVSAFVEKPELDVAKKYLEDGDYLWNSGIFMFRASVFIDELNKFRPDILKICQQALKSSTQDLDFIRIDNDSFSCCPEESIDYAVMEKTTEAVVVPLNAHWSDVGSWSALWEISRKDKSGNAIRGDVLIHDSSDSYLYSQHRLIGVVGVKDLVVVETKDAILVAHKDKVQQVKNIVEKLKVNNRTEYLQHREIFRPWGSHDSIAEGSRFEVKHVVIHPGHKTAKQIHYHRTEHWIVVSGTAKVHYEDEIFLVSENESTYIPIGVPHFIENPGKIPLEIIEVRSGVYLDEDDVVRI

SEQ ID NO: 24138 - protein, 477 aa, Trichilia emetica
  misc_feature (64)..(64): Xaa can be any naturally occurring amino acid
LEKKKSGHIAQIIGPVLDVPFPPGKMPNIYNALVVKGRDTVGQPINVTCEVQQLLGNNRVRAVXMSATDGLTRGMEVIDTGAPLSVPVGGATLGRIFNVLGEPVDNLGPVDTRTTSPIHKPSPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGEFDGLPEQAFYLVGNIDEVTAKATNLE

SEQ ID NO: 24139 - protein, 479 aa, Escherichia coli
MNNNKIITPIIMAGGSGSRLWPLSRILYPKQFLSLIGSHTMLQTTANRLDGLDCTNPYVICNEQYRFIVAEQLRKIDRLTSKNIILEPVGRNTAPAIALAALLMSKSDKSADDLMLVLAADHVIHDEEKFCNAVRSAIPYAADGKLVTFGIIPDKAETGYGYIHRGQYINQEDSDAFIVSSFVEKPNHETATKYLASGEYYWNSGMFLFSANRYIEELKQFRPDILSACEKAIASANFDLDFVRLDESSFSKCPEESIDYAVMEKTKDAIVIPMDAGWSDVGSWSSLWEINDKDSDGNVIVGDIFSHETKNSFIYAESGIVATVGVENLVVVQTKDAVLVSERNKVQDVKKIVEQIKNSGRSEHYVHREVYRPWGKYDSIDTGERYQVKRITVNPGEGLSLQMHHHRAEHWIIVSGTARVTIGSETKILSENESVYIPLGVIHCLENPGKIPLDLIEVRSGSYLEEDDVIRFQDRYGRS

SEQ ID NO: 24140 - protein, 265 aa, Burkholderia mallei ATCC 23344
MHTFNDKVALITGGGTGIGAAVARKFVEAGGRVVLLGRRREPLDAVAKPLGAAAIAVAGDAADAHDVRRALDDARAAFGRVDVLVANAGGHGVGSALDTDDASWAQSTRVNLDTAFVCARELLPELIERRGSIVILSSLAGHFAGPNVIGYVTTKHALIGLTRSLARDYGRAGVRVNAVCPGWVRTAMADEQMDALRDAHGLATREDAYRLVTRDVPLGRPAQPDEVADTVLYLASPYASMITGTSLLVDGGASAVDLPTIEFAR

SEQ ID NO: 24141 - protein, 489 aa, Pseudomonas aeruginosa UCBPP-PA14
MPDVRVLPCTLALFGALGDLALRKLFPALYQLDRENLLHRDTRVLALARDEGAPAEHLATLEQRLRLAVPAKEWDDAVWQRFRERLDYLSMDFLDPQAYVGLREAVDDELPLVAYFATPASVFGGICENLAAAGLAERTRVVLEKPIGHDLESSREVNEAVARFFPESRIYRIDHYLGKETVQNLIALRFANSLFETQWNQNHISHVEITVAEKVGIEGRWGYFDQAGQLRDMVQNHLLQLLCLIAMDPPSDLSADSIRDEKVKVLRALEPIPAEQLASRVVRGQYTAGFSDGKAVPGYLEEEHANRDSDAETFVALRVDIRNWRWSGVPFYLRTGKRMPQKLSQIVIHFKEPPHYIFAPEQRSLISNRLIIRLQPDEGISLQVMTKDQGLGKGMQLRTGPLQLSFSETYHAARIPDAYERLLLEVTQGNQYLFVRKDEVEFAWKWCDQLIAGWERLSEAPKPYPAGSWGPVASVALVARDGRSWYGDF

SEQ ID NO: 24142 - protein, 501 aa, Burkholderia mallei ATCC 23344
MNLAALSTQHQRQSGFLARRQFGNWIDGRAAEPRSGRYLPVVDPATEMTIAEVAASDARDVDAAVAAARRAFDSGDWPRMRPASREKLLHQLAERLERYADELAALETLETGKLIGVARAIDVLGGAEYVRYMAGWATKLEGSTLDTSIAAPAGAEYFAYTRREAVGVVGAIVPWNFPLAIALWKVATALACGCTVVLKPSEETPLTALRLGELAQEAGLPDGVLNIVTGAGAEAGAALAAHPGIDKITFTGSVGVGRAIGHAAVERMARFTLELGGKSPLIVLDDADPDFAAHGAAQGIFFNQGQVCTAGSRVYVQKRLFERVVAGIAAAAEAMKIGSGFDPNTQIGPLVSKRHFERVLGHVDAAKEEGATLVTGGTRALDGGYFVKPTVFVDAAPAMRIVREEVFGPVVTVTPFDTVDDAVRLANDTDFGLAASVWSQNLSHVHRVVPRLKAGIVWVNTHNMLDPNLPFGGFKQSGYGRELGRAALEQFTELKSVCIAH

SEQ ID NO: 24143 - protein, 150 aa, Allium cepa
MELFQDVVPQTAENFRALCTGEKGMGDRKPLHYKGSSFHRVIPGFMCQGGDFTAGNGTGGESIYGAKFKDENFIKKHTGPGVLSMANAGPGTNGSQFFICTEKTAWLDGKHVVFGQVVEGMDVVRAIEKVGSQSGQTKKPVKIADCGQLS

SEQ ID NO: 24144 - protein, 159 aa, Escherichia coli CFT073
MRIGHGFDVHAFGGEGPIIIGGVRIPYEKGLLAHSDGDVALHALTDALLGAAALGDIGKLFPDTDPAFKGADSRELLREAWRRIQAKGYALGNVDVTIIAQAPKMLPHIPQMRVFIAEDLGCHMDDVNVKATTTEKLGFTGRGEGIACEAVALLIKATK

SEQ ID NO: 24145 - protein, 417 aa, Nymania capensis
  misc_feature (37)..(37): Xaa can be any naturally occurring amino acid
  misc_feature (66)..(66): Xaa can be any naturally occurring amino acid
  misc_feature (352)..(352): Xaa can be any naturally occurring amino acid
  misc_feature (394)..(394): Xaa can be any naturally occurring amino acid
  misc_feature (412)..(412): Xaa can be any naturally occurring amino acid
SALEKKKLGHIVQIIGPVLDVPFPPGKMPNIYNALVXKGRDPVGQPINVTCEVQQLLGNNRVRAVXMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPXVDPLDSTSTMLQPRIVGEEHYETAQRVKQTLQRYKELQDIIXILGLDELSEKNRLTVPKXRKIER

SEQ ID NO: 24146 - protein, 650 aa, Candida glabrata CBS 138
MFARVAASTRAHSRLLAGTVAAGATLAVANHYNNNNKLISNDVSLISPVEKPDVKLPTRDELLDKLSRTNQFDVLIIGGGATGTGCALDAATRGLNVALVEKNDFASGTSSKSTKMAHGGVRYLEKAFWEMSKAQLDLVIEALNERAHLLNTAPHLCKLLPIIIPVYNYWQVPYFYAGCKMYDLFAGSQNLKGSYLMSKNATMEVAPMLDGSNLKAGLVYHDGSFNDTRMNATLAVTAIENSATVLNYMEVKQLVKDKDGKVAGAVVEDRETGKTYSVRAKVVVNATGPYSDRLLQMDANPDGLPDEVVQKTEPIIDGNATVKSIMSQVAVTKPNMVVPSAGVHIILPSFYCPKEMGLLDAKTSDGRVMFFLPWQGKVLAGTTDIPLKQVPENPTATEADIQDILKELQPYIKFPVKREDVLSAWAGIRPLVTDPRKKSKADGSTQGLVRSHFIFTSDHGLVTIAGGKWTTYRAMAEETIDEVVKNGKFDAKPCITRKLKLAGAENWDPNLPALLAQKYHLSQKMSHYLAENYGTRAPLICEMFHEDPENRLPLLLADKEQTPVLGHVDFDSFRYPITIAELKYAIKYEYARTALDFLMRRTRFAFLDAKQALNAVEGTVRLMGDSLGWDEQRRQDEIRYSTEFIKTFGV

SEQ ID NO: 24147 - protein, 164 aa, Yersinia pestis CO92
MRRRILSVLLENESGALSRVVGLFSQRGYNIESLTVAPTDDPTLSRMTIQTVGDAKVLEQIEKQLHKLVDVLRVSELVSGSHVEREIMLVKLQASGYGREEVKRCAEIFRGQIVDVTATLYTVQLAGTSEKLDAFLNAVREVAEIVEVARSGIVGVSRGDKIMR

SEQ ID NO: 24148 - protein, 523 aa, Aspergillus oryzae
MPPKKSTSKASAKPSKSTTNTNKASATKTAAKERPAKASASKSKGGDARTKTTKAARTTAPKRKAEAVEEPIREIKKARVVEPRVTKQKPKVVINHAPTTRLNVYVCGEGSSGELGLGPERNAVDVKRPRLNPYLSADKVGVVQVAVGGMHCVALTHDNKILTWGVNDQGALGRDTTWDGGYKEVEDNKSDADSDSDDDPALNPYESTPTAIPSDTFPESTVFVEVAAGDSSSFALTEDGQVYGWGTFRSNDGILGFDSTHTVQPTPTLIPSLKKIKHLVCGDNHALALDERGAVFSWGSGQQNQLGRRIIERNRLNGLQPREFGLPKNIIHVGSGAFHSFAVHQSGKVYAWGLNSFGETGIQAGAGGDEAAIVHPTIVDSLSGKNISQVCGGAHHSIAVADGEQCLVWGRLDGFQTGLKVDTLPEEAVIKDERGRPRILIEPTPVPGIKASTVAAGSDHSIAIDTDGRPWSWGFSATYQTGQGTSDDIEVATIVENTAVRGKKLNWAGAGGQFSVFTEPVAL

SEQ ID NO: 24149 - protein, 315 aa, Bradyrhizobium sp. ORS278
MGGPEALVYEPVDLAAPGPGEVRIRQHAIGLNFIDVYYRTGLYKAPGLPFVAGNEAAGEVIAVGPGVTHFHPSDRVAYYENLGGYATERNIGWQRLVKLPDHITYEQGAVLMLKGLTVWYLLHKTFKVEPHHRVLIHAAAGGIGLLACQWARALGAHVIGTVGSKAKADLALANGCDHVILYNEEDFVARVKQISRGEGCDVVYDGVGKSTFPGSLSCLKPRGLFVSFGNASGPVPPFSIAELNSHGSLFATRPKLNDYVGKRSELLEGADTLFSAVISGKLHVPINHAYALKDAARAHADLESRATTGASILKP

SEQ ID NO: 24150 - protein, 387 aa, Leifsonia xyli subsp. xyli str. CTCB07
MRGDMSAFEPAVLVLEDGKRYVGRAYGARGRTLGEVVFATGMTGYQETLTDPSYAGQIVLMTAPHIGNTGTNDEDMESRQIWVAGFVVREPSRVVSNFRAQRSLDDDLQAQGVVGISGIDTRAVTRHIRSAGAMRAGVFSGEDFGLSDSEQLDLVLTGSKMAGRNLSAEVSTVEPYTVPAVGERIGSVAVLDLGVKKSTLDNLAGRGLDVHVLPQQVSAQDVLSLNPTALFFSNGPGDPQASDKHVALLQETLRAGLPYFGICFGNQLLGRALGLGTYKLPFGHRGINQPVLDKRTGRVEITAQNHGFAVEAPREGTFASPAGFGQVEVSHISLNDNVVEGLNCLDLPAFSVQYHPEAAAGPNDANYLFDRFLTMIKDRTATQEGSD

SEQ ID NO: 24151 - protein, 238 aa, Solanum lycopersicum
MADPDTTRTVVGIIGNVISFFLFLSPGPTFVQILKAKSVMEFKPDPYIATVLNCAVWVFYGMPFVHPDSLLVITINGFGLAIELLYVSIFFIYSDWSKRQKIIIALVIEAIFMAILIFVTLTFLHGTKDRSMLIGIVAIVFNIIMYTSPLTVMKKVITTKSVKYMPFYLSLANFANGIVWACYALLKFDPYILIPNGLGSLSGLVQLILFAAFYRTTNWDEDEKEVELSTSKSNKSDV

SEQ ID NO: 24152 - protein, 416 aa, Bradyrhizobium japonicum USDA 110
MKAIIVGGGIGGLTTALMLGSRGIACEVFEQADTIRELGVGINTLPHAMRELAGLGLLQKLDDVAIRTDQLYYLNRHGQEVWREARGIDAGHDVPQFSIHRGRLQGVIHRAVEERLGAEAIHTGCRLGAFTQDEGGVTAFFFDRSGAHIHTARGDILIGADGIHSRVRDTLFPNEGPPCWNGLMLWRGARDWPLFLTGKSMIVAGGLNAKVVIYPIAEGSSPASRLTNWAVLVKVGEGNAPPPRKEDWSRPGRREELMPHVARFSVPYIDVKSLISATPEFYEYPTCDRDPLPYWSSGRVTLLGDAAHPMYPVGSNGASQAILDARCLADALVRAEHPRQALVEYEKKRLPMTADIVRSNRRGGPEGVIDAVEQLAPDGFDNVDNVLSYSQREAIVRGYATKAGFAAVPGLAAVRA

SEQ ID NO: 24153 - protein, 225 aa, Brassica napus
  misc_feature (88)..(88): Xaa can be any naturally occurring amino acid
MANTTSLVSDFLSFLNASPTAFHAVDESKRRLRHAGYEQLSERDDWKLEAGKKYFFTRNYSTIVAFAVGKKYEAGNGFHIIGAHTDSXPCLKLKPVSKVTKGGCLEVGVQTYGGGLWYTWFDRDLTVAGRVIVKEDKAGSVSYSHRLVRIEDPIMRIPTLAIHLDRNVNSEGFKPNTQTHLVPILATAIKAELNKVPAEGGEDDGGKKCTEASSKSKHHPLLMEI

SEQ ID NO: 24154 - protein, 398 aa, Bradyrhizobium sp. ORS278
MLTASHPYDALMEITARPRTVFVQGKGSWLWDDGGKRYLDFIQGWAVNTLGHAPPELAKALADQAARLITPSPACFNDTSLQLAKALTERSCFDQVFFANSGAEANEGAIKLARKYGALRKNGAYEIITFEGGFHGRTLATMSASGKKAFEPLFEPKVPGFPKARLNDIASVEALVSDSTVAIMLEPIQGEAGVWPATDKFLQQLQTLTTRHGLLLIVDEIQTGMGRTGKLFGYEHADVLPDIMTLGKGIGGGVPLAALLATSEASCFEHGDQGGTFNGNPLMCAAGLAILDIVAKPEFLKAVTDNGLYLESELQRLSARHGLGQVRGHGLLLALDVVRPIAPSIVAHAFELGLLLNAPRPDTLRFMPALNVTRDEIAAMIEMLDGILTKTGAARCVA

SEQ ID NO: 24155 - protein, 402 aa, Bradyrhizobium sp. BTAi1
MQAMLINLSPTPPDAVMLAARLFAEDPRPHKVNLGIGMYYDEEGRIPQLAAVREADHRLRSRNRPWPYLPAEGLVDLKNKAMPVVFGEDQADDLRRRTAWIQTVGGTGAVRIGAELARAIAPDAMASISDPSWPNHEAIFRAVGARVSSYRYYDVESCNIDVDGMLQDLGRLPRGTVVVLHGCCHNPTGFDPTPAQWNHIAQVLADRGLIPFIDLAYQGFGEGLEADAQSVRIIAQSCNLIFVSVSFSKSFSLYGERVGLLFVVTESEAQAALVGERARAVSRALYSSAPSNGALLIAEVLGDPQLKTTWIDELDAMRRRILLMRAELVDQLAGGNRGANFAPIKAQRGLFSYSGLTRTEIERLRVDHAVHAVADGRICLAALNAGNLPSVAAAIRQVSSRH

SEQ ID NO: 24156 - protein, 366 aa, Listeria innocua Clip11262
MALTAGIVGLPNVGKSTLFNAITKAGAEAANYPFATIDPNVGIVEVPDHRLNKLTELVKPKKTVPTTFEFTDIAGIVKGASKGEGLGNKFLSHIRQVDAICHVTRCFDDENITHVEGRVDPLDDISTINLELILADLETVEKRIGRVEKLSKQKDKDAVAEYNVLVKLREAFENDKPARAIEFNEEEEKIVRNLFLLTRKPVLYVANVSEEDVSSPDDNKYVQQVREFAASENSEVIVVCARAEEEIAELEDEDKLEFLEALGIEESGLDQLIRSAYTLLGLATYFTAGVQEVRAWTFIKGMKAPQCAGIIHTDFERGFIRAEVVAYDALLEYGSEQAAKEAGKVRLEGKEYEMKDGDVVHFRFNV

SEQ ID NO: 24157 - protein, 311 aa, Kluyveromyces lactis NRRL Y-1140
MAKVLFLGPVGTYSHQAALQQFPNEELIPVTSIPACFEKLISDIDMDYGVVPLENSTNGQVVFTYDLFRDFMQADLSPSVEVVGEQYVDIAHCLISPVPLSEEQLRKVDVIYSHPQVWGQVKDYLSDLETKYGKTAKIDCSSTAGAVERCIAEYATDRKITLAIGSRASASLNKATIVEGGINDVNGNTTRFLILKRRDESSEIGSQALPPKGDEMKVNFVTFVINQDDPGSLIDVLNVLREYKLNMCSISSRPFHNQVQSERKWQYCFFIEFYGNYGTDYELLAKRFDENCAKWIHWGKFYRNALYYQIP

SEQ ID NO: 24158 - protein, 413 aa, Synechococcus sp. RS9917
MAHQLAVYLLAFGGLLLVAVLLDDLAARIRVPGILMVLMLGLLIDNKMEVASGTASLLNLSHAEQITQVALVLVLFFGGLTTNWAEVRAVIRPAARLATLGVVLTSVLTAAVLIGFGVLQDDRPVLELLPKALFVGAMVGSTDASAVLALLRPLAGQLPQPLIDLIETESGFNDPMAVVLAGVALALAGGEGVAPADLVIEVIRQFLLGILIGFLGGSLTVQLLGSRTSLNQTTMLPVVSLALLMLLSGGTALMGGSPLLAAYVAGLVLGNGPSLDQAALEEAHASFAKMAELVLFLCMGLVVEPESVVFAAGWGFLLFLVMQLVRLVIVQTLLLRTTFRPPERMFICWAGLRGAVPIALAIDAWASGVSWGREMPPLALAVVLCGLFIQGFALVPLARRMKITVPIAEAQAP

SEQ ID NO: 24159 - protein, 605 aa, Bradyrhizobium sp. ORS278
MAAGASSAIMKIEPLSVDFNDEQKRYLEGLAAGLKVTLAGRGQSAAAVATEPTGPDALHIKAQDKLLAAGRKLADQEKIKRELHPFDAYERLKAQARSNAAPSAADNFRWRYHGLFHVAPAQNSYMCRLRIPNGIMKHWQLSGLADLADRLCGPYSHVTTRANLQLREIPPKHAVMLLEGLSDLGLTARGSGADNIRNVTGTPTAGIDPQELLDTRLYAREWHFHILNDRSLYSLPRKFNVAFDGAGRIAALEDTNDIAFSAVEVKDGFGVAPGVWFRLGLGGITGHKDFAKPTGIIVEPDKATEVADAIVRLFIETGDRTNRLKARLKYVLDSMGHDKFMEAVEARLGRTLARVPDEALKPRPEADRMAHIGVHPQKQSGLNWIGVVLPLGKLTSDQMRALAKIAADLGDGDIRLTVWQNLLLSGVSDDKVSLASAAIAQIGLATTASHIRAGLIACTGNAGCKFAAANTKKHAAEIADWCEGRVGMDTPLNIHLTGCHHSCAQHYISDIGMIAAKVPVGDGDDTVEGYHLFAGGGFGPQADIGREVYRDLKAEDAPGTVEKLLKAYLAHRTSPEETFLSFARRHDGDALRKLAEAQTSSEVSA

SEQ ID NO: 24160 - protein, 321 aa, Idiomarina loihiensis L2TR
MKVFNNVMEMVGNTPMVRVTNMDTGPCELYLKLELQNPGGSIKDRIAVEMVEQAEKQGKLKPGDTIIEATAGNTGLGLALVAASKGYPLKIVMPDKMSQEKVNNLRAMGAEVVQTRSDVQKGHPEYYQDMAARMAEENGYYYVNQFENPANVDAHYKTTGPEIWEQMEGKLDAFVCGVGSGGTLTGVGRYLREQKSDIDLVLADPAGSILEPLVNRNEEVEAGSWLAEGIGEDFIPTICDIKLANTAFAISDKEGMQTARKVLEKEGVMVGSSSGTLIAAALRYCQQQTEPKRVVTLACDTGNRYLSKLFNDDWMREQNLL

SEQ ID NO: 24161 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 24162 - protein, 233 aa, Arabidopsis thaliana
MGEEDTATVDQNSFGGGKDSLLRNRHSSPLPSPTQLSSKVITLPTVLTLGRVAAVPILVATFYVDCWWGRTATTSIFIAAAITDWLDGYIARKMRLGSEFGAFLDPVADKLMVAATLILLCTKPMVAVVLGPVPWLVTVPSIAIIGREITMSAVREWAASQNGKLSEAVAVNSLGKWKTATQMIALTILLASRDSSFERLLPSGIGLLYVSAGLSIWSLVVYMRKIWRVLLKK

SEQ ID NO: 24163 - protein, 764 aa, Vitis vinifera
METQSDGKEDTVVSIKDKRQRLETRIGAQHNTQLDLLASLQTLVPDIVSSLDLSLKVVCSFNGRPFFSTPLAPPSTNPNSKVSVQSTRISSPETARRGGSVEPKPAVSNDVSGDGAEKFTIDESGSPLSVVRSMVAVCLLERVPFTAIDSSAVLRKLENDTSATAAEKAALREMGGESGAILAVEMALRSMAEDNGGVELEEFVMSGKSRVMVLGIDRTRLVKELPESAQYQQQQESSSDGNQNQSLQRGGGGDVNSGGFGMGGPIPRPMPDMWMGPGDAHLSGLPPMFPGAGGPGPMLGPRGGPRVMGSSMMGMPRGMGVPPLHRPPLGPNMGMSGPNATPMKPRTEEDDLKDLEALLNKKSFREMQKSKTGEELLDLIHRPTARETAVAAKFKTKGGSQLKEYCSALTKEDCRRQSGSYIACEKVHFRRIIAPHTDINLGDCSFLDTCRHMKTCKYVHYELDPTPDVPPMIMGAASLAPPKQMKPQRAEYCSEVELGEPQWINCDIRTFRMDILGQFGVIMADPPWDIHMELPYGTMADDEMRSLNVPALQTDGLIFLWVTGRAMELGRECLELWGYKRVEEIIWVKTNQLQRIIRTGRTGHWLNHSKEHCLVGIKGNPEVNRNIDTDVIVAEVRETSRKPDEMYPMLERISPRTRKLELFARMHNTHAGWMSLGNQLNGVRLVDEGLRARFKAAYPEVEVQPTSPPRTSAMELDSNTAQIRSPFPGMESKSTAAQFAEPTAPEAAYPSEEKSITLDVEMMS

SEQ ID NO: 24164 - protein, 336 aa, Brassica napus
AAHEFASKELVSLIKDKYDLIGRLRSIKHYLLLDQGDFLVHFMDIARDELNKKVHEISVEKLQSLLDLALRTTAAAADPRHEDLTCCVDRASLLTTLGMHKDSDSNSIEDPVSITGLETFSLSYKVQWPLSIVISKKALSKYQLIFRSLFHCKHVERQLCGAWQIHQGIRSMNSNGTAIRRSSLLCRSMLKFISSLLHYLTFEVLEPNWHVMHDRLQSTKSVDEVIQHHDFFLDKCLRGCLLLLPDVLKKMEKLKSVCLQYAAATQWLISSSIDINSQSHSQKTMIRDATVTESIFNFEREFNSELQSLGPVLSKGSQAEPYLTHLSQWILGVSKE

SEQ ID NO: 24165 - protein, 388 aa, Pseudomonas syringae pv. phaseolicola 1448A
MNLHEYQGKQLFAEYGLPVSKGYAVDTPEAAAEACDKIGGTEWVVKAQVHAGGRGKAGGVKLVRSKEDAAAFAQQWLGKRLVTYQTDANGQPVTKILVESCTHIAKELYLGAVVDRSSRRIVFMASTEGGVDIEKIAHDTPEKILKATIDPLVGAQPFQGRDLAFQLGLEGKQVTQFAKIFTGLAKLFQDHDLALLEVNPLVIKADGDLHCLDAKINIDANAMYRQPKLKGFHDPSQDDPREAHAAKFELNYVALEGNIGCMVNGAGLAMGTMDIVNLHGGKPANFLDVGGGATKERVTEAFKIILSDTNVAAVLVNIFGGIVRCDMIAEGIIGAVKEVGVKIPVVVRLEGNNAELGAKVLAESGLNIIAATSLTDAAQQVVKAAEGK

SEQ ID NO: 24166 - protein, 585 aa, Bordetella parapertussis 12822
MSRAVSNQRRRFVQGLAGGGVLAGLGLWRQAAWARPGAAQPEVLSGTEFNLEIGRTPANFTGAARMATTVNGSIPAPILRWREGDTVTLRVTNRLDEDTSIHWHGILLPTGMDGVPGLSFPGIRPGETFTYRFQVRQSGTYWYHSHSGFQEQTGLYGAIVIEPRRADPVRAERDHVVLLSDWTDEDPMSVFRKLKVMPDYYNYIQPTVDNLVDDARKQGWASALGERLMWQQMRMNQTDLADVSGATYTYLANGKSPAGNWTGLFKPGERVRLRFINGSAMTYFDVRIPGLKMTVVAADGLPVRPVEVDEFRIAVAETYDVIVEPAEDRAYTIFSQSMDRSGYARATLAPREGMHAEVPALDPVQMLTMMDMGMAHDMPGMDHGAAMDHGAMGGMDHAAMGHGSGEASGGMVEVRHPYPAEHGPANSMLPDIVTTRLDDPGVGLRDNGRKVLTYADLRSMVEPEDNRAPTREIELHLTGNMDRYMWSFNGLKFSQAKPIVLKYGERVRFVLVNDTMMTHPIHLHGLWSDLESPDGNFQVRKHTISLNPAQRISYRVSADARGNWAYHCHLLYHMEAGMFRAVVVE

SEQ ID NO: 24167 - protein, 570 aa, Escherichia coli CFT073
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRMGTRIPRMYKENITEPEILASLDELIGRWAKEREAGEGFGDFTVRAGIIRPVLDPARDLWD

SEQ ID NO: 24168 - protein, 973 aa, Aspergillus oryzae
MATPPLRFNQKRTLEPSEREEPDSRLDESRPESSNRIPPSQSPSTVTQSDKPRKPSVTRRMSSKRTIPHKGQEFSTDDDVQEVEEDIAKQQATNPQNSPRMRPLRKQSSSLRRRINARINPLTRADPADNEDENTVLPASSLEVAGNGTSSQHSEGGSQDSNDNNDEDVSDAESFTLKDRQQAINETHPFGIRLWKPALYKKSRSVEKTAEGDIHSSPGGRVGTMLFLTNLLWTAFFGWWLALAALIGSVACFIFAYSPSAVEYGKVFSGLSWYLIYPFGSFVRLDTDENYAEEDEGEGRSISEYEQWQNGDLEHGRLFFGPRRGRSLVGRRRNSIDSASEQDSLLGRTQRASSHDSPLGHHKRRLFGRGEWTLGRVVFFVFFYFLVGPLMLLVSLLCWLLVFWIPMGRVTIILFDHLRRHPLALSYHSDTSYTRLSPNSSSSILLCTYRAAGLRYWKYTVGGTNIFLINLLGVVLFVIFDYFFLEKTLGVQNSLTHPGLIFTLALVSIIPLAYFIGQAVASISAQSSMGMGAAVNAFFSTVVEVYLYCVALTEGKGQLVEGSIIGSIFAGILFLPGLSMCFGAIKRKTQRFNVKSAGVTSTMLMFAVIAAFGPTLFYQIYGSHELNCRPCFSTIDAGGSDCRRCYFSQVPAVNDSFFRKAVKPYSWFAALFLFLSYIIGLWFTLRTHAALIWATEIEEKKAAAVVQEHGPYEPRHLLQSGPPAAAGANAGPGPKGSTPARHSNRGSTDPVKAVVEELDDIGLENGQTSGGHDAPNWSKARSSIILLGATVFYAIIAEILVNTVDVVLESVDIDEKFLGITLFALVPNTTEFLNAISFAMNGNIALSMEIGSAYALQVCLLQIPALVLFSAIYERLIDPAELLTHTFNLIFPQWDMVSVILCVFLLSYVYGEGKSNYFKGSILVLTYLVVVIGFYLSGYSNMDVMGVDRLDTLALGTSQTFHTLGRSKSGMAY

SEQ ID NO: 24169 - protein, 119 aa, Glycine max
MGEEANCDAVMEAGNGNGKAKENGHATAVLAMPDVKADDAVVAPADPRLQGISDAIRVVPHFPKQGIMFNDITTLLLRPGVFKDAVDMFVERYRGMGIAAVAGIEARGFIFGPAIALAI

SEQ ID NO: 24170 - protein, 284 aa, Triticum aestivum
  misc_feature (269)..(269): Xaa can be any naturally occurring amino acid
DSTVRSGIYQPSAPEIPPEPAAAYLAASVAEPVLAGAPHSIPDSTFAFRRTGDTEVLVMAAANGLVHASAKKPLFTFGVIADVQYADIPDGRSFLGVPRYYRHSISVLQRAVSTWNKQGNIKFSINFGDTIDGFCPKDKSLWAVQKVIDEFEKFDGPTYHMFGNHCLYNLPRSKLVALLKMPTDSDRAYYDFSPCPEYRFVVLDAYDFSALGWPHDHPVTAAALKLLDEKNPNTDKNSPDGLFGVDRRFVKFNGAVGKEQLSWLNDVLXDASDRRQNVILCSHL

SEQ ID NO: 24171 - protein, 220 aa, Leifsonia xyli subsp. xyli str. CTCB07
MAARINPSILAADFVNLERDLGRIASADLVHVDVMDSHFVPNLTFGPQMVGRIQDVSAIPLDVHLMIDDPDRWAPGYAELGAHSVTFHAEAAADPVALARRLRALGARAGIALKPGTAVDGYLDLLPEFDQVLVMTVEPGFGGQSFMLETMPKLRRLRETVEARGLDVWLEVDGGITEETIAVAAEAGADTFVAGSAVFRGEPAERIEALRAAVRWHSTL

SEQ ID NO: 24172 - protein, 453 aa, Persea americana
MDNKGGILMQRFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSQGQSL

SEQ ID NO: 24173 - protein, 478 aa, Xanthomonas campestris pv. campestris str. ATCC 33913
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 24174 - protein, 455 aa, Prochlorococcus marinus subsp. pastoris str. CCMP1986
MYPLVAELSAHDLEVAETLIGVIRFLLIFLAARALAEVLVRLSLPTIVGELLAGVVIGASGFHLLIPPSAHTELNQGLVNVISSLASIPPEVVPDVYFESFPSLQAVATLGLYALLFLTGLESELEELVAVGAQAFTVAMAGVILPFAFGTFGLMFIFQVDLIPAVFAGASMTATSIGITASVFGELGYLKTREGQIVIGAAVLDDILGIVILAVVVALAAGGSLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPASRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPGGDNKISDDVAADPVGLL

SEQ ID NO: 24175 - protein, 306 aa, Corynebacterium diphtheriae NCTC 13129
MTSPKSGNSCAVRTVIVPAAGLGTRFLPATKTVPKELLPVVDTPGIELIAEEAAQLGAMRLAVITAPKKQEVLDHFNRFPELEATLESRGKKDQLAKVVRAAELIQPVSVVQETPLGLGHAVGLAESVLDDDEDVVAVMLPDDLVLPMGVVEKMVEVRRQLGGSVLCAFDVPREDVYNYGVFDIEECDYDGPYQVKSVKGMVEKPAVEDAPSTFVATGRYLLDRAIFDALRRITPGAGGELQLTDAIALLINEGHPVHILVHDGKRHDLGNPGGYIPAVVDFGLSDPTYGPHLKKVLRTILEEHGA

SEQ ID NO: 24176 - protein, 453 aa, Persea americana
MDNKGGILMQRFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDAGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSQGQSL

SEQ ID NO: 24177 - protein, 366 aa, Exiguobacterium sibiricum 255-15
MKKRMLTIVSVVALIAIMIGGYFVFQQQQAKSSGSKELTYAKEETAILAGGCFWCMEPPFEELKGVKSVISGYTGGDVKNPTYNQVSAETTGHREAVLITFDPAVISYKQLLDVYWRQIDPTDPNGQFVDQGESYTTAIFYTNAEQKQIAEQSKKNLAESGIFDKKIVTPLIEAGPFYEAEAYHQDYYLKSEKKYKFYRSASERDEFINQYWNDQPKLDVPKYSKLTDDQIKAKLTDIQYKVTQEDGTEPAFDNPYHDLKADGIYVDLISGEPLFSSNDKYDSKTGWPSFSRPLEKGNIIEKSDFALGMKRMEVRSRHGNAHLGHVFNDGPEPTGLRYCMNSAALRFVPKADLEKEGYGQYASEFK

SEQ ID NO: 24178 - protein, 319 aa, Idiomarina loihiensis L2TR
MPKLSLPCHADVVQAQQRINSYTVKTPVLTNPALNQQLGCELFFKCENLQRTGAFKFRGATNALLKLSPEQRQQGVITVSSGNHGAALAHAGKALGVKVKVGVPINAPAIKRQNIEAGGAETTDIEPGMAAREAIVAKWQKEGKSHFIPPYDHADIIAGQGTATLELLEQTDALDAVITPLGGGGLLSGACLACDGTEIQVFGAEPELANDAFLSLKAGERQPALPAKSLCDGLLTQIGELPFAIIQQRICGILVLKDEDTLSAMKLIWHHLKIIVEPSSAIALAAVIQNKSLFEGKRVGLVLSGGNVAAQPEDIKLRQ

SEQ ID NO: 24179 - protein, 411 aa, Roseovarius nubinhibens ISM
MPVLVMKFGGTSVANLDRIRRAAKRVGVEVAKGYDVIVIVSAMSGKTNELVGWVGETSPLYDAREYDAVVSSGENVTAGLMALTLQEMDVPARSWQGWQVPVKTTSAHSAARIEEIPTDNITAKFGEGMRVAVVAGFQGVSPEGRITTLGRGGSDTTAVAFAAAFDAERCDIYTDVDGVYTTDPRIASKARKLDKIAFEEMLELASLGAKVLQTRSVELAMRYNVKLRVLSSFEEQSDAAGTLVCDEEEIMESNVVSGIAYSRDEAKMTLISVADRPGIAAAIFGPLSEAGVNVDMIIQNIAEEGRTDMTFSCPTDQVKRAEKAMADAKARGDINYHDLVADTDVAKVSAVGIGMRSQSGVAAKMFKTLSDEGVNIKVIATSEIKISVLIDRKYMELAVQALHDAFELDKA

SEQ ID NO: 24180 - protein, 339 aa, Bradyrhizobium sp. ORS278
MLRLDKFKKYSLTFGVTPIEHLPRLTAALGGKVQIYAKRDDCNSGLAMGGNKLRKLEYIVPDAIESNADTLVSIGGVQSNHTRMVAATAAKIGMKCVVVQESWVPHEDAVYDRVGNILMTRLMGADSRIVEDGFDIGIRKSWENAIQSVKDAGGKPYGIPAGASVHKFGGLGYVGFAEEVRAQEAEMGIKFDYIIVCVVTGSTQGGMIVGFAADGRADRVIGIDASGTPEQTRAQVRQIVDNTAELVELGRKVRDDEIVILNDYAYPAYGVPSAETNEAIRLAARTEAMITDPVYEGKSMQGMIDLVKKGYFPEGSKVLYAHLGGAPAINGYSYTYRNG

SEQ ID NO: 24181 - protein, 320 aa, Coprinopsis cinerea okayama7#130
MVQVPKIKLNNGQEIPQVGFGLWKVTENTADVVYNAIKAGYRLFDGAFDYGNEKEAGQGIKRAIDEGIVKREDLTIVSKLWNTFHEKERVEPITRQQLEWWGIDYFDIFYIHFPVALEYVDPKDSYPSGWTNLEGKVVESKASIQETWQAMERLVDLGLAKSIGISNFQGALIIDLLRYARIRPAILQVEIHPYLTQNALLDFAKSQNIAVTAYSSFGPQSFVELDWDKAKDTPPLFEHQVITTIASKHNKTPAQVLLRWATQRGLAVIPKSNSPQRLKENLEHTNFDLTEEEIKQITSLNKDLRFNNPPDYLGTLYIFA

SEQ ID NO: 24182 - protein, 754 aa, Roseovarius nubinhibens ISM
MHGESFTMMDGFITDSRQMLGRLREIMSEETGGQTRLDRITSLISEEMRTEVCSIYLFRDEETLELCATEGLNAEAVHQTRMRLGEGLVGRVARTSKVINTDDAPATRGFRYMPETGEEAYSSFLGVPIQRLGETLGVLVVQSKQARSYSDEEIYAVEVVAMVIAEMAELGAFVGEGAAMSARHQHPVMFRGHVAQEGVARGHVWLHEPRVVVTNPIADDPAAELERLTEAVETLRVGVDRMLSDVRSGDKEQLQVLETYRMFANSKGWMRRMEEDIGRGLSAEAAVEKEQSTARSRMEKATDAYLRDRLHDLDDLSNRLLRILTGQGRETGAEMPPDPILIARNIGPAELLDYGRSLKGIVLEEGAVGSHATIVARALAIPLVIHAERITTEALNGDPVLIDGDQGIVHLRPDDTISAAFVDKMAMQAEAQERYASIRDKPAETLCGARIGLMMNAGLMADLPSLVGSGAEGVGLFRTELQFLIRNHMPKRAELSDLYARVMDAAQGKQVTFRTLDIGSDKVLPYMKATDEPNPALGWRAIRIGLDRPGVMRMQLQALVRAAAGRPLSVMFPFVAQLEEFAAARAEMDKALERERILGHPLPSDLKVGAMLETPSLAYAPDSFYRDVDFLSIGGNDLKQFFFAADRENELVRRRYDTLNVSFLTFLENIVKRCEKTGTPLSFCGEDAGRPVEAACLAAIGLRSLSMRPASIGPVKSILRRIDLTELHALIHEAAERGDQSVRPAAMDYLRGKL

SEQ ID NO: 24183 - protein, 298 aa, Brevundimonas sp. SD212
MAIVGLRPQPVSDPEPQSPENLRGLVQDRLAETAPSSDGLLALAAREALLGPGKRVRPVVAMLAAAHVGGRAEDALDFGCAVEMAHAASLVLDDLPCMDDAALRRGQPTLHRRHGEDAAVLAAVALLNQSTRLILQSRAPSEARLGALDDLTQAIGFDGLAEGQMRDLRDDPVQRDVVALRRINDLKTGALFVAAARGGGRMGGGDADDLARLAAFGEAVGFAFQLCDDLMDACSTSEALGKDVGQDQGVTTFVDLWGEGRVRAGVRQSLARAAEAVGHDSPLTTYVLHLFRQAELGR

SEQ ID NO: 24184 - protein, 458 aa, Pseudomonas aeruginosa UCBPP-PA14
MSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGDPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTGEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNQVEPGAPIEGNSYEQLEPSLPNNLRDALRELDDSEILAKYIDPKYIDIFVACKESELEEFEYSISDLEYNWYLHTV

SEQ ID NO: 24185 - protein, 446 aa, Zea mays
MAAPPATAPATARCLSVAKSCWAAERSSSSFVLSAPATGLRQSGSRVLSIRAKVATGLQRACIADDGAERPWKLSDARLVLEDGSVWTAKSFGASGTQVGEVVFNTSLTGYQEILTDPSYAGQFVLMTNPHIGNTGVNPDDEESNQCFLGGLIIRNLSICTSNWRCKETLEKYLIKRNIMGIYDVDTRAITRRLREDGSLIGVLSTDQSLTDNELLEMAQKWKIVGVDLISGVTCDAPYEWSDKTDSEWEFKRDPSSETFHVVAYDFGIKHNILRRLTSYGCKITVVPANWPASEVLNLKPDGVLFSNGPGDPAAVPYAVKTVQEIIGKVPVFGICMGHQLIGQALGGKTFKMKFGHHGGNHPVCDLRSGRVDISAQNHNYAVDPESLPEGAKVTHVNLNDNSCAGLQYSKMKLMSLQYHPESSPGPHDSDTAFGEFIELMKSNRL

SEQ ID NO: 24186 - protein, 293 aa, Prunus cerasifera
PAIPKEYIRPKEELVNIGDIFEQEKSNDGPQVPTIDLKEIDSENEKVRERCREELKKVAVDWGVMHLVNHGISDELMDRVRKAGKAFFDLPIEQKEKYANDQASGKIQGYGSKLANNASGQLEWEDYFFHLVYPEDKRDLSIWPQTPADYIEATAEYAKELRALATKVLRVLSLGLGLEEGRLEKEVGGLEELLLQMKINYYPVCPQPELALGVEAHTDVSALTFILHNMVPGLQLFYEGKWVTAKCVPNSIVMHIGDTIEILSNGKYKSILHRGMVNKEKVRISWAVFCEPP

SEQ ID NO: 24187 - protein, 498 aa, Arabis hirsuta
MRINPTTSDPEVSIREKKNLGRIAQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVDNLGPVDTRTTSPIHKSAPAFIELDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFKLILSGEFDSLPEQAFYLVGNIDEATAKATNLEMESKLKK

SEQ ID NO: 24188 - protein, 456 aa, Pseudomonas aeruginosa UCBPP-PA14
MSNPPPTAERTQLRKSLKLWQIVMIGLAYLTPMTVFDTFGIVSGISQGHVPTAYLLALAGVLFTAISYGKLVRQFPTAGSAYTYAQRAINPHVGFMVGWSSLLDYLFLPMINALLAKIYLTALFPEVAPWVWVVMFVLIMTLINIKSVNLVANFNTVFVLVQLAIIVVFIGLVIHGLNNGEGTATVLSTQPFFSEHAHLSAMVAGATILCFSFLGFDAVTTLSEETRDAAKVIPRAIFLTALYGGVIFITVSYFLQSYFPTNVRFKEPDAALPEIALYVGGKLFQSIFLCATFINTLASGLASQASVSRLLYVMGRDNVLPERIFGFVHPKWRTPSINVLIVGMVALSAISFDLVTATALINFGALVAFTFVNLSVIVHFYVRGGRNRSLKEHFHYLVLPLLGAAIVAVLWLNLESTSLVMGLIWAGLGFGYLFYLTRSFSRPPPRFQESELSPTQ

SEQ ID NO: 24189 - protein, 399 aa, Bacillus cereus ATCC 10987
MRSEVTVKIKPKFIKEIKSGYPLILKDAIQNLNDVQEEGTIIKVVDEKNHFVGKGYYGKQNKGYGWILTRKESEQINQSFFESKIKSALHKRKQFYKSSDTTAFRVLNGEGDGLGGLIIDYYDGYYVVSWYSEGIYTFRDEIIAALQKVANFKGIYEKKRFDTKGKYIEGDDFVAGERGEFPLIVKENGVNFAVYLNDGAMVGVFLDQRNVRKQIRDKYAKGRTVLNMFSYTGAFSVFAALGGASKTTSVDLANRSLSKTIEQFSVNEVDYEAQDIIVEDVFLYFKYAAKKKMKFDMVVLDPPSFARSKKYTFSAAKDYKNLLKEAIAITENNGIIVASTNCSAFDMKKFKGFIDTAFKEMNGKYKILEEHSLPEDFRTIDQFKEGDYLKVVFIEKIKG

SEQ ID NO: 24190 - protein, 268 aa, Populus trichocarpa x Populus deltoides
MGYAQLVIGPAGSGKSTYCSSLYRHCETTGRSIQIVNLDPAAEQFDYPVAMDIRELICLDDVMEELGLGPNGALMYCMEELEDNLDDWLTDELDNYMDDDYLVFDCPGQIELFSHVPVLRNFVEHLKSKNFNVCVVYLLDSQFITDVTKFISGCMASLSAMVQLELPHVNILSKMDLVTNKRDIGKYLNPQGQVLLSELNQRMAPQFFKLNKALIDLVDQYSMVSFVPLDLRKESSIQYILSQIDNCIQYGEDADVKVKDFDPEDIDD

SEQ ID NO: 24191 - protein, 402 aa, Arabidopsis thaliana
MTMMSDLSQDLLEEILSRVPRTSLGAVRSTCKRWNTLFKDRILCKAEETRDQFRFIMKKYKLCSMRFDLNGTLNEDGGTEFVDPSIKELGHFFNQVKISKVFQCDGLLLCVTKEDNIRLVVWNPYLGQIRWIESGNTNYRLFDRYAIGYDNNRKHKILRFLEYYNFNMKHRFLEYEIYDFSSNSWRVLDIAPRWEIESYQRGASLKGNTYFIAKEKIEYEEDGEFPEPADNLLCFDFTTESFGQFLPLPFQHYLYDVGALSSLGDEKLAALFQCGDTDLSEVEIWVTTLTETNTVSWNPFLKVDMEPHYGRSFMFDYYGGSFFIDEEKKLAVVFQFDESGMTRYEDATYIIGENGYVKKVRLGEAPANQGGYCFPSVCFSSYVPSLVQINQIVGFKKEREEE

SEQ ID NO: 24192 - protein, 409 aa, Triticum aestivum
  misc_feature (200)..(200): Xaa can be any naturally occurring amino acid
  misc_feature (227)..(227): Xaa can be any naturally occurring amino acid
MASPSVFAGIAQGPEDPILGVTVAYNKDPSPVKVNLGVGAYRTEEGKPMVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATCGLDFQGLLEDLSSAPSGAIVLLHACAHNPTGVDPTLEQXWEQIRQLMRSKALLPFFDSAYQGICKXGALDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 24193 - protein, 281 aa, Glycine max
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLAMPVEVVQFCWKYNLDRLQELFKEEGVEAKLRLEESGKPYVTDNSNYIVDLYFKTPIRDALAAGAEISALEGVVEHGLFLNMATSVIIAGKSGVEVKAK

SEQ ID NO: 24194 - protein, 522 aa, Burkholderia xenovorans LB400
MAVAPHSLASQSALGVLREGGNAVEAMIAAAATIAVVYPHMNSIGGDGFWLISRPGHAPLGIEACGAAAQRASIDAYRARGYEAIPSRGPLAANTVAGTVSGWEFARRFSSDALGGRMPVSRLLEDAIHYAKHGIPVTRSQSACIAAKRGELEHVPGFAETFMPGDRMPQTGERFVNARLAATLQRLAEAGFDDFYRGDLARSIASDLAGLETLLTLDDLERHHARQRTPLALTHSLGTVYNMPPPTQGLVSLLILGVLDRVLTDDMDPLGPAFVHACVESTKLAFRIRDEHVTDPDHMRIDPQATLEPAALDAMAQRVSMTQAAPWGNGRGPGDTVWMGVIDKDGVAVSFIQSIYHEFGSGIVLRESGINWQNRGCSFTLNPSATNPLMPGRRPFHTLNPALARFADGRTMVYGNMGGDGQPQSQSAVFSRIARFGWNPQAAIDAPRWLLGRTWGQSTDSLKLEARFSAQTIDALRALGHDVEVLAAYDEAMGHAGAIVRHAGGLLEAGYDPRSDGGAAGW

SEQ ID NO: 24195 - protein, 121 aa, Azoarcus sp. BH72
MPINKILVVDDSPTERLALTELLTRHGYQVATAESGEEAITKSKSEKPDLILMDVVMPGMNGYQATRTISRDDATRNIPIIMCTSKGLETDKIWGMRQGAYDYLVKPVEHNELLARIKSIG

SEQ ID NO: 24196 - protein, 286 aa, Escherichia coli CFT073
MRKVTSLSRGKLPFFFFALRKLELTMSIESLNAFSMDFFSLKGKTAIVTGGNSGLGQAFAMALAKAGANVFIPSFVKDNGETKEMIEKQGVEVDFMQVDITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 24197 - protein, 564 aa, Hanseniaspora uvarum
MSEITLGRYVFERIKQVGVNTIFGLPGDFNLSLLDKIYEVEGLRWAASLNELNAAYAADGYSRIKGLGVIITTFGVGELSALNGIAGAYAEHVGVLHIVGVPSLASQAKQLLLHHTLGNGDFDVFHRMSANISETTAMITDLAAAPAEIDRCIRTAYIAQRPVYLGLPANLVDLNVPAKLLETKIDLALKANDAEAENEVVETILALVADAKNPVILSDACASRHNVKAEVKQLIDATQFPAFVTPLGKGSIDEKHPRFGGVYVGTLSSPEVKQSVESADLILSVGALLSDFNTGSFSYSYQTKNIVEFHSDYIKIKNASFPGVQMKFVLEKLIAKVGAKIANYSPVPVPAGLPKNAPVADSTPLAQEWLWNELGEFLEEGDIVVTETGTSAFGINQTRFPTDAYGISQVLWGSIGYSVGAMVGATFAAEELDKAKRVILFVGDGSLQLTVQEIACLIRWGLKPYIFVLNNNGYTIEKLIHGPTAQYNMIQNWKQLRYLTNFGATDYEAIPVKTVGEWKKLTADPAFKKNSTIRLIEVFLPEMDAPSSLVAQANLTAAINAKQD

SEQ ID NO: 24198 - protein, 163 aa, Candida glabrata CBS 138
MSRRRLKKTNLFHKDINSLLYAYGDVAQPLNKTVQCLDELVSSYLVDICAEAAHVANSSSRNKIRLEDFKFVLRKDPIKLARAEELISTNALITEAKKQFNENENQNLKRYKEDEDDDDDEDDDEDDDEDSKPKEAPVTVETQESTVPVKEKKKRTKKAKVKS

SEQ ID NO: 24199 - protein, 114 aa, Lithospermum erythrorhizon
MASRNSIAILLALNLIFFNLVTAQNITTCPVDTLQLGVCANVLGLIDLNLGRVPTQPCCSLLGNLVALEVGACLCTALDLNLLNLIHLTIPISLSLLVNTCNINGTIPSGWSCP

SEQ ID NO: 24200 - protein, 144 aa, Zea mays
MPPSASMPATHTAVYVAAVPLRAPKGPAQLLMSAGYSLGMWDLQHFMVLLRPDPALAQALVFDFQPRDPEDVLAALAVLSRREIPGVVRRRTLRRVPDGRCWLVGHCCDAVGAATRFSERWTTGLVVGEHDCRDYTNGNLSALS

SEQ ID NO: 24201 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIVKIKDNSWFKRGFEAKFTKGETKSKELAPLDTDAAFASSDTGVAARKPELVKPQNLNAFDIISLSAGFDLSGLFEDTNCRKEARFASKQPASAIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSLGQSL

SEQ ID NO: 24202 - protein, 481 aa, Mesorhizobium loti MAFF303099
MALACCGATKRSGAEGRGTMDYDMLVIGSGPSGRRAAVQSAKLGKSVLVVDRGRRLGGVSVHTGTIPSKTLRETVLNLSGWRERGFYGRGYRVKQDISVGDLIERLHKTLDHEVEVLQHQFMRNTVKSARAAVKFLGPNKVSLTSDNGDYSEVGFANALIAVGTRPHRPRDVPFDKTRIFDSDEMLEIDRLPRTLTVIGGGVIGVEYATIFSALDVPVTLVEPRNSILDFVDREIVDDFIHQMRDRGMTIRLGSAVKEIRSKPEAAEVELADGRTIRSEVVLYAAGRTGNVGSLGLDVVGIDADSRGRIKVDPQTFQTNVPNIYAAGDVIGFPSLASTSMEQGRVAACHAFGVTLPPPPETFPYGIYAVPEISTVGQSEEQVRESGAAYEVGVARFRETSRGHIMGVNTGFLKLLFSIETRRLLGAHIVGEGATELIHIGQAVINLGGTVDFFVNNTFNYPTLAEAYKIAGLDAWNRMGRG

SEQ ID NO: 24203 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIVKIKDNSWFKRGFEAKFTKGETKSKELAPLDTDAAFASSDTGVAARKPELVKPQNLNAFDIISLSAGFDLSGLFEDTNCRKEARFASKQPALAIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSLGQSL

SEQ ID NO: 24204 - protein, 80 aa, Prochlorococcus marinus subsp. pastoris str. CCMP1986
MSQEEILQKVCSIVSEQLSVESAEVKSDSNFQNDLGADSLDTVELVMALEEAFDIEIPDEAAEGIATVGDAVKFIEEKKG

SEQ ID NO: 24205 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIVKIKDNSWFKRGFEAKFTKGETKSKELAPLDTDAAFASSDTGVAARKPELVKPQNLNAFDIISLSAGFDLSGLFEDTNCRKEARFASKQPASAIISKLEDIAKRLRLKVKKKDEGILKLKGSKEGRKGVLSIDAEVFVVNPSFHLVEVKKSSGDTLEYQKLWNQDMRPALTDIVWAWQGDQQQQQESLVCSLGQSL

SEQ ID NO: 24206 - protein, 485 aa, Leifsonia xyli subsp. xyli str. CTCB07
MADPKGFLKTTERELPKRRPVPVRLMDWKEVYEAGEPAQLRRQAGRCMDCGIPFCHQGCPLGNLIPEWNDLMWRGEGRQAIERLHATNNFPEFTGRLCPAPCESSCVLGINQPAVTIKQVEVSIIDQAWQHGWVQPHPPERLTGKTVAVVGSGPAGLAAAQQLTRAGHTVAVYERDDRIGGLLRYGIPDFKMEKKHLEARIGQMTAEGTRFRAGVTIGVDIGWDDLRARYDAIVVATGAMVPRDLPIPGRDLAGVHFAMEYLVQQNRAGAGDQVAAQITADSKRVVVLGGGDTGADCIGTAHRQGAASVTTLAIGKQPPSERPGHQPWPLTPALFEVQSAHEEGGQREYLVSTVEFLANEHGEVRAVRVAETEHVDGHRVPKAGTEREIPADLVLLALGFTGPEQDGLSSQLNLPFDERGSLERDGGYQTSEAGVFVAGDAGRGQSLIVWAIAEGRAAAAAVDRYLEGETQLPAPVRPTDRGILV

SEQ ID NO: 24207 - protein, 250 aa, Antirrhinum majus
MVKIAFGSIGDSFSVASIKAYVAEFIATLLFVFAGVGSAIAYNKLTSDAALDPAGLVAVAVAHAFALFVGVSMAANVSGGHLNPAVTLGLAVGGNITILTGLFYWIAQCLGSTVACLLLKFVTNGLSVPTHGVAAGMDAIQGVVMEIIITFALVYTVYATAADPKKGSLGVIAPIAIGFIVGANILAAGPFSGGSMNPARSFGPAVASGDFSQNWIYWAGPLIGGALAGFIYGDVFITAHAPLPTSEDYA

SEQ ID NO: 24208 - protein, 172 aa, Picea sitchensis
MIKNRLVTGSNRMDRYFGSSSLTSSGNMNELWEEDLWPVDTEEADLEVVQDRKDNNCNHGQFVIHSTGFHGSLRMIPRFGDSESDTRLRHHHQSAPVNVPDWSKILGVDHRKEQNPVTVDVGMAGDEEEEERLPPHEYLAREHARCRIGVGLKGRDMSRVRNAVWRQTGFLG

SEQ ID NO: 24209 - protein, 453 aa, Persea americana
MDNKGGILMQRFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLLDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSQGQSL

SEQ ID NO: 24210 - protein, 555 aa, Roseovarius nubinhibens ISM
MKKTLLAALANNISMPDLSIMQDEHLTMGRVRTELLSGLTVALALVPEAVAFAFVAGVHPLVGLYAAFLVGLVTAVIGGRPGMISGATGALAVVMVALVAEHGVEYLFATVVLMGILQVIAGALKWGKFIRLVPHPVMLGFVNGLAIVIFLAQLGQFKEPGSMVNTGHGMSGGTWLAGVEMMTMLGLVALTMAVIWVMPRITRIVPAPLAGIVVVAGLVIGLGLEVPRVGDLASIEGSFPAFHWPFGQGEGLYGTPLAPLNLETLQIILPYAVILAAIGLIESLLTLNLVGEITGRRGGASQECIAQGLANTLTGFFGGMGGCAMIGQSMINVKSGGRTRIAGVAAALFLLIFILFAAPLIEQIPLAALVGVMFMVVIGTFAWNSFKILRKVPMMDAFVIILVTVVTVMEDLAVAVVVGVIVSALAYAWNNAKRIHAVERESVTEKGAKVYEIQGPLFFGSTDGFVELFDYEGDPEVVIVDFDASRVVDQSALQAIETVAGRYEAEGKRIMLRHLSRDCHQLLTRAGHLVVDSDDDPDYALAVDYGVRTGVLGGH

SEQ ID NO: 24211 - protein, 453 aa, Persea americana
MDNKGGILMQRFELGRLLGQGTFAKVYHARNLKSNQSVAIKVIDKEKVLKVGMIDQIKREISTMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDQNPNTRISIAKIKDNSWFKRGFEAKFAKGETKFKELAPLNTDAAFASSDTGVAARKPELVKPQNLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVGSQGQSL

SEQ ID NO: 24212 - protein, 465 aa, Oryza sativa Indica Group
MAVIALKCPDVEVVVVDISAARIDAWNSDALPIYEPGLDDVVRRCRGRNLFFSSDVERHVGEADIVFVSVNTPTKARGLGAGKAADLTYWESAARMIAAVATSDKVVVEKSTVPVKTAEAIEKILDHNGRDGVGFQILSNPEFLAEGTAIRDLLAPDRVLIGGRETAAGRAAVQALKDVYARWVPEERILTTNLWSAELSKLAANAFLAQRISSVNAMSALCEATGADVAEVAYAVGKDSRIGAKFLNASVGFGGSCFQKDILNLLYICECNGLPEVANYWKQVIKINDYQKSRFVNRVVSSMFNTVAGKKIAVLGFAFKKDTGDTRETPAIDVCKGLIGDKAKVSIYDPQVTEDQVQRDLAMSKFDWDHPVHLQPMSPTAIKQVSVAWDAYEAARDAHGVCILTEWDEFRSLDYARIYGGMQKPAFVFDGRNVVDAEKLREIGFIVYSIGKPLDAWLKDMPAVA

SEQ ID NO: 24213 - protein, 425 aa, Vibrio fischeri ES114
MSVYNTLCFLAAAAMLIAFFNSKIGKMQTTIAITAGSMMLSLGIIIAGQNNWFNLREVATETLTDINFEDFLLKGILGFLLFAGGLGIKLQNLKDQKWEITVLALGATLFSTFFIGFILWAICNVIGVNLDLIYCLLFGALISPTDPIAVLAIVKKMNAPQRISTQIEGESLFNDGFGLVIFVTLFTIAFGHETPTVGSVTALFFQEAIGGIAYGFILGLVFHYLISSTNDHSMELLLTIGIPTAGYALAEVLHVSGPLAMVVSGIMIGNWTRFIGFSKESEDHLDHFWELVDEFLNGVLFLLIGMSMLLFQFHQEDWILMAISIPLVLTSRYLSVFISYIGFNRFRTYNPLSVRILTWGGLRGGLALAMALAIPAGIMVIPEKNIDVREIILVMTYSVVVFSILVQGSTITPMIDKAKKLEKEM

SEQ ID NO: 24214 - protein, 511 aa, Idiomarina loihiensis L2TR
MTPTIKPLVLLILDGWGYREDAPDNAIAKANTPVMDRLWEKYPHCLVDGSGGAVGLPDGQMGNSEVGHVNLGAGRIVYQDFTRISKAISDRSFFSNTILCDALKKAKAAKGAVHIMGLLSAGGVHSHEDHLVAMIEMAVEQGAEDVYLHAFLDGRDTPPKSALPSIERFEALFARLGKGRFATLSGRFFAMDRDKRWERIEQSYKAVYHGLSGVTSANATDAVENAYERGETDEFVTPVVIGQPAPIANGDSVFFMNFRADRAREMTQAFVDKDFDGFDRGSRADISEFVMLTQYADTLEAPSAFPPEPLNNVLGEWLAKHDKTQLRISETEKYAHVTFFFSGGREQEFEGEKRVLIPSPKVKTYDLQPEMSSEQLTDELVAAIESQAFDVVICNYPNGDMVGHTGNFDAAVKACEAVDHSVGRVVSALEAVGGECLITADHGNAEQMSDATTGQAHTAHTNELVPFIYVGRPAKARNGRLSDVAPTILHLIGMEQPDEMTGTSLMTLEQD

SEQ ID NO: 24215 - protein, 304 aa, Herminiimonas arsenicoxydans
MAIKHFLQFSDLTLDEFEYVIERTRIIKRKFKNYEPHHPLVDRTLVMVFEKNSTRTRLSFEAGMHQLGGAAIHLATRDSQLGRGEPVEDAAQVMSRMCDIIMIRTFGQDIIERFAANSRVPVINGLTNEHHPCQVLADVFTFIEHRGSIKGKTVAWIGDANNMLYSWLQAAQVFDFHVNVSTPKGYEIDPTLVAADNTHYKLYAAPSDACAGAHLVTTDVWTSMGFEEENAARLKAFDGWIVDAAKMKRAQPDALFMHCLPAHRGEEVAAEVIDGPQSVVWDEAENRLHAQKALLEYLVLGKLS

SEQ ID NO: 24216 - protein, 450 aa, Vibrio fischeri ES114
MNPINVAKFGGTSVANFEAMTKSASVIEQNPNTHLVVISACSGVTNLLVELANGVQDNHRKKAILEGLKTIHFSVLDQLADPLIPEQAILDILDDIEKTAETAASQSNDKLTDHLVSCGELMSTHLFTQLLIERGNPAVRFDIRTVLRTDSRFGKGEPQLNDISRLAQKKLTPLCQQQIVVTQGFIGSDSEGNTTTLGRGGSDYSAALIAESVDACGLEIWTDVPGIYTTDPRIAPKASPIPEISFSEASEMANYGAKILHPSTLLPALRHQIPVFVGSSKEPEKGGTWIKEKVDSTPLFRALTLRCNQTMVTLHSPSMFHAYGFLAEVFKILAKYQISVDLITTSEVSVALTLDQTNTNGKAPELPLEAQQELEELCTVEVEHNLCLIALIGNKMSHSKGSAKQVFGTLEEFNLRMICYGASQHNLCFLLHESESKQAVKILHKELFEQ

SEQ ID NO: 24217 - protein, 333 aa, Idiomarina loihiensis L2TR
MQTPQVTVLGAGSYGTALAICFARKGIPTTLWGRDADKVAVMQTAHENEEYLPACPFPESLKVTADLGEALKDVKNVVVVVPSHSFSSMLKQAKPLLAEHARVAWATKGLEPDSGRLLYEVAEETLGDEHPLAVLSGPTFAIEMAKGLPTAISMSSTDQAFVEELSGLLHCDRSFRVYTNNDFIGVQLGGVVKNVIAIGAGMADGIGFGANARTALITRGLAELTRLGLKLGAKSETFTGMAGLGDLILTCTDNQSRNRRFGMALGQGKGVEEALKSIGQSVEGYRNTREVVALAARNEVEMPICEQIYAVLYEGKEPQQAAIDLLSRERKTE

SEQ ID NO: 24218 - protein, 423 aa, Mannheimia haemolytica
MSNFNTISVVGLGYIGLPTATVFAQHGLNVIGVDVNQHAVDHINQGKIHIVEPDLDVAVHQCVSSGKLKATLTPEPAEAFLIAVPTPFKGQDYEPDLSYIQAACKAIAPVLEKGNLVILESTSPVGATEQMAEWLAEYRPELSFPQQAGEDSDIRIAHCPERVLPGQVMHELIENDRIVGGMTNKCSVQAVNLYKTFVKGDCIVTNARTAEMCKLTENSFRDVNIAFANELSIICDRLDINVWELIALANRHPRVNILQPGCGVGGHCIAVDPWFIVNKTPDLAKIIRTGREVNDHKPEWVISKMNEAVIYALQKTGKSIDQIKIACLGLAFKPDIDDLRESPALKITEKLAEKYPNQVFAVEPNVEELPKKLANKNISLISVDEALEVADVVVVLVDHSEFKLVKPVFLNDICVVDTKGIWR

SEQ ID NO: 24219 - protein, 176 aa, Roseovarius nubinhibens ISM
MKTVKDYIRTIPNFPHEGIMFRDVTTLFGDGAGFSLAVDQMVEAAQGRDIDKVAGLEARGFILGGAIAHRLGCGFVPIRKAGKLPGSKISEAYLLEYGEAVVEIHEDAIEPGERVLLVDDLLATGGTAEAGIRLIERLGGQVVGCSFAVDLPELGGAARLRAMGMDVDMLCAFDGA

SEQ ID NO: 24220 - protein, 370 aa, Vibrio fischeri ES114
MQSFIPPKRTLMGPGPSDISPQVLQALSRPTIGHLDPLFIKMMDEVKELLKYAFQTKNDFTIAVSAPGSAGMETCFVNLVEEGEKVLVCRNGVFGERMRQNVERCGGIPIIIDDKWGEPVSLDKVAQALEENPDISVVAFVHAETSTGVLSDAKAIAQIARQYNCLTIVDAVTSLGGVPLLVDEWQLDAVYSGSQKCLSCTPGLSPVTFSDKAVAKMKSRSSVVQSWFLDQSLVLGYWSGEGKRSYHHTAPVNSLYALHESLLMLKHEGIEQAWQRHADYHQELKQGLEALGIKFIVDEEYRLPQLNAVYIPVGISDTQVREQLLEEYNLEIGAGLGELAGKAWRIGLMGYAAKKENVALCLKALSDVLK

SEQ ID NO: 24221 - protein, 289 aa, Vibrio fischeri ES114
MIKKCLFPAAGYGTRFLPATKSMPKEMMPVVNKPLIEYGVEEAINAGMDGMCIVTGRGKHSLMDHFDKNYELEHQISGTNKEELLEDVRELIDSAHFTYIRQREMKGLGHAILTGRELVGDEPFAVVLADDLCVNEEQGVLAQMVALYKQFRCSIVAVEEVPDNETHKYGVISGEMIKDDLYRVDNMVEKPEPGTAPSNLAIIGRYILTPDIFELIEQTEPGKGGEIQITDALLKQAQSGCVLAYKFKGKRFDCGSVEGYIEATNHCYENIYLKDKKSSELAKKVTGKK

SEQ ID NO: 24222 - protein, 476 aa, Vitis vinifera
MESLCFSTTHFSLLRPTLPNPIRPIKHVLIGSAAKPFIKATISKPAAEISGTSSTTVTSSQTSLHPSPVPPLKRVSSDSLQYQPGCIGAVPDRTIHDGIDGVVGAMEYLTNILSSKVYDVAIESPLQLAPKLSERLGAQIWLKREDLQPVFSFKLRGAYNMMAKIPKEQLERGVICSSAGNHAQGVALAAKRLGCNAVIAMPVTTPEIKWKSVERLGATVVLVGDSYDEAQAYAKQRGEEECRTFIPPFDHPDVIMGQGTIGMEIVRQMQGPLDAIFVPVGGGGLIAGIAAYVKRVSPEVKIIGVEPCDANAMALSLHHDQRVMLDQVGGFADGVAVKVVGEETFRLCRELIDGIVLVSRDAICASIKNMFEEKRSILEPAGALALAGAEAYCKYYGIKGGNIVAITSGANMNFDRLRLVTELADVGRQREAVLATLLPEEPGSFKQFCEMVGHMNITEFKYRYNPHKEKALVLYR

SEQ ID NO: 24223 - protein, 388 aa, Ajellomyces capsulatus
MFSLRTAQPAQSLFRAATNTYSTSLPRSAIAARSFATVQSDIFKPTKYGGKYTVTLIPGDGIGTEVAESVKTIFKADNVPIEWEQVDVSGLDAGNKHSEDLFKESIASLKRNKLGLKGILHTPVERSGHQSFNVALRQELDIYASIVLIKNIPGYKTRHDNVDLCIIRENTEGEYSGLEHQSVSGVVESLKIITRAKSERIAKFAFSFALANNRKKVTCIHKANIMKLADGLFRSTFHKVAESYPTLETNDMIVDNASMQAVARPQQFDVMVMPNLYGGILSNVGAALVGGPGIVPGCNMGRDVAVFEPGCRHVGLDIKGKDQANPTALILSGSMLLRHLGLDEHANRISKAVYDVIGEGVTRTRDMGGQASTHEFTRAVLDKMESAL

SEQ ID NO: 24224 - protein, 414 aa, Glycine max
  misc_feature (175)..(175): Xaa can be any naturally occurring amino acid
  misc_feature (224)..(224): Xaa can be any naturally occurring amino acid
MASPTHFDDDFDFGGGFGGRHSGNKRSSPDYDDEDYDNDPFAPKKAITKAEEASGVTTGMILSLRESLQNCKDTLATCQNELEAAKSEIQSWHSTLKNQPSILAGITPEPKMLINYLQALKSSEESLREQLEKAKKKEAAFIVTFAKREQEIAELKSAVRDLKVQLKPPSMQHGXVLFLCLRHLCLYHLTCLLKVNPAVQLPHQVGCILYSIFVLLVLQMIMPXYPLEYNFQARRLLLDPAVHEEFTRLKNLVEEKDKKVKELQDNIAAVSFTPQSKMGKMLMAKCRTLQEENEEIGNQASEGKMHELGMKLALQKSQNSQLRNQFEGLQKHMEGLTNDVERSNEMVLMLQEKLEEKDRQIQRLKHEIKQKNLEDQRLKHELQQKNLEDQRLKHELQQKNLEDGNDNNAGEAAN

SEQ ID NO: 24225 - protein, 395 aa, Opitutaceae bacterium TAV2
MSSAPAPLSVWAKNISPSPTLAVDAKAKALLAAGEDVCGFAAGEPDFDTPEHIKEACIAALKAGKTKYAPTPGIEPLRQAIADDYAARLGLKVASSQVIVSPGGKFSCYLSILAVCSPGDEVIIPAPYWVSYPEMAKLAGAKPVFVLADDRTGFRLTPAQLEAAITPKSKLLILNSPSNPTGAVYTRAELEAIVAVALKHNLYIMSDEIYEHLLYDGAQHVSPATFSAEAAARTIIVSGFAKTYSMTGWRLGTTVAPAPIAKAVAELQSQTSSNATTFAQYGALAALKEKEKTQASLTQMLAAFDRRRKFLHAELNKIPGVKCLLAQGAFYLFPNISSFGLSSADFCSKLLEQQKVAAVFGSAFGAEGYLRLSYATSDEIIKKGVERLAAFCKTL

SEQ ID NO: 24226 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 24227 - protein, 296 aa, Zea mays
  misc_feature (276)..(276): Xaa can be any naturally occurring amino acid
MAGGTLQDRSEAEDVRVGVDRFPERQPIGTAADDLGRDYSEPPAAPLFEASELSSWSFYRAGIAEFVATFLFLYVTVLTVMGVSKSPSKCGTVGIQGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFAVFLVHLATIPITGTGINPARSLGAAIIYDNPHGWHGHIAIDTLALLDGDXWIFWVGPFAGAALAAGSDSG

SEQ ID NO: 24228 - protein, 460 aa, Aspergillus oryzae
MFKLARSRPIAAAFRAATESSVQSRICQQQRNLSIHEHLSAKLLKSYGVGMPKGEVAYSAEEAEAVAKSLGNDDMVIKAQVLAGGRGKGSFDNGLKGGVRVIYSPTEAKMFAGQMIGHKLITKQTGAAGRLCNAVYICERKFARREFYLAVLMDRQSQSPVIVASSQGGMDIEAVAKETPEAIITTPIDIKVGVTDEIAGKIATELGFSEQCITEAKDTIQKLYKVFMEKDATQIEINPLSETSDHQVMAMDAKLGFDDNADFRQKEVFSWRDTTQEDADEVKAAEHGLNFIKLDGDIGCLGKNGNGLLVSSMLITDLVNGAGLAMATMDIIKLNGGNPANFLDVGGGATPAAIKSAFELITSDPKVSAIFVNIFGGIVRCDAIAQGLINVVNEMGLRTPIVARLQGTNMEQAHKLLNESGLKIFSIEDLQNAAEKSVQFSKVVKMAREIDVGVEFTLGI

SEQ ID NO: 24229 - protein, 885 aa, Aspergillus nidulans FGSC A4
MLSQIVTAAKGILFPEQNSYGNSTTATTEPNETLPATKSKMVTTRRSAAFQAVSPTEDAEMNGSPELSGKRKSDNSTLARSPETQGNKRRKRSSVETTEDMVKETNEDIGQEAAPKKHFRFDSEEPVLPDVAESEVPVDAQQKQLDEEDSSEDEAPETVDNSTQLNKIKLEAKKRDEARKIEEQAKREKRRQLDEARKQQAKASAKRKEVHTSQVMPGAGTPAEDMLSESSATLQGSFTQDTRRSTLPALLPDDILNAVPDVRPPTPPPEFEVFSQKKPTKLRFLEKKEKAPKDVRMGDVAIRVLDSESSRKQPNTALAPKASKASRGAREAWLKQARSTGHVNGMRMVSSGKRSFVRNSGKCDDHNGNLMASATESSPLLPQYHHAASSNTSPRGNRPPRTVTFNPLTTVSTYHDSASADPKFKPLASGNSSLANSRPTGLSALNSKLRRRNSHGAPGSVASSYPASKIGPQRTTKTAQKLKLLPDPITEEELVDEETSPSDVYRQIARIKEPAARSLAAKLGKADRDRLPRVTAYCTANSYRLDGVFKFLKSRSKTRGANPKLFDECVYSRFDYQFEAKQKAGNHSNNVDSENTHTVDRMPRERRFSDSAVEVNEDFGNRREELIDLHDRDSHQQNATEASVLDNAPDIDTTIHAPEVFLFDYGTVVIWGMTPAQESRFLSDISKFATSILSPEDTQVENFNFYYAREYQARIYNDFISLRDPRNYMIKLAISHALAQSVKTSLFEDLVSETISNTAPLPAQIAQTGSVNLSRRQINMQVGELFILRINIHLQGSVLDSPELMWAEPQLEPVYQAVRSYLEMDQRVSLLTERLDVIADLLAVLKDQLTHRHGEYLEWIVIVLIAAEILVAAINIVVDLYAGVE

SEQ ID NO: 24230 - protein, 274 aa, Azoarcus sp. BH72
MKITFLGGGNMAAALIGGLVERGFAAADLCAIDLDGATRERLAARFGVRTADAADDAALACDVLVLAVKPQQMKAALAPIAGRLSAQLVVSIAAGLRVADLGRWLGEAGKPYARIVRCMPNTPALIGAGVTGLYAGAVVDAAGREAAERVLAAVGSTVWVQDEAQIDAVTAVSGSGPAYVFHFIEALEAAGRALGFDEAVARKLALDTTLGAARLAAGSDEAPAVLRERVTSKGGTTAAALASLATAGWHDALGVAVAAAAARGRELGDELGRD

SEQ ID NO: 24231 - protein, 475 aa, Haloferax volcanii
MVVGDIATGTELLVIGAGPGGYVAAIRAAQNGIDTTLVEKDAYGGTCLNYGCIPSKALITGANLAHEAGNAEEMGIHADPVVDMSQLRDWKSGVVDQLTGGVEKLCKANGVNLVEGTARFKDENAVRIAHGGEGQGSETIEFEHCIIATGSRVIQIPGFDFGDEPVWSSRDALEADTVPERLVVVGGGYIGMELSTTFAKLGADVTVVEMLDDILPGYESDVARVVRKRAEELGIDMHLGEGATGWREEDDGIMVTTETEDGEENEYRADKVLVAVGRSPVTDTMDIENAGLEADDRGFLSVDDRRRTDVEHIYAVGDVVEDTPMLAHVASKEGIVAAEHVAGEPVAFDSQAVPAAVFTDPEIGTVGMTEADAEEAGFTPVVGQMPFRASGRALTTNHADGFVRVVADEESGFVLGAQIVGPEASELIAELAFAIEMGATLEDVASTIHTHPTLAEAVMEAAENALGQAIHTLNR

SEQ ID NO: 24232 - protein, 466 aa, Bordetella parapertussis 12822
MSNGTIVQCIGAVVDIQFPRDNMPKIYEALTLVDEGSSFAEKGLTLEVQQQLGDGVVRTIALGSSDGLRRGMQVAGTGAPISVPVGHGTLGRIMDVLGRPIDEAGPIASDEKRAIHQPAPRFDELSPSVELLETGIKVIDLVCPFAKGGKVGLFGGAGVGKTVNMMELINNIAKQHSGLSVFAGVGERTREGNDFYHEMEESNVLDKVAMVFGQMNEPPGNRLRVALTGLTMAEKFRDEGRDILFFVDNIYRYTLAGTEVSALLGRMPSAVGYQPTLAEEMGVLQERITSTKTGSITSIQAVYVPADDLTDPSPATTFQHLDSTVVLSRDIAALGIYPAVDPLDSSSRQLDPQVVGEEHYQVARGVQQTLQRYKELRDIIAILGMDELSPEDKQAVARARKIQRFLSQPFHVAEVFTGSPGKYVSLAETIRGFKMIVDGECDALPEQAFYMVGTIDEAFEKAKKLQ

SEQ ID NO: 24233 - protein, 237 aa, Azoarcus sp. BH72
MTSISANLQAVSERIRDAARAAGRDPAAVRLLAVSKTWPAQSVREAAAAGQRAFGENYVQEALAKLAEVDDPALEWHFIGPLQSNKTRAVAQHFAWVHSIDRLKLAERLSAQRDVHLPPLNVCLQVNVSGEDSKSGVAPDEVLPLARGVAALPRLVLRGLMCIPEPTDDVTLQRRRFATLRGLRDTLAAEGIVLDTLSMGMSHDLEAAVAEGATLVRVGTAIFGARPRSESAAVAGG

SEQ ID NO: 24234 - protein, 378 aa, Candida glabrata CBS 138
MVNDSVEITTICPDVENSQFLLSSSVQDLRKVSQTPLGTVHRSLPRIKILGTGGTIASKGSDSSQTAGYHVDLTIQDMLSAIPDISGICELEYEQLCNVDSKDIDEALLFKIYKGISDSLQSFDGIVITHGTDTLAETAFFIESTIDAGDVPIVLVGSMRPSTSVSADGPMNLYQAICIASDKKSRGRSVLVSLNDQISAGYYITKTNANSLDTFNVRQGYLGNFFNNEIHYYYPPVKPMGCHKFKLKFDDVEEKYTGFNFPKVAILYAHQAFEPELFDLVSDKYDGIVIATMGAGSLPDNVNQKALTLKVPIVYSKRSMDGMIPVANLPKAADGTHNYVIASGYLNPEKSRILLQLCLAGKYSLHEIRHVFAGVYGG

SEQ ID NO: 24235 - protein, 382 aa, Picea sitchensis
MPSSTAGQVIKCKAAVAWGAGEPLKIEEVEVAPPQASEVRIKVHYTALCHTDLYFWEAKGQTPLFPRILGHEAAGIIESVGEGVTDLKVGDTVLPVFTGECGECRHCKSEESNMCDLLRINTDRGVMINDGKSRFSINGKPIYHFLGTSTFSEYTVAHVGCVAKINPEAPLDKVCILSCGVSTGMGATLNVAKPKKGSTVAIFGLGGVGLAAAEGARIAGASRIIGIDLNSDRFEKAKLFGVTEFINPKDHEKPIQEVIAERTDGGVDSSIECTGNVKAMIQAFESCHDGWGVAVLVGVPHSDAVFATSPTHFLSERTLKGTFFGNYKPRSDLPGLVELYLDKKLELEKFITHEVSFANINKAFDYMIKGESLRCVINVIGD

SEQ ID NO: 24236 - protein, 129 aa, Oryza sativa Indica Group
MSGGVQEQFEIKFRLPDGTDIGPKRYPAASTVATLKESIVAQWPKDNIPLEYPEADKEKGPRTVNDLKLINAGKILENNKTLSECKSPICDFSGLTTMHVVVRAPTSDKQSNKIVAKKPKDFRCGCSIM

SEQ ID NO: 24237 - protein, 332 aa, Exiguobacterium sibiricum 255-15
MAVLVVGGAGYIGSHAVYQLVDAGQDVVVIDHLKSGHREAVHPKARFYEGDIRDRAFLDTVFEKETIDQVVHFAAFSLVGESMEHPLAYFDNNVYGTQVLLEAMMAHDVKQIVFSSTAATYGEQEQMPILETATTNPTNAYGETKLMMEKMMRWCETAYGLNYVALRYFNVAGARATGEIGEDHTPETHLVPLVLEVANGQRPVISIYGDDYATEDSTCIRDYIHVEDLIDAHLLALEYLKQGNTSDVFNLGSSRGFSVREIIEAARRVTGHAIPEQVVARRAGDPSTLIAGSDKAKKVLGWTPRRTEIDTIIQDAWRWHEQRPQGYKTPVR

SEQ ID NO: 24238 - protein, 466 aa, Exiguobacterium sibiricum 255-15
MVVGELTQERDLVILGGGPAGYTAAIRASQLGRTVTLIEQAQIGGLCLNKGCIPSKVVAHAAEVKLQTKHMTALGFSFHPTHDFSQLVEYRERTIRQLRTGVEALCQANAIEVVHGTASFLADDRIGVELGHQFDTYRFNDVVIATGSHSIKQDAPSVLNAEQLYQLTELPERLVIIGQDYIAIEAAMSFQALGTSVTLIADAFDFDPSLDKELRRLFKKQKIQLVTGTVTAIEAQEDVTVTVVKQGQETTWSAPFLFHSLPRVPHTLELGLERIGVTLAEDGTIPVDPFGQTNRPHIYAIGDVTPGPAIATRAIHEAKRTAEHLSGQSADTTVPYYPTIIRSLPPIVSIGLTEQTATDAGHSFRTAQFALNANGATTIEGGSGFIKVISDATTSLILGIHMIGEGAIELAGVFAQTLELHAKEEDVRFPVMPHPSRNEAFTEAIEALLGQAIHLPPRQQDVLAKS

SEQ ID NO: 24239 - protein, 404 aa, Exiguobacterium sibiricum 255-15
MIEVKLHDVGEGMTEGEIANYLVRVGDRVTIDQPVVEVSTDKMVAELPAPVSGVVTDLIIPVGQTVSVGTVLLLIEALETETAVTAEQPIQQTTEQIKVRPPVVTPAVPSNNRRVLATPYTRKIAREHGIDLEQVPPSDPSGRVTEEDVRRFLDADTSVEKTDVVEQTSTLSANPVETIPFRGIRKQIAKKMTQSLFTIPHVTHFEEVDMTRLLALREELKTAGKPISVNAFFIKALIFALQDFPVFNAKLDEANEQIILEQQFHIGVATETADGLIVPVVRDADKLTMQQLHTRVAELSARAKTGDLRAADLKPSTFTMSNVGPLGSTGATPIINYPETALIAFHKTKKRVCVDDHDQIVIRSMMNLSMSFDHRVADGATAVAFTNRFAGLIEHPTTLLMELI

SEQ ID NO: 24240 - protein, 316 aa, Opitutaceae bacterium TAV2
MSAQLFPDIVSTIGNTPLIKLGRIAAKLPGKIYIKNEFMNPCSSVKDRIGRAMIEAAERDGLIGPESVIVEPTSGNTGIALAFVCAQRGYKLILTMPETMSLERRVLLRMLGAELVLTPASEGMPGAIAKAHDILSQHGARGYMPQQFENPANPEIHRRTTAEEIWEATGGKIDAFVSGVGTGGTITGVAEVIKSRAPLRAIAVEPAASAVLSGGKPGRHMIQGIGAGFIPKNCNTSIIDEIIKVSDDDALNTARQLAVEEGILGGISTGANVWAALQVAARPEFEGKTIVTIACSCGERYISTSLAERAWQEVRV

SEQ ID NO: 24241 - protein, 698 aa, Oryza sativa
MEGCQLVARCSSSSSSSRMEVEEEAFFDTREELLPPSPAAALPWSGGLDSVRQRRERFMRSMGLERSPSLRQADFADVVGDVEEEGEVAAEAEIGRWSSQSDENECSMSSWSTEETTSYDDGASDDNSVSGSGKASRSFSSLSFIQRLMSRNGKPSGAPKTIDRRRNGWLRRLGVSACVVDSGAADEASTSSSDSEQIEAGRYERIKVHSYRKRSKELSAVYQGQVIKAHDGAILTMKFSPDGQLLATGGEDGVVRVWAVMQSEDCKIPLDDPSCVYLKARRKYGLAPVNAESEKKSKINGLKKSDSACIVVPTMVFQISEEPVHEFRGHSGDVLDLSWSSNKHLLSASTDKTVRMWEIGYANCIRVYPHSNFVTCVQFNLADENLFISGSIDGKIRVWDITRSSVVDWVDIRDIVTAVCYRPGGKGVVVGTITGNCRFYEISDNLLKLETQIALNGKKKSSLKRITGFQFCPSNPSKLMVTSADSKIRILDGTNVIQNYSGLRSGSCQLSATFTPEGQHIISASEDSNVYVWSHENQYECACKQAKTTQTSEHFRSNNAAIAIPWNGTKPRSPVPLSSQILPPQGDTFWSMSKAIKYNSSLCGKDSSIKKIVSTPAAPGIFNLNQEFFIESSCKSSATWPEEMLPSTTASVNLDESQFKLLRNCFQGTSNSWGQVIVTAGWDGRIRYFQNFGLPVHQ

SEQ ID NO: 24242 - protein, 424 aa, Brassica napus
MAATTTLGFVLPTGLSRRRGGFRVSLIRCSASPLTNSTASGLVEKPWDSYNARLVLEDGSIWPAKSFGAPGTRVAELVFNTSLTGYQEILTDPSYAGQFVLMTNPQIGNTGVNLDDEESEQCFLAGLVIRSLSISTSNWRCTKTLADYLTQRNLMGVYDLDTRAITRRLREEGSLNGVLSTEQTKTDEELLQMSRSWDIVGIDLISDVSCKSPYEWVDKTDPEWDFNSNSRDGETYRVVAYDFGIKHNILRRLSSYGCQITVVPSTFPASEALKMNPDGILFSNGPGDPSAVPYAVETVKELLGKAPVYGICMGHQLLGQALGGKTFKMKFGHHGGNHPVRNNRTGQVEISAQNHNYAVDPASLPGGVGVTHVNLNDGSCAGLSYPAMNVMSLQYHPEASPGPHDSDNAFKEFIELMKEIEQSS

SEQ ID NO: 24243 - protein, 321 aa, Herminiimonas arsenicoxydans
MPGSGTFGMEAVARQFATKQQCLILRNGWFSYRWTQILDMGDIPAGTTVLKARQLEDAPQAAFAPAPIDEVIATIKATKPAVVFAPHVETASGIMLTDDYMRQVSDAVHAVGGLFVLDCIASGCMWVDMQATGVDVLISAPQKGWSASAGCAFIMLSKLAREKIDSTQSTSFACDLRKWLQIMESYEQGNVAYHTTMPTDALTILRDVMEETAAYGFAKVRAEQQELGDKVRALLESKGFKSVAAEGYQAPGVVVSYTNDDGIQSARKFVAAGLQTAAGVPLQCDERSDFKTFRVGLFGLDKLHNIERTVANLSKALDTML

SEQ ID NO: 24244 - protein, 517 aa, Coprinopsis cinerea okayama7#130
MTSTNQSSVKASANAPTLSKYGQQRLVDGEKMYHVQKHMGDAYHPERNPKVRWGAMGAWCLTLSSTPTSDLSDPLIHALQLYRYPNSPNLPLSDPSTLTLSVLSNPSTRPSNSNPIRPLGHHGPTACERDTNIVPSSTSNSDLLRTPTPTPMYNANPDILREPKHPQAVAENSLMWDELRDLFDERLKLEAVDFTYGSSLYGSTPLRHALSHVFNKYFSPHIPVMPDHLILGSGLLSVISQLARALIDPPRLGAGGEVLGGGGGGEVLEAAGGALMLVTPYYHGFDLSLSTQFGIPVVGVDVPLSSMFTPSEVSVYLTKAFLREKERGVKVQAVLLCNPHNPLGRCYPKEVVEAYLAFCEKWNLHLVSDEIYALSRFESGDVGEPEGFRSILSFDLSSITVPSAMCSTGDSPSPDSDLNSNSNSNLNDDPPNTNADADTKPTTIAINPNRVHMIYGMSKDFNCNGFRAGVLFSYNKTIPYAVPVLLKGQFLTQFSSSSSKQILMRSPPSSNQIVTQF

SEQ ID NO: 24245 - protein, 451 aa, Rhizobium leguminosarum bv. viciae 3841
MRYERTTAAGYGKQMTTITIDDALNHAGAGRYQGRLMAIFGLVWAADAMQVIAVGFTAASIATSFELTVPQALQTGTVFFLGMFLGAMGFGRLADRIGRRGVLIATVSCDAVFGTLSIFAPDFTFLLFMRFLTGAAVGGTLPVDYAMMAEFLPAKNRGRWLVLLEGFWAVGTLVVALAAWLLSLWNVAEAWRLIFAVTALPAIIGFGLRFFVPESPLYLLRKGRGGEAKAIIDRMAVVNGRSALGQEIDIAPATPTRGIGIFSHALRRRTLLILAVWFLVSISYYGVFTWMPPKLAGDGFGFVRGYGFLVLIALAQLPGYALAAYGVEKWGRRPTLVAFCILSAMGSILFVVGSSTLLVASSLLIMSFALLGTWGALYAYTPELYPTASRATGMGAAGAMARLGGLLAPSLIGLFVTKDFGLVIGIFAALLLLAGAAAYFIDAETRSATLA

SEQ ID NO: 24246 - protein, 525 aa, Hordeum vulgare subsp. vulgare
MDMDQLCLMAVATILLTLILRQVLGGKGTGAKLPPGPWNLPVIGSLHHLVATKLPPHRALLSLSRRYGPVMLLRLGEVPNVIVSTPEAAMLVLKTNDLTFATRTSGPTLDVVGSASEGIIFAPYGEHWRQMRKVCVVELLSAMQVRRIQSIMQAEIAHLLESVAAASSASPSGSAVVDVGKGLARLTNNVIARAVFGGKSRQQEAYLRELDVMAILGGGFSLVDLFPSSRLVRWLSSSGRAMRRLHSRMQRILGDIIQDRKETRAPNGASDAATARDNEDLLDVLLRLGKQDALSFPLTSEIISAVIFDIFSAATDTTAATLEWAMAELVRNPRAMARAKLEVRQMLRHRRSSTITSADLAGLHYLRMVIKETLRLHPSAPLIHRASQENCRVMGYDIPKGTAVMINAFAVGRDPAHWGADAAEFRPERFQGTSVEYSSQGPHMEFVPFGAGRRQCPGALFATTMLELVLANLLYHFDWAIPGGESPETMDMGEVFGIIVHTRSSLHLQASEACHLQDQTTGVVS

SEQ ID NO: 24247 - protein, 1040 aa, Candida albicans SC5314
MSYNNRSGGGASGGYSRRGYHGSHRGGYRTGRSKYPEDRYLVGGMLSLNKGSHYESSDNRYIPNEIGSKSPENRSHRSSTKDGRTPSGLSTPLSSSDKVSTPISIESINGSDRNTGVNNKDSEFPKLSHHSDFTSTIPFSRSINPQKNFMVINDSHTPKTDKGIQSKKIRYNGEGVNHVSDPRIAQSNSNLQKPTKKTKKTPYKQLPQPKFVYNSDSLGPAPMSTIIIWDLPISTSEPFLRNFVSRYGNPLEEMTFITDPTTAVPLGIVTFKFQGNPQKASELAKNFIKTVRQDELKIDGATLKIALNDNENQLLNRKLESAKKKMLQQRLQREQEEEKRRQKLVEEQKKQELLKKKEKEHQESVKKEKSVEHESTIVSTRDKNLVYKPNSTVLSMRHNHKIISSVILPKDLEKYIKSRPYILIRDKYVPTKKISSHDIKRALKKYDWTRVLSDKSGFFIVFNSLNECERCFLNEDNKKFFEYKLVMEMAIPEGFTNNIRENESKSTNDVLDEATNILIKEFQTFLAKDIRERIIAPNILDLLAHDKYPELVEELKSREQAAKPKVLVTNNQLKENALSILEKQRQLFQQRLPSFRMSHDRTQQHKPKRRNSIIPMQHALNFDDDEDSESHSQSESEDEDEDETTASRPLTPVVSTMKRERSSTITSIEDDIELEEREIKKQKVKVPAIEAEIAPESSPEEGEEEEKEEVEIKQEAEEVDIKFQPTEESPRTVYPEIPFSGDFDLNALQHTIKDSEDLLLAQEVLSETTPSGLSNIEYWSWKSKNRKDVQEISQEEEYIEELPESLQSTTGSFKSEGVRKIPEIEKIGYLPHRKRTNKPIKTIQYEDEDEEKPNENTNAVQSSRVNRANNRRFAADITAQIGSESDVLSLNALTKRKKPVTFARSAIHNWGLYAMEPIAAKEMIIEYVGERIRQQVAEHREKSYLKTGIGSSYLFRIDDNTVIDATKKGGIARFINHCCSPSCTAKIIKVEGKKRIVIYALRDIEANEELTYDYKFERETNDEERIRCLCGAPGCKGYLN

SEQ ID NO: 24248 - protein, 399 aa, Clostridium acetobutylicum ATCC 824
MKIIVQKFGGTSVSTPERRSFVVQKVSSAIKEGYSPIVVVSAMGRAGEPYATDTLLSLIDNDFKETNKRASDLLMCCGEIISTVIMSNELKRAKIAAIPVTGGQAGIITDDEYSNASVKKVNPENLLKLLCHNEVPVVAGFQGKSQNGFFTTLGRGGSDVTASLIGCAVNAEKIEIYTDVDGIMTADPRIVQDAALIETISYNEVFEFAEQGAKVIHPRAVEVAMNGNIPLIIKNTLNDCKGTLINREGDSLNKNLITGITSLSGRVQVTTKFKDSKIKSTEFLSLLGERNINIDLINVFPKENIFTIDKKDLNKLKDTLIKTKVQYYLEDDCSKIAIIGNRICGVPGVMAKILKAITKEGIEVLQTADSHTTIWCLVKSNVRNKAINALHREFNLNNK

SEQ ID NO: 24249 - protein, 211 aa, Pseudomonas syringae pv. phaseolicola 1448A
MQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDLLMLDWAIASNMPMHILLTKADKLTYGAAKNTLLKVQTEIRKGWGDAVSIQLFSAPKRMGLEEAYTVLADWMELEDKAPAE

SEQ ID NO: 24250 - protein, 413 aa, Cucumis sativus
MFGRPKKSDNTKYYEILGVSKNASQDDLKKAYRKAAIKNHPDKGGDPEKFKELAQAYEVLSDPEKREIYDQYGEDALKEGMGGGGGHDPFDIFQSFFGGSPFGGGGSSRGRRQRRGEDVIHPLKVSLEDLYNGTSKKLSLSRNVICSKCKGKGSKSGASMKCPGCQGSGMKVSIRHLGPSMIQQMQHPCNECKGTGETINDKDRCSQCKGEKVVQEKKVLEVIVEKGMQNAQKITFPGEADEAPDTVTGDIVFVLQQKEHPKFKRKGDDLFVEHTLSLVESLCGFQFILTHLDGRQLLIKSLPGEVVKPDQFKAINDEGMPMYQRPFMKGKLYIHFSVEFPDSLNPEQCKALEGVLPPRTSVQLSDMELDECEETTLHDVNIEEEMRRKQAQEAYDEDEDMHGGAQRVQCAQQ

SEQ ID NO: 24251 - protein, 153 aa, Campylobacter jejuni subsp. jejuni NCTC 11168
MENNLQVNIFCIQKSDEFKTCSEKYSKLISKYATLKEINVFNKKIALAQNLNAIEAKKSYEEAFMPYKKGYCIALDEKGKDLTSIEFAKLIQDKNELSFFIGGAYGLREEFNQSLDFRLSLSKLTLAHQFVKTLLLEQIYRAFCINNNHPYHK

SEQ ID NO: 24252 - protein, 302 aa, Triticum aestivum
MSDTAAAPLLTSHKTRPVKAPSIDDTIETYMGATGALQLLKAVLLAFAWAFDAQQVFISVFTDAEPQWHCTGADASCSAAVASPCALPPGAWAWDRPAVTSVVSEWSLKCAGPALVSLPASSFFAGCLAGGFLLTTLADSLLGRRKMLLVSIVSMSVAGVLTAFSPNVWVYAALRFMSGFGRSMVGTCTLVLSTELVGKRWRDTVCVAGFFCFTLGFLSLPALAYTFREESWRNMYLWTSVPSLCYSILFYFLVVGCFGMFAACLPETRGKGMSDTMDEEEHKEAAVAACTVDDADCNSDLV

SEQ ID NO: 24253 - protein, 567 aa, Zea mays
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQLSMESNGKGVSIDGAQLSFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSTPYDTTVLPKV

SEQ ID NO: 24254 - protein, 71 aa, Zea mays
MADWGPVVIATVLFVLLTPGLLFQLPAHGRIVGFGTMHTSGIAILVHAVLYFALITIFLSSSASCFLVMYY

SEQ ID NO: 24255 - protein, 502 aa, Exiguobacterium sibiricum 255-15
MSTVHEKTIEMKRSVYHLVINGEQVEGTSGETFKTYNPATGEVIAEVAKASKADADRAVQAARDAFDHGKWKMWPVGRRSQVLNKIAGIMRSRFNELVELEILDTGKSLAAAQGQITQAIEDFEFYAGAIVGHRGSVNNVPGQFHNYTEKEPVGVCAQIIPWNYPLMMAAWKVAPAIAVGCSVVVKPATLTPLTAIILGEICLEAGVPAGVVNVIPGSGREIGNHLVEHPNVNKVAFTGSTPVGKDIMGRASESLKRVTLELGGKSPNLVFEDADITAAVDGSLFGIFYNSGQSCEARSRLYIHEDIYDTFMEQFVAKTKQLVLGNPFDKGTHVGAIIDQQQLDVIDGYVQSAKADGATILTGGQVEKVAGFEEGFWYAPTIIADVTHDMKAVQEEIFGPVVVVMKFKDEKEAVRLANDTEFGLGSAIWTKDGARATRIANQIKAGIVMINCPFSAFPGTPFGGYKQSGFGRELCIETLDLYTETKSILSYYGSRPLNPFGL

SEQ ID NO: 24256 - protein, 271 aa, Populus trichocarpa x Populus deltoides
MFRLSNNLVGILNFITFLLSIPILWAGIWLRNKGASECEKFLDTPVIVLGVFLLVVSLAGLIGACCGVSWLLWVYLVVMFLLIVVLFCFTILTFVVTNKGAGKVLSDKGYKEYRLGDYSNWLQKRVTSGKNWSKIKSCLIDAKICTDFQQRYLNDSLTVLYTRHLSALQAGCCKPPDSCGFNYQNPTTWDKTTNVTSDPDCNAWDNQSNVLCFNCNSCKAGLLDNLKSDWKKVAIINIIFLVFLIIVYSIGCCAFRNNRSENAYFSGWKHT

SEQ ID NO: 24257 - protein, 574 aa, Synechococcus sp. RS9917
MLRLERVSKIYPTGEVLRDVTWEVKPGDRIGLVGVNGAGKSTQMRLIAGLEEPSAGQIIRQGEPRIAYLQQEFDVDPRRSVRQELFQAFGEAAKVLNQQRQVEDAMASDRAAEDPDHLDALIHELSALQTRFEALHGYELDARIDKLLPSIGFSAEDVERPVADYSGGWQMRIALGKILLQEPDLLLLDEPTNHLDVETIQWLEGYLTEQTAALVVISHDRTFLDRVCTQIVSTERGISRAYLGNYTAHLEQKALEQAATQAAFERQQKEIASQQAYIDRFRASATRSTQAKSREKQLEKVERVEAPIESVAGPSFRFPPAPRSGAQVAVIENLTLSYGDQILFLGAELEVERGDRIAFVGPNGAGKSTLLRLVMGLERPDEGSARLGDHNIIASYFEQNQAEALDLSKTVIDTMFEAVPDWTQTQVRSLLGSFCFSNDSVFKEVGQLSGGEKARLALALMLLSPCNLLVLDEPTNHLDIPAKQMLEDALCHYDGAALLVSHDRYFISRVANRIVELRDGELILYRGDYSYYLEKKEEEKQAAEAALAAAQQEAKRRANREKQKQRQERRRHSA

SEQ ID NO: 24258 - protein, 178 aa, Selaginella remotifolia
FLSGLKEERVQAAEVYKKLGLAGRLGGNVKVDKQQLVDDVRKALYASKICSYAQGMNLIRAKSLQKGWNLNLGELARIWKGGCIIRAIFLDRIKKAYDRNPGLENLLIDPEFAAEMVERHEAWRGVQMKAVQAGVPVPGISASIAYFDAYREGRLPANLVQAQRDYFGAHTYERTDMA

SEQ ID NO: 24259 - protein, 492 aa, Streptomyces coelicolor A3(2)
MTHELFDSKGLLGSAPAAFVAGEYELDSSHGTLPVINPANGQLVAEVPSSSSSTVDRAVTAAVAAQREWGRRSHVARAAVLEAVRDAIAVHADELARIVSVEQGKPLSDARGETEGACAFFDFAISQKYRAVGSMMASEPGRSLGVREEPIGVVAAILPWNFPVAIFARKVAPALMAGNAVVLKPSELTPLSALALARLCRLAGVPDGLLSVVCGEGKDTGRALVTHPGVGMVTMTGSTRGGREILAQVADQIIPVSLELGGKAPFIVFEDADLDAAVEAAADARLWNTGQVCTCNEVTYVHADLHDEFVRRVVDRFASVTPLDPFAAGSRLGPLVAERERTRVQGMVDAAVAAGARVRTGGGRPDGEQYQSGAWFAPTVLTNVRPEMDIARREVFGPVLPIIPFDAEAEVVSAANSTAYGLTAYVYTRDLSRAMRMIDALEFGEVYVNQAGPEQVQGFHTGWKSSGLGGDDGPHGYEKYLRRKTVYVRHAV

SEQ ID NO: 24260 - protein, 203 aa, Clostridium acetobutylicum ATCC 824
MNLANKLTLMRIFLVPVFLIFIVVRQIPYGRSIATAIFIIAAITDKLDGYIARSRNQVTKFGKIMDPLADKLLVSSALIALVEFHVIPAWIAIVIIAREFAVTGLRSVAAGEGIVIAASWWGKIKTFIQIVTIIFALLFINLRKNYDFRKFVDQFALLSNHSAQVEKFLRYGTDITLAIAFIVTLISGIDYFYKNRHVFINDK

SEQ ID NO: 24261 - protein, 248 aa, Triticum aestivum
MPASIAFGRFDDSFSLASFKAYIAEFISTLIFVFAGVGSAIAYSKVSGGAPLDPSGLIAVAICHGFGLFVAVAVGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCDDHTAVAGNDY

SEQ ID NO: 24262 - protein, 204 aa, Triticum aestivum
YNKFVQKSRLVPVRNSRDIVDPRVRLQGISTTLGHITRAAHPPAAYMAASKGARKSLVSRTLERCRSGLASGGRSSAAVAPGCFSVYVGPERERFVVRADRANHPLFRRLLDDAEQEYGYAAQGPLALPCSVDAFLDVLWHMDHDVQDDDDGEAAVAPSTPICGLQRAGSGNIKVRPAGYRVLSPAKSTPASFFFSQTAAGGRR

SEQ ID NO: 24263 - protein, 172 aa, Zea mays
  misc_feature (90)..(90): Xaa can be any naturally occurring amino acid
  misc_feature (93)..(93): Xaa can be any naturally occurring amino acid
  misc_feature (108)..(108): Xaa can be any naturally occurring amino acid
  misc_feature (118)..(118): Xaa can be any naturally occurring amino acid
  misc_feature (130)..(130): Xaa can be any naturally occurring amino acid
  misc_feature (133)..(133): Xaa can be any naturally occurring amino acid
KKKKKSWASSDGLASVDPWSFRQSFNIDSWLLPDPFSHDSDVLAKALHKSISDPFSPSAYFDSAAVSDLSPSSTVSNVSFGSDPEIAGGXGGXGNTKRGPGVAAGKRXKRRSRVSTRXSQTTFITADAAXLRXMVQQVTGAKYTGSPHGFFAPVGRPEPHRLPSRLPTSGAF

SEQ ID NO: 24264 - protein, 205 aa, Candida albicans SC5314
MSSEKEYKPVTVDKPIPNTYDLGNLATFDPNPLDNEKLLSKDESIKEDHLQSVTRDNVQLLINQILSLPVKITTETHGSSTGQNSTMTLIQLPEPTTILPREKPIPKAKPLTKWQQFAARKGIKPKAKDGKMVYDEDTGEWVPKWGYKGKNKSIDDQWLVEVDDKVKNTEDELIDPRTLKRAERKKLIKKNELQHKRNLRNQGAV

SEQ ID NO: 24265 - protein, 398 aa, Clostridium acetobutylicum ATCC 824
MNFSKKAGQIAASITLEITAKADEMKANGINVIGFGAGQPDFNTPKNIRDAAIYAIENGYTKYTPVSGIKELKMAICDKFKRDNNLNYSLSNIIVSTGAKQCLSDTFSALLNPGDEVILSAPYWVTYPELIKLNDGISVIINTTEENHFKLSVDDLENAYTSKTKAILINSPSNPTGTVYTETELKAIAEFAKEKDLFIISDEIYEKLIYDGERHVSIASLSQDAFNRTVVINGMSKSYAMTGWRLGYAASGSSEFIKLMSHIQAHTTSNANSITQYASVEALNGRQEELHSMVTEFEKRRTYMSKRVNNITGIHCLLPKGAFYVMMNISNLFGKEINGVKINNSVDFSKELLSENKVAVVPGTGFGNDNYVRLSYATSMDNIVKGLDEIENFIGKLR

SEQ ID NO: 24266 - protein, 326 aa, Streptomyces coelicolor A3(2)
MTDSRAGLGPQAAGGLLTFGETMGLVTATTIGTLEYARDFTFGIGGAESNVAIGAARLGAPVTWIGRVGSDAAGDLVGRRMRAEGIQTVAVRDTSFTGLMVRHHRAATVVHVDYHRAGSAGSRLTAHDIPVGEIRRAAILHLTGITPALSASARQATWDAVAAAKANGVRVSLDVNHRSKLWDRDTARRELRRLVAEADIVFAGIEEAQLVLDSEADAPESLADALAATGPGETVVKTGARGCTAHIDGAIHEEPALSVPVVDTVGAGDAFVAGYLAEHLRGAGPVQRLRTACAMGAYAVSVPGDCELLPTRSELETFLTTGDVLR

SEQ ID NO: 24267 - protein, 591 aa, Mesorhizobium loti MAFF303099
MPAFFCYQLDAGHTVCCPSAIAVRRCLDATPTIAHGSPNSRNRAMQAAIFVLVVLVFVAVSGALVRLVRVPLPVLQIAIGAALAWPVRGIHVEIDPELFLLVFIPPLLFSDAFGAPKRELMALRGPILDLAIGLVFFTIVGFGYALHWLVPSIPLVVAFALAAVLSPTDAVAVSSIVDRNVVPARLMHILEGESLLNDASGLVMFRFAVAAALTGSFSFAAASLSFLYAVAAGIVAGVAALFVAAKALQLLNRIGGVPAEPQVLITILLPFVAYLGAENFGASGILAAVTAGLLTGSTGIFRFLGVSARMQTISLWTTFSFVFNGALFIVLGLQLPEIIRKVPPELSSRHWLLEPVLTVLLLTLCLIALRFVWIWIGDITAGFAARLGKRKAEPFGLRVRLAGSVAGVRGAITLAGILSLPLALQDGSPFPARDLVIFLAAGVIICSLLIASLALPVIARGLVEPGEDAGAAEERMARVGAAKAAIAHLESLAQTDEEEGDVPGLKLAAANGIVAAYRRRIAASDEADEARAEMREAGRLETDLRLAGIAAERDALRAMLRRGEINDHTARALFTEITLSEALLNGRQTRK

SEQ ID NO: 24268 - protein, 370 aa, Aspergillus awamori
MSNLPHEPEFEQAYKELASTLENSTLFQKNPEYRKALAVVSVPERVIQFRVVWEDDAGNVQVNRGFRVQFNSALGPYKGGLRFHPSVNLSILQVPWFRADLQECSHWPEHGWWYVEHMIAHATNGQESFKGKRVAISGSGNVAQYAALKVIELGGSVVSLSDTQGSLIINGEGSFTPEEIELIAQTKVERNELASIVGAAPFSDANKFKYIAGARPWVHVGKVDVALPSATQNEVSGEEAQVLINAGCKFIAEGSNMGCTQEAIDTFEAHRTANAGAAAIWYAPGKAANAGGVAVSGLEMAQNSARLSWTSEEVDARLKDIMRDCFKNGLETAQEYATPAEGVLPSLVTGSNIAGFTKVAAAMKDQGDWW

SEQ ID NO: 24269 - protein, 387 aa, Triticum aestivum
  misc_feature (228)..(228): Xaa can be any naturally occurring amino acid
  misc_feature (272)..(272): Xaa can be any naturally occurring amino acid
  misc_feature (290)..(290): Xaa can be any naturally occurring amino acid
  misc_feature (301)..(301): Xaa can be any naturally occurring amino acid
MERTQGFFAALKQEVARGLSPARARRRSELADLDAAALRFSGPGGGGEMLAPLMEGPDPESGDGVGRAAAGARREGWGRWVRGQLARTPSSVAAAAAGAGAARNDRRRLLGVMGAPLAPVHVCAAEPLPHLSIKDTPIETSSAQYILQQYLAASGGHRLLASVRNSYAMGKVRMVATEFENAGRLVKNRNAARCAEPGRFVLWQMAPEKWYIELAVGGSKVHAGCNGXLVWGPTPGLGSHAAKGPVRPLGRALQGRDPLTGTSILAGARCIXGERKVTGEDCFILKLVTXPEPLQGRARGXLAEIHRHCSVPGTSPQEDPALLVPNWGHPPRSGGFGQNPGGEWGLWGRPPPNGFTWGDPRPGGGALLIGPLGGPAPGNLCSRPAGG

SEQ ID NO: 24270 - protein, 323 aa, Glycine max
LFCLPCSSLNAVANDGGWIYLGTNKTMAKSSSTGYSQWSLSKDHLQVGDTVRSRKLSNSCNPQNMEVPEGNVVGLERNVDHGFVLVRLHGVHDPVRIRASTLERVTNGLGAGDWVRLKEEDDKHSPVGILHSINRDGRVTVGFIGLQTLWNGNSSELEMAEPYCVGQFIRLKTNVLSPRFEWPRKREGAWATGKISWILPNGCLVVKFPGMLNFLDAPSTVLADPSEVDVVNFKNCPKMIEKYQHVEDHHWAVRPVLLAFGLLTAVKLGMSIGKKFGRNINVTAMESESHYTDSQNASTSSPTWTSSVASILFREGVNLPNGH

SEQ ID NO: 24271 - protein, 244 aa, Prochlorococcus marinus subsp. pastoris str. CCMP1986
MLRTFKSDIEIIRERDPAARGILEIFLCYPGFQSIIVHRFTHKLWLLKLPLIPRLLSHLNRLLTGIEIHPGAKIGEKVFIDHGMGVVIGETAEIGNNCLLYQGVTLGGTGKSHGKRHPTLMENVVVGAGAKVLGSIIIGQNTRIGAGSVVVRNVEENSTVVGIPGRVVHQSGVKVNPLAHSALPDAEANVIKNLMDRIDQLENQILQLQNTLQCLVNSESNDISKIGNAQNLKDKEIIEFLGDN

SEQ ID NO: 24272 - protein, 231 aa, Triticum aestivum
MPRITSVDSPGCPPLRAITTDILGLIKVIEARARPAGIAKVVETWGEPDASRAILVASLADRAVDPVLAVARKNGVVELLNPLNGDALAVVKSSRTEQTVGAVENDPLVALHLFRKHAPDLTTLGTFLACTEKGKASVRSVAKENTASDSDVGPSSTWDVCNKGTWQFSSVDLGENYPMFGGNGMEVNLWDITSGSKRGSANSLTGLPTLLLWNFFAPNAKKGNCKKTFFF

SEQ ID NO: 24273 - protein, 562 aa, Erythrobacter sp. SD-21
MYSYDEFDRTYVKDRVATFRDQVARRISGALTEDEFKPLRLQNGIYLQLHAYMLRVAIPYGTLNSAQMRQLAMIAERWDKGYGHFTTRQNIQYNWPKLVDLPDILDALADVEMHAIQTSGNCIRNVTADHFAGAARDEIEDPRPAAELLRQWSTDHPEFAFLPRKFKIAVTGAEEDRAVTRAHDIGIQIVRNEAGEVGYKVIVGGGLGRTPVVGVTIRDFLPKEHLLAYCEAILRVYNLHGRRDNKYKARIKILVMEEGLDSFRAQVEDEFASLLERHHGPSLIPDPAVVERIEQAFAPPAFETLPDSDEALDARLASDPAFAEWCEVNLTEHREPGHTIVSISLKPVGEAPGDASTAQMQVVANLAELYSHDEVRVSHEQNLILPHVAKRNLPAIYDALKDAGLATANINLIGDIIACPGLDYCALATARSIPIAKDIAQHFADSAYARTIGEMKIKISGCINSCGHHHVGHIGILGLDKGGKENYQITLGGDHTQDLQLGQRLGPGFDAKDVVPAIERLVEIYLGLRQDKDETFLKAVKRVGIQPFKDALYPPKESARAA

SEQ ID NO: 24274 - protein, 326 aa, Corynebacterium diphtheriae NCTC 13129
MTSHNWTANQKNLMVLTGRAHPELADAVAKELGVEITPTTARDFANGEIFVRFEESVRGCDAFVLQSHTQPLNKWLMEQLIMIDALKRGSAKRITAILPFYPYARQDKKHRGREPISARLVADLLRTAGADRIVSVDLHTDQIQGFFDGPVDHMHAMPILTDYIKGKYDLDNVVVVSPDAGRVKVAEKWANTLGDAPMAFVHKTRSVDVANQVVANRVVGDVAGKTAILLDDMIDTGGTIAGAVGVLRDAGAEDVIIACTHGVFSGPARERLSQCGAKEVITTDTLPQSTEGWDNLTVLSIAPLLAKTIHEIFENGSVTTLFEGQA

SEQ ID NO: 24275 - protein, 444 aa, Lactobacillus plantarum WCFS1
MTNKYDYDVLYIGAGHATFDGAAPLAKTGVRVGVIESGLIGGTCPNRGCNAKITLDEPVKLTRETARLNDILSSAPTINWTANVAHKQEIIDPLPAGLTARLEDGGATIIHGHATFKDAHTVVVDDQQTITAEKIVIATGLKPHRLDIPGTKLAHDSSDFMNLKRLPQSIVIIGAGYIGMEFATIANAAGAQVTVMLHGDQALRDFYQPFVAQVVDDLTERGVTFIKNANVQAFTKQDDQFQVSYGDHQQLTTDWILDATGRIPNLDGLGLDRIGVKYDRHGVYVNDHLQTNVPNIYAAGDVLANDLPKVTPAAYFESKYLMRLFSGQTSAPIDYPVIPSVVFTSPRIAQAGMKIPAAEKAGLTVSDNDLADYWYYQVSKEPIAASKQVHDQDGHLVGVTEISDQAEDAVNALLPAIEYQLDREQIDRLIGIFPTIGYAAWHRA

SEQ ID NO: 24276 - protein, 172 aa, Exiguobacterium sibiricum 255-15
MKIPYRDSSPQLATNVFVAPGAFLIGDVTVGEESTIWFNAVLRGDEGPITIGKRCSIQDNATIHLYEGAPVIVEDEVTVGHNAILHGCKIGRRSIVGMGATVLDHADIGEECIIGANTLIPSGKKFPPRSLIIGSPGKVVRELTAADLEMIQESIDSYVDKGYAFRKQLADN

SEQ ID NO: 24277 - protein, 538 aa, Bradyrhizobium sp. BTAi1
MAIIDNTISPTGAAFQANRDGMLGLIGRMRDLEARTRNASAAAKDRFHQRGQLLPRERVALVLDPGAPFLELSTLAGYMFDVPDPAKSVPGGGVVAGIGFVSGVRCMVSANDAGIDAGALQPYGLDKTLRVQELALENKLPYVQLVESAGANLLRYRVEDFVRGGNIFRNLARLSAAGLPVVTVTHGSSTAGGAYQTGLSDYIVMVRGRTRAFLAGPPLLKAATGEIATEEELGGAEMHTSVSGLGDYLAEDDRDALRIAREIMGKLNWDRPSRDATTAKPPRYDQEELLGIMPLDHKRPVDMRQVIARIVDDSDFVEMSPNYGPATVCGHARIEGQAIGIVTNNGPLDPAGANKATHFIQACCQTRTPILYLNNTTGYIVGRAYEEAGMIKHGSKMIQAVTSATVPQITIYCGASFGAGNYGMCGRGFHPRFCFSWPNAKTAVMGGEQAAETMAIVTEAAAARRGKPVEREKLDAMKAQIVSVFDSQMDVFATSARVLDDGVIDPRDTRAVLSEVLAICREAEAREPQRMQFSVARP

SEQ ID NO: 24278 - protein, 158 aa, Prochlorococcus marinus subsp. pastoris str. CCMP1986
MTIFEGSFTNASTLKVGIVVARFNDLITNKILSGCLDCLKRHGLDTSETSKELDIVWVPGSFELPIAAKTLLKKTNYDVVIALGAVIRGETSHYDVVISEASKGISQVSYENNVPIIFGVLTTDSMQQALERAGIKNNLGWNYALQAIEMGSLIKNLN

SEQ ID NO: 24279 - protein, 172 aa, Oryza sativa Japonica Group
MSGCFCVCSFVLSAYLGSVVVAKVFFSTRAGEGLKPKLDEVLPQAAGIVFAVDAQDFLSTMQVVAEYLYDILTKATVVKKRIHVLIFCNKTDKVTAHSKEFIKKQLEKEINKLRESRKDISSADTTDEVKLGNPGETFYFSQCQNRVTVAEGAGLTGNVSAVEQFIREYVKA

SEQ ID NO: 24280 - protein, 474 aa, Erythrobacter sp. SD-21
MTKTYANLINGEMVTTAATLDVVNPANEEVVGLVPSCGKDELDRAVAAARNAFKSWRKTSAEERQKVVMGISAAIKENADELFRLLTTEQGKPHAQAQMEIFGAAGLAAAQSGLTLDDVINQDDDTRLSRTRRVPVGVVGGIVPWNFPVMMAVQKIVPALISGCTIVLKPSPFTPLTTLRIAELIKDVVPAGTVNIITGPDELGPLITEHPDIDKITFTGSTATGKKIMEGAAGDLKRITLELGGNDASIVLPDADVGKVAEQLFWSSFSNAGQICVAAKRIYIHEDIYDDLSKAIAEYAKTVVVGDGSQQGTGVGPIQNKKQFDRVCELIQDAKDNGYQFLTGGDVDPSGTGYYVPITILDNPPEDARIVAEEQFGPVMPLMKFGSVDEVIERANNSEYGLAGAVWTKDTDKGVEIAEQLETGTVWINEFLHISPLAPFGGHKQSGIGAEYGIDGLKEFTYPQVITVKRNAEV

SEQ ID NO: 24281 - protein, 114 aa, Oryza sativa
  misc_feature (19)..(19): Xaa can be any naturally occurring amino acid
  misc_feature (24)..(24): Xaa can be any naturally occurring amino acid
MSQFGQVVGILRKLNDEYXTTTPXKLKLIDAYLVYVLLTGIIQFAYCLLVGTFPFNSFLSGFISTVGCFVLAASLRIQLNKANRTTFNVTPERAFADFVFAHIILHLVVINFIG

SEQ ID NO: 24282 - protein, 453 aa, Roseovarius nubinhibens ISM
MQHVEGEDNRSEARAAWARAQGAGPGAALIARDAEAFLHQSLSSPCVSTIARAEGIWIEDLEGRRYMDFHGNSVHHLGYGHPKVIAAIKDQLDALPFAPRRFTNEPAVALAEKLGAVAPGDLSKVLFTTGGSDANEVALKIARAATGRFKTLSFWDAFHGAGFGAASVGGEATFRSHIAGPLLPGAEHVAPFHCYHCAYGHPGPEACGLACAKMVEYVLAREGDVAAVIAEPMRAVPVVPPPGYWQAVQAACHRHGALLIMDEIPTGLGKTGEMFAFEHDGITPDIVTLGKALGGGVLPIAAVLARRDLDVCGEFAIGHYTHEKNPVTARAALATLEVIEEEDLVARAARLGEAAQARLRERLSGLASVGDIRGRGLMFGVEIVRDREGRVPAPGLAEQIYYRSLAAGVSFKISAGNVLTLSPPLVIAEEDLWTALDHVAAAVEAVTEAAGLC

SEQ ID NO: 24283 - protein, 130 aa, Brassica napus
  misc_feature (118)..(118): Xaa can be any naturally occurring amino acid
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLXSEGKGCVYSYDA

SEQ ID NO: 24284 - protein, 499 aa, Aspergillus oryzae
MMVAWWSLFLYGLQVAAPALAATPADWRSQSIYFLLTDRFARTDGSTTATCNTADRKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 24285 - protein, 475 aa, Zea mays
GWFLRERKLGTRKLGPLEGYSRAAAVAAPAPANGAFPKMPAFDYTPPPYNGPRAEIFRKRAQFLSPSLFHFYDRPLDIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFKVVQMGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRKSYFNRSTFDGNPVSTAGGHAVLKVLEKEKLQENAFVVGSYLKEQLNNLKDKHEIIGDVRGKGFLLGVELVTDREKKTPAKAEISRVMNHMKDMGVLVGKGGFYGNVFRITPPLCFTKEDSDFFIEVMDIALSKL

SEQ ID NO: 24286 - protein, 598 aa, Oryza sativa Japonica Group
MTTYRVCCFLRRFRAASNEPSEELGDVFQAYADGGGGVMGEEALRRFLREVQGEAAGGGDDELEATAREVMAFAAEQRLLRKGGAAAAGGGLTVEGFHRWLCSDANAALDPQKRVYQDMGLPLSHYFIYTGHNSYLTGNQLSSGCSEVPIVKALHDGVRVIELDLWPNAAKDAVEVLHGRTLTSPVGLMKCLEAIREYAFVASPYPVILTLEDHLTPDLQSKVAKMIKETFGDMLYVSETENMAEFPSPDELKGKIIVSTKPPKEYLQTKNDADADEAGVWGEEITDDKVAATAMTTEEKCAAAEEAVAAAAVDEEMQEAETDKKTQHGVDNEYRRLIAIPLTRRKHDMDQDLKVDPDMVTRLSLGEKAYEKAIVTHGAHIIRFTQRKLLRIFPRSTRITSSNYNPLMGWRYGVQMVAANMQGHGRKLWLTQGMFRANGGCGYVKKPDILMNNDPDKLFDPTSKLPVKTRLKVTVYMGDGWRFDFRKTHFDKCSPPDFYARVGIAGVEADTRMEQTKVKMDTWIPAWDHEFEFPLSVPELALLRVEVHESDNHQKDDFGGQTCLPVWELRRGIRSVRLCDHRGEPLRSVKLLMRFDFT

SEQ ID NO: 24287 - protein, 164 aa, Mesorhizobium loti MAFF303099
MAGISQHGKAFIRPKAKAHLLIVEARFHDDLADALLDGATSALEEAGATYDVVTVPGSLEIPAVITFALDGAAEGGTNYDGFVALGTIIRGDTYHFDIVANESSRALMDMSVQDSVCIGNGILTTENDAQAWTRAKRSEGDKGGFAARAALTMIALKEQLGARS

SEQ ID NO: 24288 - protein, 61 aa, Glycine max
MKFNIANPTTGCQKKLEIGQHGELRPFWDKRISQDVVGDALGEESKGYVSKILNVATSNDF

SEQ ID NO: 24289 - protein, 432 aa, Arabidopsis thaliana
MKLKWESISNLQQNTYLIKLVAATLITCLAFRFFVFRFGQFSPVQVSVTGNSNSQISPTSVILSDNEDQIPVDIEVEKCDLFTGKWIKDPLGPIYTNESCGIVVDAHQNCITNGRPDSGFLNWKWKPNDCSLPRFDSLRFLQLMRNKSWAIIGDSIARNHVESLLCMLSTVEKPVEVYHDENYRSKRWHFPSYNFTVSNIWSPFLVQADIFEDSNGVSSAAVQLHLDKLDNTWTDLFPSLDYAIISSGEWFLKTAVYHENANPVGCHGCPESSNMTDLGFDYAYNTSLRHVMDFIAKSKTKGMIFFRTSIPDHFEDGEWHNGGTCKKTEPVGEEAVEMKVLNKILRDVEINQFERVVTEMGQESENLKLLDFAGMLLTRPDGHPGPYREFRPFDKDKNATVQNDCLHWCLPGPIDHLNDVILEIIVNGRTGK

SEQ ID NO: 24290 - protein, 445 aa, Rhizobium leguminosarum bv. viciae 3841
MTRVAVIGAGPSGLAQLRAFQSAAQKGAEIPEIVCFEKQSDWGGLWNYTWRTGLDEYGEPVHGSMYRYLWSNGPKECLEFADYSFEEHFGKPIASYPPRAVLWDYIKGRVEKANVRHWVRFSTPVRMVRFDDQTKKFTVTAHNRIEDRMYDEEFDYVVVASGHFSTPNVPYFEGVKTFNGRVLHAHDFRDALEFKGKDILLVGRSYSAEDIGSQCWKYGAKSVTTSYRSKPMGFKWPENFEERPLLTKLENRTAHFLDGSTKEVDAVILCTGYQHHFPFLPDDLRLKTANRLWADSLYKGVIFDKNPQLFYIGMQDQFYTFNMFDVQAWWARDVMMGRITLPPEEELKANFDMWRAREETLEDAEQMIWYQGDYVKELLAETDYPSFDIEGTNQTFMEWEHHKAHNIMGFRDHAYRSLMTGNMSPTHHTPWVEALDDSMEEYLRN

SEQ ID NO: 24291 - protein, 292 aa, Azoarcus sp. BH72
MKRILVVGSGDVARRAIPWLARRMRVFALARRPEAAAELRALGAVPLRGDLDDRASLDRLAGVADAVLHFAPPPAEGDGDPRTARLLAALAKRRSLPQHLIYISTTGVYGDCAGAEVDETAPCRATTARALRRVDAERRLRAFGRRTGAVVGVLRAPGIYAADRLPLERLRRGDPVLAAADDVWTNHIHADDLARLALAALFRGRPGRVYNAVDDSRLKMADYFDAVADACGLPRPPRCRRAEIASRLSPLTLSFMSESRRLTNRRIHTELRARLRYPTVADALRALPAPTA

SEQ ID NO: 24292 - protein, 368 aa, Oryza sativa Japonica Group
MAEAAGDGGWPEPVVRVQALSESGAATIPDRYVRPETERPSSSSEANAVANINIPVVDMSSSPGTAAAAVAEACREWGFFQAVNHGVPAALLRRARGVWRGFFQQPMEVKQRYGNSPATYEGYGSRLGVDKGAILDWGDYYFLHVRPPHLLSPHKWPHLPPDLRETTTEYSEEVRRLCERLMAVMAVGLGVEEGRLQEAFGGREGAGVCVRVNYYPRCPQPDLTLGLSSHSDPGGMTVLLVDDRVKGLQVRHAGAWVTVDPVPDAFIINVGDQIQVVTNALYRSVEHRVVVNAAEERLSIATFYNPRSDLPVAPLPELVSPERPPLYSPMTFDDYRLYIRRNGPRGKSQVDRLAAAAATIPNSTTTTQ

SEQ ID NO: 24293 - protein, 713 aa, Mesorhizobium loti MAFF303099
MTILYAVIACGLLSVLYAIWATRSVLASDQGNARMQEISAAIREGAQAYLARQYTTIALVGVVVLLLAWWLLSITAAIGFLIGAVLSGAAGFIGMHVSVRANVRTAQAASNSLAAGLDIAFKSGAITGMLVAGLALLGVSIYYLILTGPMGLQPNDRIVIDSLVALGFGASLISIFARLGGGIFTKGADVGGDLVGKVEAGIPEDDPRNPATIADNVGDNVGDCAGMAADLFETYAVTVVATMVLGAIFFGGTAVLGAAMLYPLAICGACILTSIVGTFFVKLGANGSIMGALYKGLIVTGLLSIVGLAVATSVCFGWGEIGTVAGMVITGKNLFICGLIGLAVTGLIVVITEYYTGTNKRPVNSIAQASVTGHGTNVIQGLAVSLESTALPAIVIVGGIISTYQLAGLYGTAIAVTTMLGLAGMIVALDAFGPVTDNAGGIAEMAGLPKEVRHSTDALDAVGNTTKAVTKGYAIGSAGLGALVLFAAYSNDLKFFAANGDKYPYFQGMGEISFDLSNPYVVAGLIFGGLIPYLFGGIAMTAVGRAAGAIVEEVRKQFREDPGIMAGTSKPNYARAVDLLTKAAIREMIIPSLLPVLAPLVVYFGVLLISGSKASAFAALGASLLGVIVNGLFVAISMTSGGGAWDNAKKSFEDGFTDKDGVKHLKGSEAHKASVTGDTVGDPYKDTAGPAVNPAIKITNIVALLLLAVLAHG

SEQ ID NO: 24294 - protein, 251 aa, Idiomarina baltica OS145
MSDKHEDGIDFGYQRVPKDAKKGLVANVFNSVAAKYDVMNDLMSMGIHRVWKRYTIDCSGVRKGMKVLDIAGGTGDLTAQFSRRVGETGEVVLADINDAMLKVGRDKLRDKGIVGNVNCVQADAENLPFADNSFDIVTIAFGLRNVTDKPAALRSMLRVLKPGGRLLILEFSKPTTATLNQLYDFYSFNILPKMGQLVANDADSYQYLAESIRMHPDQETLKQMMSEAGYENADYQNLTGGIVALHRGYKF

SEQ ID NO: 24295 - protein, 390 aa, Bacillus licheniformis ATCC 14580
MRTTYISKAAQQIKPSGIRKFFDLASTMEGVISLGVGEPDFVTAWNVREASILSLEQGYTSYTANAGLLSLRKEISAYLNKRFHLDYAPDDELIVTVGASQALDIAVRAILDPGEEVLIPEPCFVAYEALVSLAGGKAVHIHTNAERGFKASAADFEAVLTERTKAIILCTPSNPTGSVYSKKELEEIAAFAEKHDLIVIADEIYAELTYDEAYTSFAEIAGMKKRTILISGFSKGFAMTGWRLGYVAAPAYLRDPMLKIHQYSMMCAPSMAQFAAEEALKNGLEDVEKMKKSYRRRRNVFVDSLNEIGLDCHQPGGAFYAFPSVKKTGMSSEQFAEELLISEKVAVVPGNVFGPSGEGYIRCSYASSLEQLQEALVRMKRFVEKVGAVK

SEQ ID NO: 24296 - protein, 474 aa, Lactobacillus plantarum WCFS1
MDLSHTRLLRKKDINAMLATYHSPLKKELKTFDLTMLGIGAIIGTGIFVLTGTGALTAGPGLMISFVLAAIACLFASLCYAEFAAMVPESGSAYTYAYTTLGEIVAFIIGWDLMLEYLFAVSTVSAGWSGYFQSFLAGFGLKLPAALSAAAGSVPGVTSYFNLPAFTIIILITTLLSLGVKETKRVNNVMVVIKLAVVLLFIFTAVRFIKPANWSPLLPFGFKGVFGAASSVFFAFIGFDAISSSVEETLEPSKTLPRSMLLSLGICTILYVAVSAIMTGVVPFETFAKYIDHPISAVLIYSGQNWMAGIIDLGAILGMTTVMLVCLYGQTRISFSMSRDGLLPHVFSDISAKTGAPLKSTVLFGSIAAIMGGFIPLADLAELVNIGTLTAFTLVSFSILRLRKTQPDLRRPFKTPWVPFVPIMSIICCVFLLINLKPVTWIRFVVWLAIGMVVYFGYSVKHSQLKTDTATDEK

SEQ ID NO: 24297 - protein, 341 aa, Idiomarina loihiensis L2TR
MKALSKLHAKPGIWMTDVEKPECGYNDLLIKIKKTAICGTDVHIYKWDDWSQKTIPVPMVVGHEYVGEVAAMGDGVRGFEIGDRVSGEGHITCGHCRNCRAGRRHLCRNTYGVGVNRPGAFAEYLALPAENAFKLPDDVTDEMAAVFDPFGNAVHTALAFDLVGEDVLITGAGPIGIMAAAVARHVGARHVVITDVNEYRLDLARKMGVTRAVDVSKEKLSDVMTELGMKEGFDVGLEMSGVPSAFSQMLETMNHGGKIAMLGIPPENIAIDWNQVIFKGLVIKGIYGREMFETWYKMASLLQSGLDISPILTHEMPIDDFEKGFETMISGQSGKVILNWD

SEQ ID NO: 24298 - protein, 307 aa, Oryza sativa Japonica Group
MAGGFLSMANPAVTLSGVAGNIISFLVFLAPVATFLQVYKKKSTGGYSSVPYVVALFSSVLWIFYALVKTNSRPLLTINAFGCGVEAAYIVLYLVYAPRRARLRTLAFFLLLDVAAFALIVVTTLYLVPKPHQVKFLGSVCLAFSMAVFVAPLSIIFKVIKTKSVEFMPIGLSVCLTLSAVAWFCYGLFTKDPYVMYPNVGGFFFSCVQMGLYFWYRKPRNTAVLPTTSDSMSPISAAAAATQRVIELPAGTHAFTILSVSPIPILGVHKVEVVAAEQAADGVAAAAAADKELLQNKPEVIEITAAV

SEQ ID NO: 24299 - protein, 400 aa, Campylobacter jejuni subsp. jejuni NCTC 11168
MFDEIRFNTIERLPNYVFAEVNAIKMAARRAGEDIIDFSMGNPNGKTPQHIIDKLCESANKDKTSGYSTSMGIYKLRLAICNWYKRKYNVNLDPENEVVATMGSKEGFVNLARAIINPGDVAIVPTPAYPIHTQAFIIAGGNVAKMPLAYNEKFELDENQFFENLHKTLNESIPCPKYVVVNFPHNPTTVTCEKSFYERLIATAKKERFYIISDIAYADLTYDDYKTPSILEIEGAKDVAVETYTLSKSYNMAGWRVGFVVGNKRLVSALKKIKSWFDYGMYTPIQVAATIALDGDQTCVDEIRATYDKRMHILLEAFENAGWKLQKPRASMFVWAKLPESKRHLKSLEFSKQLLQRASVAVSPGVGFGEAGDEYVRIALIENENRIRQAARNIKKYLKE

SEQ ID NO: 24300 - protein, 283 aa, Kluyveromyces lactis NRRL Y-1140
MLRRQARERREYLYRKAQELQESQLQQKRQIIKQALAQGKPLPKEIAEDEQLQKDFQYDESAQEQIDDEYSATSGIAEPKIIVTTSRDPSTRLSQFAKEIKLLFPTAVRLNRGNYIMPNLVDACQTSGTSDLVVLHEHRGVPTSLTVSHFPHGPTAFFTLHNVVLRHDILNSGNQSEVNPHLIFDNFTTPLGKRVETILKHLFPPGPKKDAARVITFANRGDFISVRQHVYVKTREGVELAEVGPRFEMRLFELKLGTLENKDADVEWQLRRFVRTASRKDYL

SEQ ID NO: 24301 - protein, 341 aa, Zea mays
MHLKPMMPFCLREWRSTGGLQASLSNNPQLIHDSVPSPTTSGRKRQKTSQSVPALPAPPPAMHSQQLATPTQPSSSTARKAKFMHFQGQKVPGGSAAKPIPSSAGPSGRGPHMNRGGSAPEAQAQNVDPLIGRKVMSRWPEDNSFYEAVIYEYDAETGLHALVYDIDTADETWEWVDLKEMGPEDIRWQEDDSGIDPVTYLRSRGGPTSGVRKPAGRGGPMPGSVRGRGLQKNMPKKDFPPPQNGVGKRSSDDIDILHTESLIKEVGKVFSVSNPDPQEVEKAKKALKEQEQSLIDAIARLAEASDGESDGHNRGRRNLYAANQHQASYVGAMPVGDRAGA

SEQ ID NO: 24302 - protein, 743 aa, Photorhabdus luminescens subsp. laumondii TTO1
MCCWRVGHSYGIGGGIMTQAQHDAAPITTGTNQTASVFSFDVRPDKIGIITINVPGEKVNTLKAEFVDQFLNVFKQAQQSSGLKGLILISGKPDTFIAGADISMIAGCKTKEDARDLAEKGQKLFSQIANYPLPVVAAIHGACLGGGLELALACHWRVCSQDDKTRLGLPEVQLGLLPGSGGTQRLPRLIGVSSALDIMLTGKQLRAKQALRLGLVDDAVPLDILLDIAIEKVKKGIPVRKPLPWQQRLLVGPVGRYFLFNIVRKKTLAKTRGHYPAPERIIEVVKEGLEKGMSQGLRAEAVAFGELAMTRESAALRNLFFAATSLKNETGSSEKPAKIKHVGILGGGLMGGGIANVTATRGKLPVRIKDINEKGISQVLKYTWDLLSKRVKQKRLRPAERAQQMMLISGTTDYRGFAQTDIVVEAVFEDLSLKQKMVAEIETNAKPETIFASNTSSLPIHQIAEKAQRPEQVIGLHYFSPVDKMPLVEVIPHQGTSEKTIATAVSLAKKQGKTAIVVGDKAGFYVNRILVPYISEAAHCLVAGEPIDHIDGALVNFGFPVGPINLLDEVGIDVGTKIMPVLVEQLGPRFAAPESLDAVLKDGRKGRKNGRGFYLYAPGPRKFWQFGKRDKKVDSSVYTLLNITPESHMLSSEIAQRCVMLMLNEAVRCLDEGIIRSPRDGDIGAVFGIGFPPFFGGPFRYIDSLGCARVVEILRRLESQYGDRFVPCECLVNMAEQNKSFYP

SEQ ID NO: 24303 - protein, 117 aa, Oryza sativa
  misc_feature (25)..(25): Xaa can be any naturally occurring amino acid
  misc_feature (43)..(43): Xaa can be any naturally occurring amino acid
  misc_feature (65)..(65): Xaa can be any naturally occurring amino acid
  misc_feature (102)..(102): Xaa can be any naturally occurring amino acid
LSRRQPLWRKPSIVIIPGQGHHLTXDQTPKGERTCLMVFDSQXPCEPIDFAFCAHGWKAESLEGXTSFDIDCSEGEFADYDEKGECPCRFGQLRSEFRVVKXRTESRGKTKYVPRGV

SEQ ID NO: 24304 - protein, 365 aa, Chlamydophila caviae GPIC
MITEVRIPNVAESISEVTIASLLVTSESLVQENQGIMEIESDKVNQLIYAPTSGRIVWSVSEGDVVAVGGGVAKIYDANEAVPESAIENTSSSESVDAEIICFPRSKAHEPPAEGKTFVPLRDKIQNAPQPAGSKNEVREHMSSIRKTISRRLVSALHESAMLTTFNEIHMTPLMKLRKEKQESFSSRYNVKLGLMSFFIKAVIEGLKAYPRVNAYIEGDEIVYRQYYDISIAVGTERGLVVPVIRDCDKLSSGDIEVKLADLAGRARDGQISIPELEGGSFTITNGGVYGSLLSTPIINPPQVGILGMHKIEKRPVVLDNTIVIADMMYVAFSYDHRMIDGKEAVGFLIKIKDAIEQPETLLDL

SEQ ID NO: 24305 - protein, 1432 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLVFLRYLYRLQKFNCILQFYSQLDSKQININHRIYSIVSWAFLNLNRYEDAEKFINIHISKASIFPRTHMLDSLIHGFSITRDDPSKGLLILRDCLRNHGAFPSSLTFCSLIYRFVEKGEMDNAIEVLEMMTNKNVNYPFDNFVCSAVISGFCKIGKPELALGFFESAVDSGVLVPNLVTYTTLVSALCQLGKVDEVRDLVRRLEDEGFEFDCVFYSNWIHGYFKGGALVDALMQDREMVEKGMNRDVVSYSILIDGLSKEGNVEEALGLLGKMIKEGVEPNLITYTAIIRGLCKMGKLEEAFVLFNRILSVGIEVDEFLKGNLNRAFSMLGDMEQRGIQPSILTYNTVINGLCMAGRVSEADEVSKGVVGDVITYSTLLDSYIKVQNIDAVLEIRRRFLEAKIPMDLVMCNILLKAFLLMGAYGEADALYRAMPEMDLTPDTATYATMIKGYCKTGQIEEALEMFNELRKSSVSAAVCYNRIIDALCKKGMLDTATEVLIELWEKGLYLDIHTSRTLLHSIHANGGDKGILGLVYGLEQLNSDVCLGMLNDAILLLCKRGSFEAAIEVYMIMRRKGLTVTFPSTILKTLVDNLRSLDAYLLVVNAGETTLSSMDVIDYTIIINGLCKEGFLVKALNLCSFAKSRGVTLNTITYNSLINGLCQQGCLVEALRLFDSLENIGLVPSEVTYGILIDNLCKEGLFLDAEKLLDSMVSKGLVPNIIIYNSIVDGYCKLGQTEDAMRVVSRKMMGRVTPDAFTVSSMIKGYCKKGDMEEALSVFTEFKDKNISADFFGFLFLIKGFCTKGRMEEARGLLREMLVSESVVKLINRVDAELAESESIRGFLVELCEQGRVPQAIKILDEISSTIYPSGKNLGSYQRLQFLNDVNEEEIKKKDYVHDFHSLHSTVSSLCTSGKLEQANEFVMSVLSCMPR

SEQ ID NO: 24306 - protein, 176 aa, Triticum aestivum
  misc_feature (22)..(22): Xaa can be any naturally occurring amino acid
  misc_feature (45)..(45): Xaa can be any naturally occurring amino acid
MAPPVMASSATSVGPFQGVKSXTAALPVSRRSNGASLGSVSNGGXIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 24307 - protein, 220 aa, Opitutaceae bacterium TAV2
MKHHASLLAPSLLAGNHARLADSAQIVASHAIPWLHLDIMDGHFVPNLSFGPQTVADLRPTLPGLFFDTHLMLDEPHRYIEPFAKAGANLISIHIEPAYDHAATLRRIRELGCQNGIVLNPGTPADAIEPHLAHVDLVLVMTVQPGFGGQSFRRDMLPKIAQIDRWRAERGLRFRLEVDGGIDLATGAECAAVGTDTFVAGTAFFKAPDRAAFAATVAGW

SEQ ID NO: 24308 - protein, 364 aa, Mycobacterium tuberculosis CDC1551
MFTGRPFGATGQALGEAVFSTGMSGYQETLTDPSYHRQIVVATAPQIGNTGWNGEDSESRGERIWVAGYAVRDPSPRASNWRATGTLEDELIRQRIVGIAGIDTRAVVRHLRSRGSMKAGVFSDGALAEPADLIARVRAQQSMLGADLAGEVSTAEPYVVEPDGPPGVSRFTVAALDLGIKTNTPRNFARRGIRCHVLPASTTFEQIAELNPHGVFLSNGPGDPATADHVVALTREVLGAGIPLFGICFGNQILGRALGLSTYKMVFGHRGINIPVVDHATGRVAVTAQNHGFALQGEAGQSFATPFGPAVVSHTCANDGVVEGVKLVDGRAFSVQYHPEAAAGPHDAEYLFDQFVELMAGEGR

SEQ ID NO: 24309 - protein, 245 aa, Opitutaceae bacterium TAV2
MPDPAAVKTMFGRIARRYDLANRLLSGGSDVWWRWRLVRRVRRAAPADVLDLATGSGDVAFALAQALPPATRITGMDFCLPMLDEATAKQRAFTARAPVSSTTPDSPVARIEFRQGDGMDLPLDDECMDAVTISFGLRNMASRLQALREMHRVLRPGGRVHVLEFSQPWRWFRPVYFFYLKHLLPRIARIVTGDKSAYDYLCGSIETYPTHTAMSNELRMAGFKDIEVLRMTFGIVALHTGRRGE

SEQ ID NO: 24310 - protein, 491 aa, Burkholderia xenovorans LB400
MKRYQLFIDNEWVDPHSGAWFETDDPFTGEPWAEIPRADPTDADRAVRAAEKALEGPWSTLSASERGMLMYKLGALIERDAEHLATIESRDNGKLFRDVLGQMKYMAKYYYYFGGLADKIQGAVVPIDKPGIFNFIRYEPMGVVLSITPWNSSLPLTTWKMAPALCAGNTIVCKPSEFTSASLFELAKLFVEAGFPRGVFNVVTGFGPEIGASLVSHPGVARIAFTGGDEAGRKIYAAAAQHLKRVSLELGGKSPNIVFDDADLDQAVNGVISGIFSATGQTCVAGSRVLLQESIHDAFVERVAKLTRAAKVGNPLDPASEIGPITTKPQFEKILGYIDIATREGARCVAGGRALSGPGYGAGRFVEPTVFVDVTNDMRIAQEEVFGPVLSIIRFKDEEDAIRIGNDIKFGLAAGVWTNSLHRAMLMSQRLKAGTVWINNYRSSSFTTPFGGFKQSGIGREGGIESVKEFMEAKSVWMSSDLKMPALFAGK

SEQ ID NO: 24311 - protein, 665 aa, Populus trichocarpa x Populus deltoides
MKLGRNKVTSLDRYISSWKSADDPSRGNYTFRLDPAAYSELIMIEDSNEKFRSGPWNGMRFSGTPQLKPNPIYTYRFFYDGDEEYYTYKLVNSSFLSRMVINQNGAIQRFTWIDRTQSWELYLSVQTDNCDRYALCGAYATCSINNSPVCSCLVGFSPNVSKDWDTMDWTSGCVRKTPLNCSEDGFRKFSGVKLPETRKSWFNRTMSLDECRSTCLKNCSCTAYTNLDISINGGSGCLLWLGDLVDMRQINENGQDIYIRMAASELEKAGSAEAKSKEKKRTWSIIISVLSIAVVFSLALILLVRRKKMLKNRKKKDILEPSPNNQGEEEDLKLPLFDLSTMSRATNDFSLANILGEGGFGTVYQGKLNDGQEIAVKRLSKTSKQGLDEFKNEVLHIVKLQHRNLVKLLGCCIEGDETMLIYEMMPNKSLDFFIFDKTRDKVLDWPQRFHIINGIARGLLYLHQDSRLRIIHRDLKASNILLDHEMNPKISDFGLARSVGGNETEANTNKVVGTYGYIAPEYAIDGLYSVKSDVFSFGVMVLEIVSGKRNKGFCHPDHKQNLLGHAWRLFIEGRSSELIVESIVESCNFYEVLRSIHIGLLCVQRSPRDRPSMSTVVMMLGSESELPQPKEPGFFTTRDVGKATSSSTQSKVSVNEITMTQLEAR

SEQ ID NO: 24312 - protein, 587 aa, Yersinia pseudotuberculosis IP 32953
MSACHTRLHLLFCHSAEISCKTGGDTLAILWHNARRITFFILLEYPYSVIKSRASSVLSTNNITMQFGSKPLFENISVKFGGGNRYGLIGANGCGKSTFMKILGGDLVPSGGNVFLDPNERLGKLRQDQFAFENNTVLDTVIMGHGELWEVKEERDRIYAMAEMSEEDGYKVADLEVAYGEMDGYSAEARAGELLLGVGIPVEQHYGLMSEIAPGWKLRVLLAQALFSDPEILLLDEPTNNLDIDTIRWLEQVLNERNSTMIIISHDRHFLNMVCTHMADLDYGELRVYPGNYDEYMTAATQARERLLSDNAKKKAQISELQSFVSRFSANASKSKQATSRARQIDKIQLDEVKASSRQNPFIRFDQDRKLFRNALEVEMLTKGFDNGPLFKNLTLRLEVGEKVAILGPNGIGKSTLLKTLLGEYESDAGTVKWSENSKIGYYAQDHASDFDIDLTVFDWMSQWKQEKDDEQAVRSVLGRLLFSQDDIKKKVSVLSGGEKGRMLFGKLMMQRPNILVMDEPTNHLDMESIESLNMALEMYEGTLIFVSHDREFVSSLATRVIEMTPNKLIDFTGNYEDYLSSQGIQS

SEQ ID NO: 24313 - protein, 293 aa, Candida albicans SC5314
MFDWRRLKPLRPHQIFFFYTTIQNYSDNGYQYSYKSNQIKSNQIKLNQQQQTSRQLIRINNQLPPSVVLHNIIMKSILITTGATITFESLIQIIVSPQFLNNLIRLKINKLIIQYGHEIKNSINLSESFFNETINKYDLINLFNLEIEETPIGDDDDDEGIRLFKNSDIEILAFSYSSNINKYIENVDLIISHAGTGSIIDCLHLNKPLIVIVNDKLMDNHQLEIAQQFTKLNYCIYYSIKELEQYVNNNDNNKDSRFWNQLNQLINGELQLNKLPQTDGSIIETIICEELEK

SEQ ID NO: 24314 - protein, 486 aa, Bordetella parapertussis 12822
MEDLRNHEFKNYIGGQWVACAAGKTYPNVNPADTDDIVGRFQASQAEDAAAAVAAAQAAFDGWRNLAVSKRAALMQRAADYLEAHAEQFGRELTREEGKALNLAKDEVLRSAQTIRFYAAEGQSFSGETFVNDDPDMVVYSQREPLGVVTVISPWNFPVSIPARKIAPALITGNTVVFKPSSDAPLSGLRLVEAFEQAGLPPGVLNLVTGSASAIGAAITQAPQVRAVSFTGSTAAGEQIHRSVDMTTRTQMELGGKNPLIVMADADLDRAVDLVVKGGFSLSGQACTGTSRVLVDAPVKAAFTEKLLAKVKALKVGNSLEGSFDLGPLATARQLESVMRYIEVGKQEARLLYGGERLDGPGYERGYYLTPAVFADVTQQMRIAREEIFGPVIALIEVNGYEDAIAKANDTEYGLAAAIATTNAQYAHRFARDIQAGTVKINRTTTGNLINAPFGGLKRSSTSTFRESGRIGLEFYTQIKTVYRAG

SEQ ID NO: 24315 - protein, 97 aa, Glycine max
FGYSRDNVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 24316 - protein, 298 aa, Candida glabrata CBS 138
MSSELANYKRLEKVGEGTYGVVYKALDLRPGKGQRVVALKKIRLESEDEGVPSTAIREISLLKELKDDNIVRLYDIVHSDAHKLYLVLEFLDLDLKRYMESIPKDQPLGVNIIKKFMVQLCKGIAYCHAHRILHRDLKPQNLLIDKEGNLKLGDFGLARAFGVPLRAYTHEIVTLWYRAPEVLLGGKQYSTGVDTWSIGCIFAEMCNRKPIFSGDSEIDQIFKIFRILGTPSEAVWPDIVYLPDFKPSFPQWRRKDLAEVVPSLDPHGIDLLDKLLAYDPINRISARRAANHPYFHEQ

SEQ ID NO: 24317 - protein, 426 aa, Synechococcus sp. CC9311
MAISPSPVPSESATSGFDSLGLSQPLLKALQEKGYTAPSPIQLQAIPAVISGRDVMAAAQTGTGKTAGFTLPMLERLNHGARPGRLQIRALVLTPTRELAAQVLASVREYSKYLQLTSDVVFGGVKINPQIQRLQKGVDVLVATPGRLLDLLQQGAVRFDRVEFLVLDEADRMLDMGFIHDIRRVISRLPDRRQTLMFSATFSAPIRKLATGLLDHPVQIQVAPANQTVRSVEQVVHPCDMARKVDLLSHLIRSGEWLQVLVFSRTKHGANRVVDRLSQQGLLAAAIHGNKSQGARTRALQGFKDGSVRVLVATDIAARGIDIQQLPHVVNLDLPNVAEDYVHRIGRTGRAGETGHAISLVAAEEALLLKAIERLTGESLRRENVPGFEPTVLSAPPLDLSGGRGRRSGGSSRSRKDTRSTRTYRR

SEQ ID NO: 24318 - protein, 604 aa, Oryza sativa Japonica Group
MDDDDYSWVRRTKFSHSIVKSNSGREQFGAFLDPFDSSTAWRQKGFSGELMIHGHNLQPRAKGAVSKSPRPSIPLAKSPVSQAERKLKAKFSDGELKQRGKISDGSLREASKEKDRKVGHKGEGLSLDISCPILDRTVQDDSSDTLDFSFHSEEQSLRLLRVCSSPAPFYSKDTTTFGDSKIHSTSVKIVGEGSKPRRRAKSPMPTRVISEVFKEAKAATKRFSSPQRQRKSSSPHSPRSPDDSPRFGFPSMRTPGNLKARRASSWPRNYDNGVAKAVALDILERWTIDRSQLLIGQRFASGAYSRLFHGIYKEQPVAVKFIRQPDEEEDAELAAKLEKQFTAEVTILARLHHRNVIKLIGACNAPPVFCVITEFLCGGSLRAFLRKLQRQKLPLEKIICIALDIAHGLEYIHSQRVIHRDVKPENILFDGECCAKVVDFGVACEEVYCNSLEDDPGTYRWMAPEMYKRKPYGRKVDVYSFGLVLWELFSGSIPYEEMTPLQAAFAVVNKNLRPVVPSSCPAQLRLLIEQCWSCQPEKRPEFSQVVQILKNLKEALDRDGTLDKIPSTNCQEPPDQNKKRLSNWIQRLSYSQADFSGPPPPKLL

SEQ ID NO: 24319 - protein, 497 aa, Erythrobacter sp. SD-21
MRQVDHFIVGNSPAPTRKHKIWNPSTGEVQAEVALGGAELLQQAVDAAKKVQPEWAATNPQRRARVMFKFKELVEAHKQELAELLSSEHGKVVEDAHGDVQRGLEVIEFACGIPQALKGEYTQGAGPGIDVYSMRQPLGIGAGITPFNFPAMIPMWMFGMSIAAGNAFILKPSERDPSVPVRLAELFLEAGAPEGLLQVVHGDKEMVDAILDHPDIPAISFVGSSDIAQYIYSRGTANAKRVQAFGGAKNHGIVMPDADLDQVVNDLAGAAFGSAGERCMALPVVVPVGEDTANRLRDKLIPAINALRVGVSNDPDAHYGPVVTPEHKARVEGWIDTAENEGAEVVIDGRGFTLQGHEDGFFVGPTLLDRVTADMESYKEEIFGPVLQIVRAKDFEEAVRLPSEHQYGNGVAIFTRNGHAAREFASRVNVGMVGINVPIPVPVSYHSFGGWKRSGFGDIDQYGMEGLKFWTKAKKVTQRWPDGGGDGSNAFVIPTMG

SEQ ID NO: 24320 - protein, 424 aa, Zea mays
MASLFGNGGYIYSSGSEGEDEDEGTEGYRKGGYHAARPGDRFAGGRFVAQRKIGWGNFSTVWLAYDTLHSRFVALKIQKSARDYAHAALHEIELLSAVAKGDPTNSKCVLRLLDHFKHAGPNGQHVCLVTEFLGDSLLRLIRYNRNKGIGLSRVKEICRSVMVGLDYLHSELGIIHTDLKPENVLLESTINPAKDPVRSGFTPILDRPVGNQYGGTVISFSEKMLKMRARRAVAKISQRRVSLGGVGAELEKERCLDGISLKCKIVDFGNACWADQQHAGEIQTRQYRAPEVIIGSGYSYSADIWSFACIAFELATGDLLFAPMNRQGCSEDEDHLALMMETLGKMPRKIASSGTRSKDYFDRYGDLKRVRRLKFWPLDRVLVERYSFSEPDAKGFADFLRPMLDFAPEDRPSAAQCLKHSWLN

SEQ ID NO: 24321 - protein, 416 aa, Arabidopsis thaliana
MANISEISGDSNDGGDPNKKPEEQVLRRSRRIATRNENQNKKPKEEEEKDNRSVSFPIPNELTEACVALIRKCDYPSLSSVSSYFFNLIASSELYETRSRLGLSETFLYAAIRFPDTNPPNWYILHRNKVSSLRLSKLESLPPVPYGCSVVTIGQEMYVIGGLLDVRRLQLMTLIDCRTHKCRSLPKMKRGRYHAAAGVFDGKIYVIGGFRMRKPDAEWIEVFDLKKQIWESLPGPYPKTSMDSQFFAHAVMEDKLYILGSRCLIYEPKRNGEWDATVNANPIWNLWKVPCTMQCVIDDMLYTIDPQCTLGHPIVVYNPKDKTWRPVKGESLRTLPSYFVSDGSEMANFGGKLVILGSNGSCYDTGDCIGEKGIWCVMIELEKREGGLFFSLKAYILVLFHDLVADEGSLLLKSQE

SEQ ID NO: 24322 - protein, 495 aa, Thermus thermophilus
MPLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGPKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 24323 - protein, 481 aa, Chlamydophila caviae GPIC
MTEQADIGLIGLAVMGKNLVLNMIDHGFSISVYNRSPEKTREFLQEHSQNTLLQGHENLEDFVRSLKRPRKVMLMIKAGAPVDQSIESLLPYLEPGDIIIDGGNSYYKDSERRCRDLKEKGILFVGMGISGGEEGARKGPSIMPGGNSEAWPAIAPIFQGISAKVHGNPCCCWVGSGGAGHYVKTVHNGIEYGDIQLICEAYGLLRTRLGISPEGISEIFAEWNSRELESYLMRISVEVLSLKGPDGSPVIDTILDVAGQKGTGRWTAIDAIDSGVPLSLIIESVLARFLSSWKTVREQAASELPGIPIVFEKPRDPHLFIEDVFQALYASKIISYAQGFMLLKQASEEHQWNLNFGELALLWRGGCIIQSAFLDAIHKGFENEPEAPSLILQTYFKSTLQNSESGWRRTVAYAVGSGYPVPCLAAALTFYDGYRTKDSSIALAQGLRDYFGAHSYERKDRPRGEFYHTDWIGTKTTTAVK

SEQ ID NO: 24324 - protein, 497 aa, Gossypium hirsutum
MTQQAILLSLRFRPRRKLNFPPGPKPWPVIGNLDLIGSLPHRSIHALSQKYGPLMQLKFGSFPVVVASSVEMAKAFLKTHDVIFAGRPKIAAGEYTTYNYSDITWSPYGPYWRQARKMCMTELFSAKRLESYEYIRREEMKLLLKGLYESSGVPIVLKDRLSDLSLNVISRMVFGKKYTEGTGENEIVTPKEFKEMLDELFLLNGVLDIGDSIPWLRFLDLQGNIKRMKALSKKFDKFLEHVLDEHNARRRDVKDYAAKDMVDVLLQLADDPNLDVKLERHGVKAFSQDLIAGGTESSAVTVEWAISEMLKKPEIFAKATGELDRVIGRERWVEERDTVNLPYIDSIAKETMRLHPVAPMLVPRMTREDCQVDGYDILKGTRALVNVWTIGRDPTVWDNPNEFCPERFIDKTIDVKGHDFQLLPFGAGRRMCPGYPLGIKVIQASLANLLHGFTWKLPGNMTKENLDMEEIFGLSTPKKCPLQAVAVPKLPLHLYSH

SEQ ID NO: 24325 - protein, 538 aa, Lophopyrum elongatum
MGYQVVAAQLARLSGALGTPDHASVVSINLFVALLCACIVLGHLLEENRWLNESITALIIGLCTGVVILMTAKGKSSHVLVFSEDLFFIYLLPPIIFNAGFQVKKKQFFRNFMTITLFGAVGTMMSFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRGAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 24326 - protein, 435 aa, Bacillus cereus ATCC 10987
MGVITLTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLTFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNMDVAIIKNA

SEQ ID NO: 24327 - protein, 449 aa, Francisella tularensis subsp. holarctica
MNAQKYIDSVIAQVEKRDGHEKEFIQAVKEVFSTLKPALEHNPKYIEENILARMVEPERGISFRVPWVDKDGNIQVNRGYRYQFNGAIGPFKGGIRFHPSVYSGIIKFLGFEQVFKNSLTTLPMGGGKGGADFDPKGKTDAEIMNFCQSFMMELQRHIGPDIDVPAGDIGVGGKEIGYMYGQYRRIRACFENGVLTGKSLESGGSLIRPEATGYGAVFFLDEMLKHDGETLQGKTVVTSGYGNVAWGVCKKVAQLGGKVVTISGSKGFVHDPEGITTDEKIEFLLKIRNGEKTMQDYAKEFNASWHAGQKPWGIKADIAIPAATQNEIDFEDAQKLIDSGVKYVVEASNMPTTNEAIEFLMKKGIILAPGKAANAGGVAVSGLEMSQNSARLSWSAEEVESKLQQIMANIFHACKFASSKYNLGYNLVAGANLAGFEKVAEAMIQQGRY

SEQ ID NO: 24328 - protein, 533 aa, Chlamydophila caviae GPIC
MTQTAEKPFGKLRSFLWPIHMHELKKVLPMFLMFFCIAFNYTVLRDTKDTLIVTAPGSGAEAIPFIKLWLVVPCAVVFMLIYAKLSNILSKPALFYTVITPFLLFFALFPTVIYPFRHILHPTDFADKLQTILPQGLMGCVAMLRNWTFAAFYVLSELWGSVMLSLMFWGFANEITKISEAKRFYALFGVGANIALLASGRSIIWASKLRASATGNTDPWGLSLYLLMSMVILSGGVIILCYWWMNKCVLTDPRFYDPKELNKSKKSKPKMSMKESFAYLARSPYMLLLALLVICYGVCINLVEVTWKSQLKMQYPNANEYSQFMGNFSFWTGVVSVIVMLFVGGNVIRKFGWLTGALVTPVMVLLTGVLFFALVIFRDQASGIVATLGTTPLMLAVMVGAIQNILSKSTKYALFDATKEMAYIPLDQEQKVKGKAAIDVVAARFGKSGGSLIQQSLLVVCGSIGAMTPYLAIALFLIIAVWLVSATKLNKLFLIQSAIKEQELAGEEAAAASEVASSSTTIQGTPAVENASS

SEQ ID NO: 24329 - protein, 309 aa, Cryptococcus neoformans var. neoformans JEC21
MSAPTSFKLNNGVEIPAVGLGTWQAPPGQVQAAVAHALKNGYRHLDCALIYQNEAEVGDGIKESGVPRSEIFITSKVWNTHQPNVADGLRQTLEALQTDYLDLYLIHWPVRLVPNESSGLLPVNPDGSRSVDRDWDQSETWRQMEEVYASGKVKAIGVANWSIPYLEELKKTWKIVPAVNQVELHPFLPQHKLVKYCRDLGILLEAYSPLGSTNAPLLSDPEINAIAEKYKTSPATICISYQVNRGIVVLPKSVSPKRIEDNLKTIPIEKEDMVKLDGMAAAGKAQRINTPKWGWDLGFDDWYGPVKQQ

SEQ ID NO: 24330 - protein, 451 aa, Aspergillus oryzae
MAKARTKKRTHVRAQNASAAAVKGSASSMSKTPKSMVIRIGGSQVGSSVSQLVKDVRLMMEPDTAVRLKERKSNRLRDYTVMAGPLGVTHLMLFSKSATGNTNMRLALTPRGPTLHFKVENYSLCRDVEKALKRPRGGGQDHKTPPLLVMNNFNSPNATEDGKVPKRLETLTTTIFQSLFPPINPQATPLSSIRRVMLLNRELKSDGQEDDSYVLNLRHYAITTRKTGVSKRIRRLDPKEIRNREKRGVAVPNLGKLEDAADYLLDPSAAGYTSASETELDTDNEVEIAESTTKRVLNKRELQRMKAGEKEKAEKKLRAAPEVEKRAVKLVELGPRLKLRLIKVEEGLCDGKVMWHDYIHKSEEDMKKLDKNWEKRKKEKEERKRQQKENIEKKKAEKAKARAEGKEIEDDDDEEMDVDDDEDDWLSDDFGEEEEGAEQQGGEGDDESMEE

SEQ ID NO: 24331 - protein, 585 aa, Bacillus cereus ATCC 10987
MRKTKIVCTIGPASESIEKLEQLIEAGMNVARLNFSHGSHEEHGARIKNIREASKKTGKTVGILLDTKGPEIRTHDFVDGQAELVTGAEVVISTEQVLGTAEKFSVSYAGLYDDVNPGSRILIDDGLIELEVIEKADGNIRTKVLNSGTVKNKKGVNVPNVSIKLPGITEKDVKDIIFGIEQKVDFIAASFVRKAADVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEVAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 24332 - protein, 461 aa, Mycobacterium tuberculosis CDC1551
MATATTQRPLKGPAKRMSTWTMTREAITIGFDAGDGFLGRLRGSDITRFRCAGRRFVSISHPDYVDHVLHEARLKYVKSDEYGPIRATAGLNLLTDEGDSWARHRGALNSTFARRHLRGLVGLMIDPIADVTAALVPGAQFDMHQSMVETTLRVVANALFSQDFGPLVQSMHDLATRGLRRAEKLERLGLWGLMPRTVYDTLIWCIYSGVHLPPPLREMQEITLTLDRAINSVIDRRLAEPTNSADLLNVLLSADGGIWPRQRVRDEALTFMLAGHETTANAMSWFWYLMALNPQARDHMLTELDDVLGMRRPTADDLGKLAWTTACLQESQRYFSSVWIIAREAVDDDIIDGHRIRRGTTVVIPIHHIHHDPRWWPDPDRFDPGRFLRCPTDRPRCAYLPFGGGRRICIGQSFALMEMVLMAAIMSQHFTFDLAPGYHVELEATLTLRPKHGVHVIGRRR

SEQ ID NO: 24333 - protein, 472 aa, Francisella tularensis subsp. holarctica
MIKADICIIGGGSGGLSVAAGAVQMGAKVVLCEGNKMGGDCLNYGCVPSKAIIEASRVIAKVNKAQAFGINIDNNNIEIDYKKVQEHIKITIAKIEPHDSVERFETLGVNVIQEYAQIIDQYTVKAGDNFIKARYIVIATGSRAAIPKIKGLAEVNYLTNETIFDLKEKPEHLMIVGGGPIGVELAQAYALLGSKVTIFEASDTILGVLDNDCRKIILKEFDRLGISIITNVNISEIAQDDQEINLYCGSKLYQGSHLLIAAGRVPNLDKLDLDNVGIKYTSRGIKVDSRLRTNHKNIYAIGDVVGGYQFTHVAGYHAGVVIQNILFKLPIKVDYNSLPWSLYTSPEVAHVGQNIAQTQTHGAKILKLSYQNNDRAVASLATNGLIKVAINKKGYILGATIVGENASELIVQWTIAIKNKLKIKNMASHIVAYPTLSELNKRLAGNYFIPVLYSNKVRSLVRFLIKIFVKKL

SEQ ID NO: 24334 - protein, 320 aa, Mycobacterium tuberculosis CDC1551
  misc_feature (61)..(61): Xaa can be any naturally occurring amino acid
MPSLDNTADEKPAIDPILLKVLDAVPFRLSIDDGIEAVRQRLRDLPRQPVHPELRVVDLAXDGPAGPIGTRIYWPPTCPDQAEAPVVLYFHGGGFVMGDLDTHDGTCRQHAVGADAIVVSVDYRLAPEHPYPAAIEDAWAATRWVAEHGRQVGADLGRIAVAGDSAGGTIAAVIAQRARDMGGPPIVFQLLWYPSTLWDQSLPSLAENADAPILDVKAIAAFSRWYAGEIDLHNPPAPMAPGRAENLADLPPAYIAVAGYDPLRDDGIRYGELLAAAGVPVEVHNAQTLVHGYVGYAGVVPAATEATNRGLVALRVVLHG

SEQ ID NO: 24335 - protein, 465 aa, Oryza sativa Japonica Group
MNSLQSFLALNPPAAAAALGGARLRPSRVTACLATPTPTPPPPTSAPLAPAAAAARRELSAASRAVVEDEARYIVGTYNRSRVVLVAGRGCKLYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 24336 - protein, 423 aa, Idiomarina baltica OS145
MTISILGINHRTAPVELRERVAFGPVQLEQALTELKQLPGIEEAIIVSTCNRTELYCHGHAEHQPMLHWLSQFHGITPSELEQHHYYHIQEDAVAHLMSVASGLDSLVLGEPQILGQVKQAYQQAKHFNVVGGILERLFQNTFRVAKAVRNETEVGQNAVSVAFAAVSLAKHIFGDLKHSNVLLVGAGDTSELVAQHLVQQGVSSLNVANRTLQRATELAQRVGAEAHSLSQLGELLPNADIVVSSTASTLPIIGKGRVEKALKQRRHKPILLIDLAVPRDIEEQVNELDDAYLYTVDDLQNIISENIKNREQAAQQARKIIAREANQFLDWLRSLDSVTLIRDYRQHTQKVAQLQLEKALAMLQQGKPAEQVMQVLSHKLTQQLAHRPTQLLKQAGEQGDQTTLSVLQRLWLEDDNQNKETN

SEQ ID NO: 24337 - protein, 546 aa, Streptococcus agalactiae 2603V/R
MNKFKVNISGMTCTGCEKHVESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLGAVPRAIVNRETTGVFKLVADAETLKVLGVHIVSENAGDVIYAASLAVKFGLTIEDLTETLAPYLTMAEGLKLVALTFDKDISKLSCCAG

SEQ ID NO: 24338 - protein, 122 aa, Lactobacillus plantarum WCFS1
MGMIRINNLRFHTFNGVLPEERRNGQQLGLDIAIKYPIETKVQHDDVHETINYAAVRNVVDEFVTTHSYKLIESLANHLLQTLLTSFPAADAINIKIRKYSVPMPGIFDDVEIEVEGTPNGK

SEQ ID NO: 24339 - protein, 618 aa, Candida albicans SC5314
MSKKYSEENTSSIPLTDLTSPSTGETSSQQQRQRASQQQPPQQPESNTATGSRWSNFVDSFKPAIENEKLAMRYRDANADVEEDAGGYYNSTDQLTEIQRININSSKSNLKRKLKNRHLQMIAIASSIGSGLLIGTGGALATGGPGGILIAWILSGISILCTIQAMAELAVTFPVSGGFNVLFSRFIDPSVGFSVAWNYVLQYLVLLPLELVAASMTIQYWNTDINPDVWVIIFYVTVTSINFFGVRLYGEVEFILSSLKVIAVVGFIILSIVLAAGGAPNGVHHGTKYWHDPGAFANGFKGVSSTFITAAFSFAGTELTGLTSAEAENPRKALPKACKQVFWRILLFYVVSIILITFLVPYDNPRLLGASDVSASPFVIAIQDGGISGLASVMNSVILISVISVGSSSVYATSRTLVSLAEQNLAPKICGYVDRAGRPLVAILITNVFGLLSFIAASGKEDEVFTWLLSISGLSSIFTWLCICISHIRFRRALHVQGRNTDELTFVSQTGVIGSWFGILLNVLVLVAEFWLAIFPLGEKSNAKSFFETYLGFVILIIFYFGHKLWRNNWILFIRSRDIDIDSGRRETDLEALKRELQEEREVLRNKPFWYRAYHFWC

SEQ ID NO: 24340 - protein, 286 aa, Magnaporthe grisea 70-15
MSSDIPDQPPSRSLRGRVAIVTGAGCAGSGIGNGRAISILLADDGCNVVCLDMNLDWANKTVDMVNAKPGRGTAIAMQGDVTKQADCDAAVQLALDKFGRLDVLVNNVGVGGAPGTAVEVDLEKFAQSLEVNVSSMVRMAKAAIPAMVRDKDGVEIKGSIVNMGSVAGMLGGTPHLLYPTSKGAVVNMTRAMAAHHAKDGIRVNCVCPGMLYTPMMYAGGMSEEVREARKGRSLLGTEGSGWDAACAVVFLASDHSRWITGAILPVDAGTTAATSITLPKGASVNG

SEQ ID NO: 24341 - protein, 176 aa, Gossypium hirsutum
APSIHERAYRDAPGGFPKLGSVFTLNLFNKKITFLIGPEVSSHFFKASESDLSQQEVYQFNVPTFGPGVVFDVDYTIRQEQFRFFTEALRVNKLKGYVDQMVTEAEDYFSKWGDSGEVDLKYELEHLIILTASRCLLGQEVRNKLLDDVSALFHDLDNGMLPISVIFPYLPIPAHR

SEQ ID NO: 24342 - protein, 193 aa, Roseovarius nubinhibens ISM
MAREDNRRDRRDRDETPEFADRLVAINRVSKTVKGGKRFGFAALVVVGDQKGRVGFGKGKAKEVPEAIRKATEQAKRQMIRVPLREGRTLHHDVKGRHGAGKVVMRTAPQGTGIIAGGPMRAVFEMLGVQDVVAKSIGSQNPYNMIRATLNGLTQESSPRMVAQRRGKKVADILRKEDAPKVSGEQAPVVEEA

SEQ ID NO: 24343 - protein, 339 aa, Oryza sativa
MAAALMRRAARAPPAACGLRRFMQEQTAFRPAAVPVVPPERRGFIPLADRIRDLGAAFPRINLDGLVPPAPPQTHPTVAREERASASAVAGLTVEEARKVLRATQMEAARARLRASGAGTVPYAEFLRLCCDAAGAESGASVARALDESGSVIVLGKTVFPKFGDFYSVVKAIEKAIPIPRAQPIALDGPAREELKAMEAQKVEIDRTAALQVRRELWLGLAYLVVQTAGFMRLTFWELSWDVMEPICFYVTSMYFMAGYTFFLRTKKEPSFEGFFESRFAAKQKRLMHARDFDLRRYDELRRACGLPVVRTPTSPCRPSSSSSSSTQESHCHSYCHCQ

SEQ ID NO: 24344 - protein, 516 aa, Erythrobacter sp. SD-21
MSWERELEERQKREEFAEQMGGPEKLARQHSRGKMNARARLAALVDEGSFREIGKIAGKGHYDENGNLAGVTPAPFLFGKAKINGRPVVATADDFTIRGGAADAGISRKMVQAEKMAHELKLPIIRMIDGTGGGGSVKTLEQIGATYIPAVPGWSDVVKNLDTVPVVALALGPTAGLGAARTVASHYSTMVKGLSQIFAAGPAVVDGLGESYKGSDDHSQAKEDLGGSGIHTRNGVVDDEVSSEAEAFARARHFLSFMPEHVGQIARRADCSDPVDRREEGLLSLVPREDKQVYSMRRAMEMVFDKGTVFEIGRMWGRACITALARLDGWPVMVLASDPSYLGGSWEAKTSEKVERFVKLADQFRLPIVHLVDNPGFMIGREAEMAGTIRYGVQAMNAIYRASVPLASIVLRRAYGIAGSAMSNAETYQYRYCWPSGDWGSLPIAGGLEVAYKSELEAADDPAAELAAIRERLDRVTSPFRSAERFNVEDIIDPRDTRPLLCEFAQLAWRRLEIEA

SEQ ID NO: 24345 - protein, 379 aa, Escherichia coli
  misc_feature (268)..(268): Xaa can be any naturally occurring amino acid
IKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPQAKKEDELPFHVVAYDFGAKRNILRMLVDRGCRLTIVPAQTSAEDVLKMNPDGIFLSNGPGDPAPCDYAITAIQKFLETDIPVFGIXLGHQLLALASGAKTVKMKFGHHGGNHPVKDVEKNVVMITAQNHGFAVDEATLPANLRVTHKSLFDGTLQGIHRTDKPAFSFQGNPEASPGPHDAAPLFDHFIELIEQYRKT

SEQ ID NO: 24346 - protein, 164 aa, Saccharomyces cerevisiae
KIEFRVVNNDNTKENMMVLTGLKNIFQKQLPKMPKEYIARLVYDRSHLSMAVIRKPLTVVGGITYRPFDKREFAEIVFCAISSTEQVRGYGAHLMNHLKDYVRNTSNIKYFLTYADNYAIGYFKKQGFTKEITLDKSIWMGYIKDYEGGTLMQCSMLPRIRYLD

SEQ ID NO: 24347 - protein, 183 aa, Triticum aestivum
MSSPSKRREMDLMKLMMSDYKVEMVNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEYCEKYAKPEDAGITPEDKSSDEELSEEEDDSGDEAILGNPDP

SEQ ID NO: 24348 - protein, 412 aa, Bacillus cereus ATCC 10987
MSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 24349 - protein, 193 aa, Arabidopsis thaliana
MEGKEEDVRVGANKFPERQPIGTSAQSDKDYKEPPPAPFFEPGELSSWSFWRAGIAEIIGTFVLVYTVFSATDAKRNARDSHVPILAPLPIGFAVFLVHLATIPITGTGINPARSLGAAIIYNKDHSWDDHWVFWGWPPFIWSLHFACSFYPIVGLSIPEAQSPLQSPRKAKVKNKNIQFPLVFWPLSLGCFL

SEQ ID NO: 24350 - protein, 229 aa, Mycobacterium tuberculosis CDC1551
MAGSTGGPLIAPSILAADFARLADEAAAVNGADWLHVDVMDGHFVPNLTIGLPVVESLLAVTDIPMDCHLMIDNPDRWAPPYAEAGAYNVTFHAEATDNPVGVARDIRAAGAKAGISVKPGTPLEPYLDILPHFDTLLVMSVEPGFGGQRFIPEVLSKVRAVRKMVDAGELTILVEIDGGINDDTIEQAAEAGVDCFVAGSAVYGADDPAAAVAALRRQAGAASLHLSL

SEQ ID NO: 24351 - protein, 167 aa, Oryza sativa Indica Group
MAAKVYKPAAEVNLGPDSDEFYISPNVKGMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 24352 - protein, 522 aa, Streptococcus agalactiae 2603V/R
MNLQKNDKTNSFIHYANGPSLEEINGTIEVPKDLSFFKTLLAYSGPGALVAVGYMDPGNWSTSITGGQNFQYLLISIILMSSLIAMLLQYMSAKLGIVTQMDLAQAIRARTSKQLGIVLWILTELAIMATDIAEVIGGAIALYLLFHIPLAIAVFITVFDVLLLLLLTKIGFRKIEALVVALILVIFLVFAYQVALSHPIWTDIFKGLVPTSEAFSTSHTVNGQTPLSGALGIIGATVMPHNLYLHSSVVQSRKLDHNNKKDIARAIRFSTFDSNIQLTVAFFVNSLLLIMGVAVFKTGSVTDPSFFGLFKALSNSTIMSNSILAHIASSGILSLLFAIALLASGQNSTITGTLTGQIIMEGFIHMKVPIWFRRIITRLISVIPVMICVLVTSGRSTVEEHIAINNLMNNSQVFLAFALPFSMLPLLIFTNSKVEMDDDFKNTWIIKILGWLSVIGLIYLNMKGLPNQIEGFWGDNPTHQQIILAHQIAHIIIISVILTLIWTIVELYKGNKKYSTMQQSAT

SEQ ID NO: 24353 - protein, 363 aa, Pseudomonas syringae pv. phaseolicola 1448A
MALNTIEELVEDIRQGKMVILMDDEDRENEGDLIMAAECVQPEHINFMARFARGLICMPMTRERCETLKLPLMAPRNGSGFGTKFTVSIEAAEGVTTGISAADRARTVQAAAAKEAKAEDIVSPGHIFPLMAQAGGTLARAGHTEAACDLARMAGFEPTGLICEVMNDDGTMSRRAELEEFARQHDIKIGTIADLIHYRMIHERTVQRIAEQPMDSELGSFNLVTYRDSVEGDVHLALTLGKICAEEPTLVRVHNMDPLRDLLMVKQPGRWSLRAAMRAVSEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 24354 - protein, 761 aa, Arabidopsis thaliana
MSNDKDSMNMSDLSTALNEEDRAGLVNALKNKLQNLAGQHSDVLENLTPPVRKRVEFLREIQNQYDEMEAKFFEERAALEAKYQKLYQPLYTKRYEIVNGVVEVEGAAEEVKSEQGEDKSAEEKGVPDFWLIALKNNEITAEEITERDEGALKYLKDIKWSRVEEPKGFKLEFFFDQNPYFKNTVLTKTYHMIDEDEPILEKALGTEIEWYPGKCLTQKILKKKPKKGSKNTKPITKTEDCESFFNFFSPPQVPDDDEDLDDDMADELQGQMEHDYDIGSTIKEKIISHAVSWFTGEAVEADDLDIEDDDDEIDEDDDEEDEEDDEDDEEEDDEDDDEEEEADQGKKSKKKSSAGHKKAGRSQLAEGQAGERPPECKKKSKSDGNGSSEEGMSKKEIALQQALDQITSSFGKGSIMYLGRAVSPRNVPVFSTGSFALDVALGVGGLPKGRVVEIYGPEASGKTTLALHVIAEAQKQGDAEHALDSSLAKAIGVNTENLLLSQPDCGEQALSLVDTLIRSGSVDVIVVDSVAALVPKGELEGEMGDAHMAMQARLMSQALRKLSHSLSLSQTLLIFINQVRSKLSTFGGFGGPTEVTCGGNALKFYASMRLNIKRIGLIKKGEETTGSQVSVKIVKNKLAPPFRTAQFELEFGKGICKITEIIDLSIKHKFIAKNGTFYNLNGKNYHGKEALKRFLKQNESDQEELMKKLQDKLIADEAADKETESESEEEDSLRVVVSPDNTDDESPALVVGAAAVVVEAA

SEQ ID NO: 24355 - protein, 499 aa, Zea mays
MGSPADDKLRRRRPAGRLLMHCAKATPRGQAHPACMLDYKYPAGCTGQFHPAIDSPPVHRHSSRKRQELKNMANRGLHLALFLVLLGLSSNLAAGQILFQGFNWESWKQNGGWYNFLMGKVDDIAEAGITHVWLPPASHSLAEQGYLPGRLYDLDASKYGNEAQLKSLIEAFHSKGVKVIADIVINHRTAEHQDGRGIYCIFEGGTPDSRLDWGPHMICSDDRAYSDGTGNPDTGADFGGAPDIDHLNPRVQQELTGWLNWLKTDVGFDAWRLDFAKGYSADVAKVYIDGTQPCFAVAEIWTSLAYGGDGKPFYDQNAHRQELVSWLDRVGGKASPATTFDFTTKGILNVAVDGELWRLRGADGKAPGLIGWWPAKAVTFVDNHDTGSTQHMWPFPADKVMQGYAYILTHPGNPSIFYDHFFDWGLKNEIAHLVSIRDRHGIQADSELRIIEADADLYLAEIDGKVIVKIGSRYDCGHLIPEGFQVVAHGDGYAVWEKN

SEQ ID NO: 24356 - protein, 324 aa, Oryza sativa Indica Group
MVVRAGAYDDELIKTAGGLGDGRVERDVREEAGVDRNRQAYRTLLVTAAGLGQYISGAILFEETLYQSTVDGRRIVDVLAEQGIVPGIKVDKGLVPLAGPIPSLWCQGLDGLATREAAYYQQGARFAEWRTVVSIPNAGPSALAEDGLVPIVEPEILLDGEHRVERTFEVAQKVWADTFFHMSENNVMLEGILLKPSMVTPGAESKDGAATPEQVAAASRRRCPASCSSPAASRRWRRRGNLNAMNQAAPSANPWRWRVSFSYARALQNTCLKTWGGRRENVAAAQGALLLRAKANSLAQLGKYTSDGEAAEASEGMFVKNYTY

SEQ ID NO: 24357 - protein, 398 aa, Bordetella parapertussis 12822
MFALNPHPSGRHFLQIPGPTNVPDRVLRAIDQPTIDHRGPAFGQLGLAVLAGLKHVFRTESPVLIFPASGTGAWEAALVNTLSPGDTVLMAETGHFASLWRRLAGRLGLEVDCLESDWRHPADPQAIGARLAQDTQHRIKAVCVVHNETSTGVTSDIAAVRAAIDQAGHPALLMVDTISSLGSIDYRYDEWGVDVTVAGSQKGLMLPPGLSFNAIGPRALAAAGQARLPRSYWDWREMLAANERGYFPYTPATNLLYGLHEALAMLREEGLPQVYARHRRHAHATRLAVAAWELELLCLDPAQCSPALTAVLMPGGHSADAFRQRALERFDISLGQGLGKLADRVFRIGHLGYFNDLMLCGTLAGVEMGLAAAGVPHRAGGVQAAMAFLAQTPSGQPA

SEQ ID NO: 24358 - protein, 232 aa, Glycine max
MAERDLRLLGAWFSPFALRVQIALNLKGLDYEVVEETLNPKSELLLKSNPVHKKIPVFFHGDKVICESAIIVEYIDEVWSNNALSILPQNAYDRANARFWVSYIDDKWLTSLKSVLATEDDEAKKLHFEQAEEVLEKVEEVFNKCSEGKAYFGGDTIGFVDIGFGSFLSFIRVSENMNERKLLDETKHPGLTLWAETFAADPAVKGLLPETEKLVEFAKILQLKWAAAAAAK

SEQ ID NO: 24359 - protein, 200 aa, Brassica napus
MDEEAAIDRLPLHLLAYIFSLVTSFTELAQASGVCKKWRKAVNQSMARRQSLSFAGWKMDDDSTSRLVHLAYNLKELDISRSRWGCHITDNGLYQIASARCVSSLTSISLWGMTAITDSGVVQLVSKTSSLQHLNIGGTFITDESLFAIAERCHHLKTISMWCCRHVTERGLLVLVNKCRKLESLNLWGTRVPVDCFIAL

SEQ ID NO: 24360 - protein, 144 aa, Streptococcus sanguinis
FERLVQPDKEDLKRFFIRGQYKSGTVKGKKYISYRSEPNVNPDSMTETFASGAFFVNSERFRDVPFFFRTGKRLTEKGTLVNIVFKQMESIFGEELAPNVLTIHIQPTEGFSLSMNGKEVGERFSLAPLSLDYRTDATASGASP

SEQ ID NO: 24361 - protein, 469 aa, Herminiimonas arsenicoxydans
MTAAEVLKMVKDNEVKFVDFRFADTRGKEQHVTVPVSHFDMDKFESGHAFDGSSIAGWKGIESSDMLLMPDPNTANIDPFFEETTLFMQCDVIEPSDGKGYDRDPRSIAKRAEAYLKSSGMGDTAYFGPEPEFFIFDSIRWKIGMDGCFVKIESEEASWSTGEKFEGGNTGHRPTVKGGYFPVPPVDSFQDMRSEMCLILESLGIPVEVHHHEVAGAGQNEIGSKFSTLVERADWTQNMKYVIWNVAHTYGKTATFMPKPIVGDNGSGMHVHQSVWKDGKNLFAGDGYAGLSDFALYYIGGIIKHAKALNAITNPGTNSYKRLVPGFEAPVKLAYSARNRSASIRIPHVSNPKGRRVEARFPDPLANPYLCFSALLMAGLDGVQNKIHPGEAASKDLYHLPPEEDALIPTVCASLEEALDALNKDREFLTRGGVFSDAMIDAYIELKMQEVQRFRMTAHPVEYDMYYSL

SEQ ID NO: 24362 - protein, 144 aa, Streptococcus oralis
FKNLYHPTEEELKEQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASP

SEQ ID NO: 24363 - protein, 217 aa, Gossypium hirsutum
RSVADETYMKQPGYDNLWFHSMIDHAHEDGMVVFRNGKTVLADLIMHCTGYKYHFPFLDTKGIVTVDDNRLGPLYKHVFPPALAPYLSFIGIPWKIVPFPLFEFQSKWIAGILSGRITLPSQKEMMEDIQAFYSALEDSSIPKRYTHCIGQSQVEYNNWLATQCGCQGVEKWREAMYSMASENRRLLPEMYRDEWDDHHLVSEAYEDFIKYPSASNL

SEQ ID NO: 24364 - protein, 320 aa, Opitutaceae bacterium TAV2
MNAILIDSQKNMRWQPVPTPEPTGAEILIDVHAAALNRADLLQREGKYPPPPGWPEWPGLEVAGTVAALGPECSGRWKPGDKVCALLGGGGYAEKVTAHEDLIMPVPAGLTMEQAAALPEVFATSWLNLVHEAALKSGETVFIQAGASGLGIAAIQTAKFLGAKVITSVGSDEKAQSLRRFAPDIIVNRATESLAAVFDKNPVHVALDCVGGDALAECFPKMATGGRWVLVSTLGGEFANISLRPVLKSGLRLIGSTLRSRPLATKARILRELTEKIWPEIEAGKIDPAVCKIFPITEAEAAHGVLQRRENIGKVVLSIC

SEQ ID NO: 24365 - protein, 144 aa, Streptococcus pseudopneumoniae
FKNLYHPTDEELKEHFIRGQYRSGKIDGMKYISYRSEPNVNPESTTETFASGAFFVDSDRFRGVPFFFRTGKRLTEKGTHVNIVFKQMDSIFGEPLAPNILTIYIQPTEGFSLSLNGKQVGEEFNLAPNSLDYRTDATATGASP

SEQ ID NO: 24366 - protein, 369 aa, Gossypium hirsutum
LRVNLPRQIMGFTDYPFMKKEGGDPRTFPGHEEVLKFLEDFVRDFRLMELIRFGHEVVRVELTDEARHKWVVESRTRETESRWESKEELFEAVVICNGKHTEPKIAEFPGISLMPLEKMHSHSYRTPEQFENQIVVLIGNGSSAKDILKEISPLASQVHQAIRGPDSQLKRLENHDNAWQHSMIECARKDGKVVFQDGSIVDADVIIHCTGYKFHFPFLRSNGTVTVDDNRVGPLYKHVFPPSLAPWLSFVALPYKAVPSIVMESQAKWVAKVLSGKVKLPTQAEMADSVEELYRLMEKSGRPKHLTHTLQQDKFEYENWLATQLNIRPPERWKEIMFFSMEKIKSYYGDKYRDAWDVDKWIQEVDCSN

SEQ ID NO: 24367 - protein, 433 aa, Synechococcus sp. RS9917
MIASADRSGVDASAQRVAPVIDLAERTRPDFPILAQATPDGTPLIYLDHAATSQKPRVVLETLQHFYSADNANVHRGAHQLSARATESFEAARTITARFIAAASSHEIVFTRNASEAINLVARSWGDANLKEGDEVLLTVMEHHSNLVPWQLLAQRTGCVLRHVGLTESGRLDLEDLRTKLSARTRLVSLVHISNTLGCCNPVPEVVSLARQQGAKVLLDACQSLAHQPLNVGALGVDFLVGSSHKLCGPTGMGFLWASEALLEAMPPFLGGGEMIQDVFLDHSTWAELPHKFEAGTPAIGEAIGMGAAITYLQSLGLETIQAWEAQLTRHLFRRLEAIDGVRILGPTPEQQPGRGALATFLVDGVHANDIAALLDCSGICIRSGHHCCQPLHRLYGVTASARASLSFTTTLAEIDRFAEELQGTIRFLREHS

SEQ ID NO: 24368 - protein, 217 aa, Triticum aestivum
  misc_feature (119)..(119): Xaa can be any naturally occurring amino acid
  misc_feature (186)..(186): Xaa can be any naturally occurring amino acid
KGAESCHRKNKMQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAXGIVTERDYLRKIIVQGRSSKSTKVGDIMTEENKLITVKPETRVLKAMQLMTDKRIRHIPVISGTEMXGMVSIGDVVRAVVSEHKEELNRLNAYIRGGY

SEQ ID NO: 24369 - protein, 144 aa, Streptococcus cristatus
FERLVQPSEEDLKRFFIRGQYKSGKINGRKYISYRSEPNVNPESTTETFASGAFFIDSDRFRDVPFFFRTGKRLTKKGTHVNIVFKQMDSIFGEPLKPNVLTIYIQPTEGISLSLNGKEVGELFNLAPISLDYRTDATASGASP

SEQ ID NO: 24370 - protein, 160 aa, Mycobacterium tuberculosis CDC1551
MKGGAGVPDLPSLDASGVRLAIVASSWHGKICDALLDGARKVAAGCGLDDPTVVRVLGAIEIPVVAQELARNHDAVVALGVVIRGQTPHFDYVCDAVTQGLTRVSLDSSTPIANGVLTTNTEEQALDRAGLPTSAEDKGAQATVAALATALTLRELRAHS

SEQ ID NO: 24371 - protein, 317 aa, Treponema denticola ATCC 35405
MIKEIYLAGGCFWGVEGYFRQIPGVKETDTGYANGKNDSANYKGLHQSDHAETVKIVYDSSVVSLQELLAHYFRIIDPTSLNKQGNDAGRQYRTGIYYVDDSMIKEINSFVKFMQKKYSRPIVVEVEKLKHFILAEDYHQDYLQKNPGGYCHIDLTLALKPLYDESKFKVPSKEELKKSLKPIQFSVTQEKATERPFTSEYDKFDAEGIYVDITTGKPLFSSLNKYDAGCGWPSFTKAITTQALQYLEDKSLGMNRTEVVSKTGGAHLGHVFDDGPADAGGLRYCINGAALRFIPYDKMEKEGYGDYLPYVKPTGNF

SEQ ID NO: 24372 - protein, 337 aa, Candida albicans SC5314
MSTSIQNRTIEFQQCVSTYDKINKKHNKHVNNSPALSTPKKSYFSQQAGLIAKDISHVTELLSKLAVLAKRKPIFDDKPIEIGELTYVIKQDIFKIETNIQNLQKYLKGDTSVSIDAQTTQFSKNVLTLLNSKMKNVSGEFKNVLEIRQKNEIINKNRTENFLSSVSASRSSNNQSPLVDNPNASLSNLSENPFLASSPPENLPYDPDADPDTSSPYGVSNNGEYLSLPSQTQQMLLMEEQQYGNQQYLQQRNRAVESIESTINEVGNLFQQLATMVSEQGEQIQRIDANVEDINMNITGAQRELLKYYAHITSNRWLFLKIFGVLIVFFFLWVLVS

SEQ ID NO: 24373 - protein, 278 aa, Triticum aestivum
  misc_feature (180)..(180): Xaa can be any naturally occurring amino acid
WIPRAAGIRHEQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEXFYNANLGITNKPIPDFSFYDRSAPIYTQPDTCSFKRFWGSEFDITPANVNPPPPPRLKSPVKGGAHSPLRWANFWKGKWGGPFSLFPPRGKGEFSPRQ

SEQ ID NO: 24374 - protein, 323 aa, Physcomitrella patens
RYDRCWHGRKDSPLDIVVINDTGGVKQASHLLKYDSMLGTFDAYVKVEGNDAISVDGKVIKVVSDRNPLNLPWGDMDIDLVIEGTGVFVDEAGAGKHIQAGAKKVLITAPGKGPIPTYVVGVNEQDYKHSDTIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTSAEEVNQAFRDACNTDQLKGVLAVCDEPLVSVDFRCTDVSSTVDSSLTMVMGEDMVKVVAWYDNEWGYSQRVVDLANLVAEKWQ

SEQ ID NO: 24375 - protein, 794 aa, Streptomyces coelicolor A3(2)
MAELPTSHLAAAVLTDGNRALVAVIAVVALAALVLAGVLVRQVLAAGEGTDSMKKIAAAVQEGANAYLARQLRTLGVFAVVVFFLLMLLPADDWNQRAGRSIFFLIGAAFSAATGYIGMWLAVRSNVRVAAAAREATPAPGEPEKDLALVSHKATKIAFRTGGVVGMFTVGLGLLGACCVVLVYAADAPKVLEGFGLGAALIAMFMRVGGGIFTKAADVGADLVGKVEQGIPEDDPRNAATIADNVGDNVGDCAGMAADLFESYAVTLVAALILGKVAFGDFGLAFPLLVPAIGVLTAMIGIFAVAPRRSDRSGMSAINRGFFISAVISLVLVAVAVFVYLPGKYADLDGVTDAAIAGKSGDPRILALVAVAIGIVLAALIQQLTGYFTETTRRPVKDIGKSSLTGPATVVLAGISLGLESAVYTALLIGLGVYGAFLLGGTSIMLALFAVALAGTGLLTTVGVIVAMDTFGPVSDNAQGIAEMSGDVEGAGAQVLTDLDAVGNTTKAITKGIAIATAVLAAAALFGSYRDAITTGAADVGEKLSGEGAPMTLMMDISQPNNLVGLIAGAAVVFLFSGLAINAVSRSAGAVVYEVRRQFRERPGIMDYSEKPEYGKVVDICTRDALRELATPGLLAVMAPIFIGFTLGVGALGAFLAGAIGAGTLMAVFLANSGGSWDNAKKLVEDGHHGGKGSEAHAATVIGDTVGDPFKDTAGPAINPLLKVMNLVALLIAPAVIKFSYGADKSVVVRVLIAVVAFAVIAAAVYVSKRRGIAMGDEDDADPEPKSADPAVVS

SEQ ID NO: 24376 - protein, 97 aa, Alocasia macrorrhizos
  misc_feature (17)..(17): Xaa can be any naturally occurring amino acid
ATYKVKLVTPQGQQEFXCPDDVYILDQAEEEGIDLPYSCRAGSCSSCAGKVKQGEVDQSDGSFLDDEQMEQGWVLTCVAFPTSDVVIETHKEEELTA

SEQ ID NO: 24377 - protein, 301 aa, Shewanella sp. ANA-3
MNKLTDFERYVIEEKGTERPFSGEYYKHDAKGVYLCKKCHAPLYRSEDKFNAHCGWPAFDDEIPGAVSRHVDADGRRTEIVCSQCGGHLGHVFEGEYLTPKNIRHCVNSVSMVFQAADEVTTSTHKTAFATFGAGCFWCVEAIFKSLKGVLNVRSGYSGGEASDADYKSVCSGLTGHAEVVHIEFDPAQISFTTLLQVLFESHDPTTLNRQGNDKGPQYRSVVFTHDAAQIEETNTMIAKLTEAKVFDAPIVTQVVAFESFYPAEDYHNDYFALHGEQPYCQIVVRPKVEKIRALFAELQA

SEQ ID NO: 24378 - protein, 476 aa, Zea mays
FGTRVGARVVCIACAGRVVPRAMAAAGARLPLALLLPLFVTFFASPASATDTITANSSLSDGQTLVSAGGVFQLGFFTPASSTARFLGIWYMGLAPQTVVWVANREAPITGTTASLAINATGSLVLADPSGRVFWSSPQSNMSSTGSPVGAQLLDSGNFVLQGGGGAVLWQSFDYPSDTLLPGMKLGWDLTTGLDRHLTTWRSTGDPSPGDYTFGFDLRGVPEGFIRRDGTVPVYRNGPWNGLQFSGEPEMEPNNSNFQFEFVDNASDVYYTFLVDGGGGSGNGGVVSRFVLNQSSVQRYVWPPGGQGWSLYWSLPRDQCDNYAHCGAFGACDTSGGSAACACVHGFTPASPRDWELRDSSAGCRRLTRLNCTGDGFLPLRGVKLPDTTNATEDATITVDQCRQRCLANCSCLAYAASSIKGGDSGCIIWSSPLIDIRHFPSGGQDLFVRLAASDLRTNLLSSSLLISSLASWFSS

SEQ ID NO: 24379 - protein, 524 aa, Thermus thermophilus HB8
MDLTHYPYPSRRHVVLGRRGAVATSQPLAALAGMEMLQKGGSAVDAAVAMAACLTVVEPTSNGIGGDLFALVWDGTLHGLNASGKSPMALTPERLPGRMPERGWLPVTVPGAVSGWRALHERWGRLPFAEVLVPAIRYAEEGFPVGPETARSWRRAEGVFLPLEGPEFGPFKEVFFPGGRAPRAGEVWRSPLHAKTLREIAGSYGESLYRGALAEALLRFSEATGGLLTREDLEAHAPEWVTPLSTEYKGLTVWELPPNGQGVAVLLALNLLEGFDLRPEDPWSYHVQIEAMRLALVDTYRFVADPRHMELAPEAFLSKAYAAERRRLIGERALPRVLPGLRPEGTVYLAAADGEVMVSLIQSNYQGFGSGVLVPGTGIALQNRGLGFSLEEGHPNRVGPGKRPFHTIIPGFLTREGKPLGPFGVMGGFMQPQGHVQVVVGLADFGLNPQAALDRPRWQVVPGDEVLLEPGIPQATALFLKDLGHRVRYEAEYGLFGRGQAVFRLGEALVGASDPRAEGLALAW

SEQ ID NO: 24380 - protein, 1292 aa, Physcomitrella patens subsp. patens
MVRQVRCYKKLRVCYCTQYLTEPRHCQRFFYLATKFRQTLRGGTLRFVQIWRDQPPLAEWGLLHDKRIVGHGDAEKISLPRLKRELLPGCRAPRAKQWPTEQDIHDCMSSHPGRCRHMFPLQGAFRSVVALRCRDEGRYDHEVSTVMARCCPFLEAVELRPTASIGPRAPVRIIPAKIAVAMRPPPVWDTISAPSAIPNRVRVALLSSCKENPVTPSVVSMAETVLGGCGTPSHSQLYGFNGGGDTIACDDCGRPVPGNADVGYYFCNQCHVSSCVSCTSLKQSHPGSFNAPREKKTFNAAQSSRASPGTRTSYKGKISYDSDDDGEENPGMPSVELMAETPIPGGCGTPSHCQYWSRGTGQNIACQDCGRYVPTARVGYYFCSQCYAKSCMSCASLKLQGDAKQSRSRGSPQQQATAAAQRSRGLPQQTVNAAQSSRTSPATRNSYKVNSNPVTPSVESMGRAIRGGCGIPSHVQRYWCNDRTIACEDCSRQVPTAGVGYYFCNQCEVSSCMSCTFVKQGHQSSSNAAPSSRASPLVLASDDDNDDDEKPVLPCAGLLTHSLEFLQKSPYYGNCFGCNMCGEAGYSELYHCESCQFAAHKQCAEVEEEVKVFYHKHPLQRYYTGEDEEDIICQCCQGEVEEDVSPWVYKCPDCTNFAVHARCAKYAKSLTHGSHPHKLKLVHKSSKGKSRQCGCDGCGNEILHTFHYTCTKWGCDFDLHPLCAVLPTKPLCRMNPSHRVEIDYFPLASEQCALCDSPSDEAWLYRCRICDVSMHVDCFSAETDEDSSDDEDDEEDEDLGELYQKFIDSMDDFGNQGNEEKVDKLSELVNSFKSTTEAAAASSLPRQSSVQSWGFGVQGLGTCSRADSDKTLNDVTEMVLFMCKVVTSRVHPKVSSLARSETHILDQGRQPRSRESDASEEERRRIKQAAKEQRRKEKAAARELQEQEKAARREEKAKREAKVIAELQNIAIQLQKNQNSKDSGGNDATVGQKLAELKAMTENWQASDARRHQEQAKFNEERHLEQTKLHHEQGKLNQERHLHHTKLHHEQLKLQHEQAKLQDKRHLEHTNLLQERNQEYLNGLQEIINTQVQSTTRVVPRLVLCTETSSRVKKLITSLRVGIKVVQLHLFCEHAQQPHVVAGAPGCEINQKVAGDRWTKLQPFLAAGLMVVKLALNFGTTMGAGVGVLKDVLPDLHKMVLETQAIDLGKHAVQPARCKVLPRQEAEEAEVMATQWLVSYLNDQKVNIAESFKLFRVRYTAPEHIKGTVGCLCFNHLDRGMKDGSLEHFPLR

SEQ ID NO: 24381 - protein, 460 aa, Lactobacillus plantarum WCFS1
MKITNADGTIRALSNRHVQMIAIGGTIGTGLFLGSGSTISKTGPSVMWVYLVLGFFFFLMMRAIGEMFYSDPTQHTFVAFISRYLGPSVGYFTGWTYWIGLIFVCMAELTATATYVKFWLPNVPAWLIEISFLLILAGVNLTAARLFGEAEFWFAMIKIVAIIALIITGIFMMVGHHPTPLGQASIGNLFHNYQVFPNGIANFISAFPMVFFAFQGIEFVSITIGEAKNPHRVIKKAVNETLLRILLFYIGALIVIMGIIPWTSLSPDSSPFVQVFKLAGYPAAAAIINFVVLTSAASSLNSCLFSAGRHFYQLATEMPVTSRMHQIFGQISKSGVPAAAIVLSAILVLVTPIMSLSAATTAVFTVVTGISSDMYLIVYTLAMLAHRKYRLSNDYLADGFKMPAYRITSPLTIAFFVLIFASLFFIQADIVGAIGAIIWTLLFGGITFAHQARLRAVTRS

SEQ ID NO: 24382 - protein, 334 aa, Xanthomonas campestris pv. vesicatoria str. 85-10
MTASADRYAASLRLSVAPMMDWTDRHCRVFHRLLAPSARLYTEMVHANAVIHGDRARLIGFDAVEHPLALQLGGSDPALLAQAAAIAQEWGFDEINLNCGCPSDRVQAGRFGACLMREPALVAECVAAMCAATHVPITVKCRLGVDDDDDYALFARFVDQVVAAGAAMVVVHARNAWLKGLSPKENREVPPLRYDWAYRLKQERPGLPVVLNGGIVAVDTAMAHLQHADGVMLGRAAYHDPYVLHCLDAALNQRPEQSRESLLRAYQPYVESQLAQGLALKHMTRHVLGLFHGQPGGRAFRQVLSEGAHRPGAGWELVEQALERTDTRSWRVVA

SEQ ID NO: 24383 - protein, 194 aa, Campylobacter jejuni subsp. jejuni NCTC 11168
MFIPYVIEKSSRGERSYDIYSRLLKDRIIMLSGEIHDELAASIVAQLLFLEAEDPTKDIYLYINSPGGVITSGFSIYDTMNYIKPDVCTICIGQAASMGAFLLSCGAEGKRFALPNSRIMIHQPLGGARGQATDIEIQAKEILRLKTILNDILAKNTKQKVAKIAKDTERDFFMSAQEAKEYGLIDKVLEKSFK

SEQ ID NO: 24384 - protein, 144 aa, Streptococcus sinensis
FERLVQPSEDDLKRLFIRGQYKSGKVNGKKYISYRSEPNVNAESTTETFVSGAFFIDTDRFRDVPFFFRTGKRLTAKGTHVNIVFKQMNSIFGEPLKPNILTIYIQPTEGFSLSVNGKEVGELFNLAPISFDYRTDATASGASP

SEQ ID NO: 24385 - protein, 492 aa, Gossypium hirsutum
MPHFSNSVKLKYVKLGYQYLVNHILTLTLIPVMAGVLIEVLRLGPAGIVSLWNSLHFDLVHILCSCFFIIFVATVYFMSKPRSIYLVDYACYKPPVTCRVPFATFMEHSRLNLSNNPKSVEFQMRILERSGLGEETCLPPAIHYIPPTPTMEAARGEAEIVIFSAMDSLFKKTGLKPKDVDILIVNCSLFSPTPSLSAMVINKYKLRSNIKSFNLSGMGCSAGLISIDLARDLLQVHPNSNAVVVSTEIITPNYYQGKERAMLLPNCLFRMGGAAILLSNRRSERWRAKYRLVHVVRTHKGADDKAYRCVFEEEDKEGNVGISLSKDLMAIAGEALKSNITTIGPLVLPASEQLLFLLTLIGRKIFNPKWKPYIPDFKQAFEHFCIHAGGRAVIDELQKNLQLSAEHVEASRMTLHRFGNTSSSSLWYEMSYIEAKGRMKKGDRVWQIAFGSGFKCNSAVWKCNRTIKTPKDGPWADCIQGYPAHIPEVVKL

SEQ ID NO: 24386 - protein, 144 aa, Streptococcus anginosus
FKHLHKPTDNDLKKLFIRGQYTSGKVDGKKYISYRSEPNVAPESTTETFASGAFFVDSDRFRGVPFFFRTGKRLTAKGTHVNIVFKQMESIFGSSLQPNVLTIYIQPTEGFSLSMNGKEVGEQFNLAPLTLDYRTDATASGASP

SEQ ID NO: 24387 - protein, 529 aa, Streptococcus pneumoniae TIGR4
MFASKSERKVHYSIRKFSVGVASVVVASLVMGSVVHATENEGATQVPTSSNRANESQAEQGEQPKKLDSERDKARKEVEEYVKKIVGESYAKSTKKRHTITVALVNELNNIKNEYLNKIVESTSESQLQILMMESRSKVDEAVSKFEKDSSSSSSSDSSTKPEASDTAKPNKPTEPGEKVAEAKKKVEEAEKKAKDQKEEDRRNYPTITYKTLELEIAESDVEVKKAELELVKVKANEPRDEQKIKQAEAEVESKQAEATRLKKIKTDREEAEEEAKRRADAKEQGKPKGRAKRGVPGELATPDKKENDAKSSDSSVGEETLPSPSLKPEKKVAEAEKKVEEAKKKAEDQKEEDRRNYPTNTYKTLELEIAESDVEVKKAELELVKEEAKEPRNEEKVKQAKAEVESKKAEATRLEKIKTDRKKAEEEAKRKAAEEDKVKEKPAEQPQPAPAPKAEKPAPAPKPENPAEQPKAEKPADQQAEEDYARRSEEEYNRLTQQQPPKTEKPAQPSTPKTGWKQENGMWYFYNT

SEQ ID NO: 24388 - protein, 417 aa, Penicillium citrinum
MSLSNKLPVTDVDLKGKRVLIRVDFNVPLDENKNVTNPQRIVGALPTIKYAIDNGAKAVVLMSHLGRPDGKVNPKYSLKPVVPVLEKLLGKSVTFAEDCVGPQTEETVNKASDGQVILLENLRFHAEEEGSSKDAEGKKVKADKADVDAFRKGLTALGDVYVNDAFGTAHRAHSSMVGVDLPQKAAGFLVKKELEYFAKALESPARPFLAILGGAKVSDKIQLIDNLLPKVNSLIITGGMAFTFKKTLENVKIGNSLFDEAGSKIVGEIVEKAKKYNVEIVLPVDYVTADKFSADATVGAATDATGIPDGYMGLDVGPESVKLYQKTIAEAKTILWNGPPGVFELKPFASATEATLDAAVKAAESGSIVIIGGGDTATVAAKYKVEDKISHVSTGGGASLELLEGKELPGVAALSSK

SEQ ID NO: 24389 - protein, 144 aa, Streptococcus constellatus
FKHLHKSTDNDLKKLFIRGQYTSGKVDGKKYISYRSEPNVEPESTTETFVSGAFFVDSDRFRGVPFFFRTGKRLTAKGTHVNIVFKQIESIFGSSLQPNVLTIYIQPTEGFSLSMNGKEVGEQFNLAPLTLDYRTDATASGASP

SEQ ID NO: 24390 - protein, 622 aa, Pseudomonas fluorescens PfO-1
MSFASLGLSEALVRAIEDAGYTEPTPVQQRAIPAVLQGRDLMVAAQTGTGKTGGFALPILERLFPNGHPDKSQRHGPRQPRVLVLTPTRELAAQVHDSFKIYARDLKFVSACIFGGVGMNPQVQAMSRGVDVLVACPGRLLDLCGQGSVDLSHVEILVLDEADRMLDMGFVHDVKKVLARLPAKRQNLLFSATFSKDITDLAGKLLHNPERIEVTPPNTTVERIEQRVFRLPASHKRALLAHLITAGAWEQVLVFTRTKHGANRLAEYLDKHGLPAVAIHGNKSQNARTKALADFKAGEVRILVATDIAARGLDIDQLPHVVNFELPNVDEDYVHRIGRTGRAGRSGEAISLVAPDEEKLLKSIERMTKQKIADGDLMGFDASTIEAEKPEVRERPDMRNPRNARGPRGDGPNGGGGGGGRKDKGKDKGKEKPAGERGERPARQQKPREGTPAREQRQPSQPPRAAADRAPDEFLDDDIDNFGNRVDYVPKQAPTGGRNRRPGAPAQGAGSGAPRGGQSQGRQNGPRNSNGSSTGTPPGKRSGPRNGAPRDGQGRRDENSRNRRPARDDQQRAEPAVQNPRSSGPKIMHKESKADRFPTPEQLDQLPSRPRGEKPALLTRNR

SEQ ID NO: 24391 - protein, 432 aa, Francisella tularensis subsp. holarctica
MSEYFLFSLLTVVAALMSYINTKFLKLPKAIGLTILSITFSALCASFLSPSNFLVVALSSFDFKKTVLDGMLSFLLFANALHFNMIDLKKELKAIFGLASIGLLLSALTTAILIYGFCLLVGFEISLGYCLVFGALISPTDPIAVISTLAGNKSIPKHIKTRVVGESLFNDATGIVLFVVLSNIVFFSSGGEFGQAINGHGIEYIWIIAKQIGSEAGGGILLGYIFARVALIFLKTNQDSETSIFVTLAVASMGYVIAHSLNVSGPIAMVVAGLFIGNNLSDRKKTSPDQVEKLDNFWMVIDNMLNSFLFILIGLELTSIPFNHGAFWVGAAGIFIVTFARLVSISIPITVIDKKLTRASAKDNLLVAWSGVRGGISLALALSLPDEGNVIVSITYTVVILSILAQGSTLKIVLNMIYPHNITKKAANTVDN

SEQ ID NO: 24392 - protein, 468 aa, Pseudomonas fluorescens PfO-1
MGLNNQWMQRDLAVLWHPCTQMKDHEQLPLIPIKRGEGVWLEDFEGKRYLDAVSSWWVNVFGHANPRINQRIKDQVDQLEHVILAGFSHQPVIELSERLVKMTPEGLNRVFYADNGSSCIEVALKMSFHYWLNRGQPNKKRFVTLTNSYHGETMAAMAVGDVPLFTETYKALLMDTIKVPSPDCYLRPQGMSWEEHSRNMFAAMEQTLAENHDSVAAVIVEPLIQGAGGMRMYHPVYLKLLREACDRYGVHLIHDEIAVGFGRTGTMFACEQAGIRPDFLCLSKALTGGYLPLAACLTTDEVYSAFYDDYPTLRAFLHSHSYTGNPLACAAALATLDIFEQDNVIENNRALAQRMASATAHLVDHANVSEVRQTGMVLAIEMVKDKATKEAYPWQERRGLKVFQHALERGALLRPLGSVVYFLPPYVITPEQIDFLAEVASEGIDIATRDSVSVAVPKDFHPGFRDPG

SEQ ID NO: 24393 - protein, 417 aa, Brassica napus
MAATAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 24394 - protein, 159 aa, Geobacillus kaustophilus HTA426
MHISIVAVGKLKEKYLIAGINEYTKRLSAYAKIDIIEVADEKTPERASELEEEQIKEREGGRLLAKIPHDAHVIALAIEGKMQSSEQFAARLDELATYGKSKVVFVIGGSLGLSKQVMARADETLSFSKMTFPHQLMRLILLEQIYRAFRINRGEPYHK

SEQ ID NO: 24395 - protein, 406 aa, Bacillus subtilis
METPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 24396 - protein, 403 aa, Mycobacterium avium subsp. paratuberculosis K-10
MKRVSELLESIQSRAEQGAITDAEIFAAHVGGKLSVSLTSPLDTQRALSIAYTPGVAQVSRAIAADHRQAAHYTWANRLVAVVSDGSAVLGLGDIGPAASLPVMEGKCALFQAYGGLNAIPIVLDTKDPDEIVETLVRLRPTFGAVNLEDISAPRCFEIERRLIEALDCPVMHDDQHGTAIVVLAALMGASKLLGRDMSSLKVVVSGAGAAGVACTNLLMAMGVSDITVLDSRGILHAGRDDMNDVKAALSRRTNPAGLTGSLAEAIRGADVFLGLSGGVVPEEMIAAMAPNGIVFALSNPDPEIHPQIAAKYATVVATGRSDFPNQINNVLAFPGVFRGALEAGARRITEKMMVAAAEAIFSVVSDDLAPDRIVPSPLDTRVGDAVATAVALATEVSDAPAG

SEQ ID NO: 24397 - protein, 317 aa, Triticum aestivum
  misc_feature (149)..(149): Xaa can be any naturally occurring amino acid
  misc_feature (173)..(173): Xaa can be any naturally occurring amino acid
  misc_feature (264)..(264): Xaa can be any naturally occurring amino acid
  misc_feature (297)..(297): Xaa can be any naturally occurring amino acid
MGLKAAVFLSVPAAVTPLPTTLHRHHLPPSSYSSSRGSSASASRISAAVMATAVQPAVVVGGGRVGQALLSMGPSSGDLLLRRGEALPPAAPAGPILVCTRNDDLDGVLDATPKSRWPDLVFFQNGMLDPWLESKGLAGANQVLAYFAXSKLGEPPVDGITDANPEGLTAALXNWAPAVAARLQNGGLTCKVLDKDAFEKQMLEKLIWISAFMLVGARHPGATVGAVEKEYRSEVSSLIPELASAAPAQRGLTFDEGMEERLCXAYPRAVAHFPTAVKEFKWRNGWVYSLTEKALAXEGNPDPSPLHTAGLQRIKVI

SEQ ID NO: 24398 - protein, 209 aa, Mesorhizobium loti MAFF303099
MKNPVETYMNLVPMVVEQTNRGERAYDIFSRLLKERIIFITGPVEDGMATLVCAQLLFLEAENPKKEINLYINSPGGVVTSGMAIYDTMQFIKPAVSTLCIGQAASMGSLLLTAGHKDMRFATPNARIMVHQPSGGFQGQASDIERHAMDIVKLKRRLNEVYVKHTGKSYEEIERTLDRDHFMTADEAKDFGLIDKVISSREPAESAVA

SEQ ID NO: 24399 - protein, 185 aa, Chlamydomonas reinhardtii
MPALAAAVATGVAASLLSANMAMAEFRLPPIDKTDPNRCDRGYVGNTIGQANAVSDKILDMRLCSYAGKDLHGRVLAGALLADADLSNTNLQEAVLTKAYAVKANFEGADMTNAVVDRVDFTNANLKRVKFINTVVTGASFAGADLEGSVWEDALIGSQDVGKLCENPTLTGESRAQVGCRAVRK

SEQ ID NO: 24400 - protein, 476 aa, Zea mays
MTMNAAIASRLGLAVSRCGAGSRVDSRPLTPAVGFTAGPRARSVAVTAASSSPATGGVTPVPPRSNRSVMKRHTLSVFVGDESGMINRIAGVFARRGYNIESLAVGLNKDKALFTIVVSGTDKILNQVVEQLNKLVNVIKVDDLSMEPQVERELMLIKVNAEREKLPEIMGLVRIFKAEVVDLSDYTLTIEVTGDPGKMVAIQKTLSKYGIREIARTGKIALRREKMGETAPFWRFSAASYPDLEVAIPSNFQQNTGVKAINQNPEESSGGDVYPVESYESFSSTSQILDAHWGVMTDGDPTGFCSHTLSILVNDVPGVLNLVTGVFSRRGYNIQSLAVGPAEKEGTSRITTVVPGTDESIAKLVHQLYKLIDVYEVQDFTHLPFAARELMIIKVAANATARRDVLDIAQIFEAQKVDISDHTITLLLTGDIDRMVRLQKMLEQYGICEVARTGRIALLRESGVDSKYLRGFSLPL

SEQ ID NO: 24401 - protein, 568 aa, Synechococcus sp. CC9311
MTPSVVTYALDRLADLGIGHVFGVPGDYSFPINDAVEVHPRLRWVPSANELNAAYAADGYARRRGAAIVCTTYGVGELSALNGLMGAMAERLPVFHLVGTPSLRIVRQGLICHHTLGDRNYDRFEAISASASCVSARLTPENAVIELERVIDKALEQSRPAYLTFPMDLALMPITGTPIQGSPLGVIDQHDSVSAELEAVLDLLESRIASASRPVVLPTITLKRFGLVNAFEEFLKASGLAYATTPMDKALLSEQHPAFLGMYNGGRSTPAALQSVVEEADLVVDIGGLVLEDLNTGLWSGSLDPNRIVALHADWVQAGHQVFTSVSISDVLAGLTRRFQTSSKRLSYWGEHRPVRPAPMLPLLGEPDQPTDSASFYPRLQQFLRPNDLLLSDTGTCLLKLNAIRLPDGVTMESQTLWGSIGWGTPAALGCALAEPERRVVLVTGDGAHQLTVQEIGVMGFTGVNPVVIVLNNGLHGIEALISETGHAYNDLPPWHYANIPAALGCKDWWSGRAATVAELEQALAAISAHQGAAYLEVVIPAEESQPLAEEVIEIFHQTTTPKSALTD

SEQ ID NO: 24402 - protein, 333 aa, Triticum aestivum
  misc_feature (221)..(221): Xaa can be any naturally occurring amino acid
MAAATLVLVMLVVTVGVAVAMAEGGKLRQGYYEQSCPRAEQIVKHYVERHVPHAPSVAATLIRTHFHDCFVRGCDASVLLNATTGGGEAEKDATPNLTLRGFAFLDRVKALLEQECPGVVSCADILALASRDAVGVIGGPFWRVPTGRRDGRVSIKQEALDQIPAPTMNFTDLLTSFRAKGLDLADLVWLSGAHTIGISHCNSFTERLYNFTGRGGPGDAXDPSLDAEYAANLRRTKCTTPTDNTTIVEMDPGSFLTFDTSYYRGLLKRRGLFQSDAALITDAAARADVESVAKGPSEVFFQVFARSMVRMGMIEVKTGGEGEIRRHCAVVNS

SEQ ID NO: 24403 - protein, 647 aa, Synechococcus sp. CC9311
MHLSELTHPNQLHGLSETQLEAVAKQIRERHLEVVSNSGGHLGPGLGVVELTLALYQTLDLDRDKVVWDVGHQAYPHKLITGRYGSFDSLRQQGGVAGYLKRTESRFDHFGAGHASTSISAALGMAIARDRQGLDYKCVAVIGDGALTGGMALEAINHAGHLPSTPLLVVLNDNDMSISPPVGALSTYLNRMRLSPPLQFLSGSVEESVRNLPFMGGEIPPELNRLKESMRRLAVPKVGAVFEELGFTYMGPIDGHDIAEMTRTFQSAHRVGGPVMVHVVTKKGKGYPYAEADQVGYHAQSAFNLSTGKARPSKTPKPPSYSKVFGQTLVKLCEQNPKVVGITAAMATGTGLDILQKALPDQYIDVGIAEQHAVTLSAGMACDGLRPVVAIYSTFLQRAFDQLIHDVGIQKLPVTFVLDRAGIVGADGPTHQGQYDISYMRAIPNFTVMAPKDEAELQRMLVTCLNHDGPTALRIPRGPGEGVPLMEEGWEALPIGCGEVVREGNDVLIVAYGAMVPKAMATAKCLAAVGVEVAVINARYLRPLDEALIHPMAKQIGKIVTMEEGALAGGFGSAVLESLQEKGLAIPMLRIGIPDRLVDHATPQQSFEALGLTPDQMAVRIKQHFLLSTSGSLTLEEKAPAEVSSAG

SEQ ID NO: 24404 - protein, 461 aa, Campylobacter jejuni subsp. jejuni NCTC 11168
MNLEKLRSKLGKENLSAIFGEITKISATSIEIRGLKTGVGDIVKLVSNENENLNTLAMVVEIKEQFSYLSPFSFIEGFKIGDRAFISDAGMQIGVSDELLGRVVDPFMRPKDGKGAIEATKYMPIMRAPIDAMKRGLIEEVFPVGVKTIDALLTCGVGQKLGIFAGSGVGKSTLMGMIVKNSKAPIKVVALIGERGREIPEFIQKNLGGKLDDTVIIVATSDDSALMRKYGAFCAMSVAEYFKEQGKDVLFIMDSVTRFAMAQREIGLALGEPPTTKGYPPSVLSLLPQLMERTGKEEGKGTITAFFTVLVDGDDMSDPIADQSRSILDGHIVLSRELTDFGIYPPINIQNSASRVMSDIISPEHKLWARKFKRLNSLLKENEVLLRIGAYQKGSDKELDEAISKKEFMQKFLGQNPEESFEFNQTLELLSQIDTPNTPLPPTQNINVGSASATLPNPNLK

SEQ ID NO: 24405 - protein, 130 aa, Brassica napus
  misc_feature (128)..(128): Xaa can be any naturally occurring amino acid
CLVNNQANCVYEGTQRLPRLVGLAKATDMILLSKSISSEEGQKFGLVDALVPSGELLSTSRKWALDIALGRKPFLRSLHRTDKIGSLSEARAILKDTRQLAKKIAPNMPQHHACIDVIEERIVHGGYXGV

SEQ ID NO: 24406 - protein, 480 aa, Synechococcus sp. CC9311
MLEINKIFDKFQLFYVDGEWEVSSSKERLSVINPATEESIGKIALAGDADVEKVVAAATIAFKSFGHSSVEERIDLLQNILKIYEQRVDEFASAISMEMGAPIDFARSAQAQAGIDHLSALIDDVKEYKFERKLRNGDTIVMEPIGVCGLITPWNWPINQIVLKVAPALAAGCTMVLKPSELTPLSAILFAEVMHEAGVPKGVFNMIHGLGNVAGSALSKHPNVAMISFTGSTGAGRSIIRNSAERIAKTTLELGGKSPNLVFADCELSTAIDQGIDACFINSGQSCDAATRMLVERSVYEKSIELAHDKCERISVGDPTKSGNHLGPLVSQIQFDRVQSLIACGLEEGARCISGGLGKPQECQVGYFARPTVFADVKNTMKIAREEIFGPVLCMIPFDSEKEAIELANDNAYGLAAYIQTLDQGRAQTVARLLRSGSVNINNSFIAPGSPFGGYKLSGTGREGGAEGVNEYLEVKVIAS

SEQ ID NO: 24407 - protein, 618 aa, Candida albicans SC5314
MSKKYSEENTSSIPLTDLTSPSTGETSSQQQRQRASQQQPPQQPKSNTATGSRWSNFVDSFKPAIENEKLAMRYRDADADVEEDAGGYYNSTDQLTEIQRININSSKSNLKRKLKNRHLQMIAIASSIGSGLLIGTGGALATGGPGGILIAWILSGISILCTIQAMAELAVTFPVSGGFNVLFSRFIDPSVGFSVAWNYGLQYLVLLPLELVAASMTIRYWSTDITPDVWVIIFYVTVTSINFFGVRLYGEVEFILSSLKVIAVVGFIILSIVLAAGGAPNGVHHGTKYWHDPGAFANGFKGVSSTFITAAFSFAGTELTGLTSAEAENPRKALPKACKQVFWRILLFYVVSIILITFLVPYDNPRLLGASDVSASPFVIAIQDGGISGLASVMNSVILISVISVGSSSVYATSRTLVSLAEQNLAPKICGYVDRAGRPLVAILITNVFGLLSFIAASGKEDEVFTWLLSISGLSSIFTWLCICISHIRFRRALHVQGRNTNELTFVSQTGVIGPGFGILLNVLVLVAEFWLAIFPLGEKSNAKSFFETYLGFVILIIFYFGHKLWRNNWILFIRSRDIDIDSGRRETDLEALKRELQEEREVLRNKPFWYRAYHFWC

SEQ ID NO: 24408 - protein, 144 aa, Streptococcus mitis
FKNLYHPTDEELKEHFIRGQYRSGKIDGMKYISYRSEPNVNPESTTETFASGAFFVNSDRFRGVPFFFRTGKRLTEKGTHVNIVFKQMDSIFGEPLAPNILTIYIQPTEGFSLSLNGKQVGEEFNLAPNSLDYRTDATATGASP

SEQ ID NO: 24409 - protein, 144 aa, Streptococcus mitis
FKNLYHPTDEELKEHFIRGQYRSGKIDGMKYISYRSEPNVNPESTTETFASGAFFVNSDRFSGVPFFFRTGKRLTEKGTHVNIVFKQMDSIFGEPLAPNILTIYIQPTEGFSLSLNGKQVGEEFNLAPNSLDYRTDATATGASP

SEQ ID NO: 24410 - protein, 494 aa, Salmonella typhimurium LT2
MHIKYLWMCDCGGKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 24411 - protein, 250 aa, Arabidopsis thaliana
  misc_feature (226)..(226): Xaa can be any naturally occurring amino acid
  misc_feature (234)..(234): Xaa can be any naturally occurring amino acid
  misc_feature (242)..(243): Xaa can be any naturally occurring amino acid
SPPPPWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNGSMESNGKGVXIDGLPLPXETGEIDFXXPWTNGQH

SEQ ID NO: 24412 - protein, 144 aa, Streptococcus mitis
FKNLYHPTDEELKEHFIRGQYRSGKIDGMKYISYRSEPNVNPESTTETFASGTFFVDSDRFRGVPFFFRTGKRLTEKGTHVNIVFKQMDSIFGEPLAPNILTIYIQPTEGFSLSLNGKQVGEEFNLAPNSLDYRTDATATGASP

SEQ ID NO: 24413 - protein, 144 aa, Streptococcus mitis
FKNLYHPTDEELKEYFIRGQYRSGKIDGMKYISYRSEPNVNPESTTETFASGAFFVNSDRFRGVPFFFRTGKRLTEKGTHVNIVFKQMDSIFGEPLAPNILTIYIQPTEGFSLSLNGKQVGEEFNLAPNSLDYRTDATATGASP

SEQ ID NO: 24414 - protein, 487 aa, Oryza sativa Indica Group
MVSQVVAEEKPQLLSKKAGCNSHGQDSSYFLGWQEYEKNPFDPVSNPSGIIQMGLAENQLSFDLLEEWLEKNPHALGLRREGGGASVFRELALFQDYHGLPAFKNALARFMSEQRGYKVVFDPSNIVLNAGATSANEALMFCLADHGDAFFIPTPYYPGFDRDLKWRTGAEIVPVHCASANGFRVTRAALDDAYRRAQKRRLRVKGVLITNPSNPLGTASPRADLETIVDFVAAKGIHLISDEIYAGTAFAEPPAGFVSALEVVAGRDGGGAGVSDRVHVVYSLSKDLGLPGFRVGAIYSANAAVVSAATKMSSFGLVSSQTQYLLAALLGDRDFTRSYVAENKRRIKERHDQLVDGLREIGIGCLPSNAGLFCWVDMSHLMRSRSFAGEMELWKKVVFEVGLNISPGSSCHCREPGWFRVCFANMSAKTLDVAMQRLRSFVDSATGGGDNAALRRAAVPVRSVSCPLAIKWALRLTPSIADRKAER

SEQ ID NO: 24415 - protein, 531 aa, Francisella tularensis subsp. holarctica
MSIEIVKVPDIGDYDNVDVIEVNVAVGDVIAEEDSLITLETDKASMEVPSPFAGKITKLTVKVGDKVSQGTAIMEVEVESAADQAATTQSQPQTTSSAPVAATTNQIVDVEVPDIGDYDSVDVIEVSVKVGDEIAEEDSLITLETDKASMEVPSPVAGKVVEVITKVGDKVSQGSLILKVKTQGSAPVEQTSSQPAPAKQEQAKQQAATPAAPTPASSSVNEYAVDNSNAHASPAVRKLARILNIDLSKVKATGRKGRVTKEDCYNYIKHAVTQVQTGKVAASGSGLDLLDDPVVDFAKFGEIETQPLSRINKISAKNLHRNWVKIPHVTFYDDADVTDLEEFRNAKKAFAEKKGIKITPLSFLVKAAAVALQEFPRFNSSLSNDGENLIIKKYYNIGFAADTPAGLMVPVVKDADKKGIIEISKDIMELAGKARDGKLGAKDMTGATFTISSLGVLGTTSFTPIINMPEVAIMGVSKTAVKPIWNGKEFIPRTMLPLSLSTDHRVIDGALAAKFLTRYCQILSDLREIIM

SEQ ID NO: 24416 - protein, 385 aa, Thermus thermophilus
MRGLSRRVQAMKPDAVVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 24417 - protein, 144 aa, Streptococcus mitis
FKNLYHPTDEELKEHFIRGQYRSGKIDGMKYISYRSEPNVNPESTTETFASGAFFVDSDRFRGVPFFFRTGKRLTEKGTHVNIVFKQMDSIFGEPLAPNILTIYIQPTEGFSLSLNGKQVGEEFNLAPNSLDYRTDATATGDSP

SEQ ID NO: 24418 - protein, 470 aa, Francisella tularensis subsp. holarctica
MSDIKTQVVVLGSGPGGYSAAFRAADLGLEVVLVERYAEIGGVCLNVGCIPSKAMLHIAKVINEARHLESLGIIEMGGLKINRENLLKYKDGVIGKLTGGLKGMAQMRKVKIVQGYGKFTSDKELAVEAADGKVTKIAFYNCIIAAGSSVIKLPFVPEDDRIIDSTGALEMKEIPETMLVVGGGIIGLEMAQVYSELGTKITVVEFADQLMNGVDKDLVKAYQKVNSRYDVRLKTAVTAMEAKEDGIYVTMEGDHPAKDERFDRVLMAIGRKPNGKLIDAEKAGVKVDERGFIPVDKQLRTNVPHIFAIGDIVGQPMLAHKAVPEGRIAAEVISGLNHSFDPLVIPSVAYTDPEVAWVGETETSAKAKGIKYEKGVFPWAASGRSLSIDRSEGITKILFDENHKIIGASIVGTHAGELISEAALAIEMGCDAEDIALTVHPHPTLSESLMMATEVYEGTATDLPPQKKKK

SEQ ID NO: 24419 - protein, 621 aa, Cryptococcus neoformans var. neoformans JEC21
MDNTVAPSKGKKPGGARPNPGTRPESGGPARPTGAGGVPKLSIPPDNVPGMHVDQAGQGGWHQPASLPSLALRPMRPSPTPSSSSRPKLSLTPLTPTIPASSSSAPSSASPAPPNRPALLNAHSARGYGERNTPSLKLSIPGASSVGPGFSTEHDYPLELPDDTDALSSELKTPTPGRPAGGGLNLSLSSLSLTSSEDANPTLQARGRDYDEGESSYGYGCVGNGLIGPGGDAISAMTEDIRQALSRNRFETGSDRGGARSRAGSLMSDSSRATAGRDRSDSASLYNAASRRESPSASLSGGSARQSLDLPRAAEEVNEQKESPVFDPEGLVMMRRLGEGTGGSVDMVQDRATGRIMAKKVITRTSNPMVHKQLLRELEILNSCASPFIVEHYGSFLADHDSSIGILMEYCEAGSLDSLLGKMKKKSMRCSEHVLGRVASSVLKGLDYLHQRRIVHRDIKPSNILITRQGAVKLCDFGVSGELVESLAGTFTGTSFYMAPERIQNKPYSIKADVWSLGMTLHEIAHLRFPFPPEGENQSVAPIELLSYIVTAPVPVMIDDLSVGRVWSEPIKDFMGQCLIRSGTDRPYPWQLLQHPFIVASEAKKVNMAKWVAALCNWPLS

SEQ ID NO: 24420 - protein, 188 aa, Nicotiana tabacum
TTVAMATLVPPSTTVPPAAGSKSPAVESEKVDYLNLPCPIPYEEIHREALMSLKPELFEGLRFDFTKGLNQRFSLSHSVFMGPTELPTQSTDIVKIPTAHYEFGANFIDPKMMLIGRVLTDGRVNARVKCDLSENLSLKANGQLTGEPHMSHGMVNFDYKGKDYKTQFQLGNGALFGASYIQSVSPHL

SEQ ID NO: 24421 - protein, 421 aa, Oryza sativa Japonica Group
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASFNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQTVVPERVLKMEEAIKSRNFESFARLTCADSNQFHAVCLDTSPPIFYMNDTSHRIISLVEKWNQSEGTPQVAYTFDAGPNAVLIAPNRKNATILLQKLLYYFPPQDNDLSSYMVGDKSILSDAGLKSIEDVEALPAPAETKMPSQKFKGDVSYFICSRLGAGPKVVTDESLALIDSVTGLPKGV

SEQ ID NO: 24422 - protein, 458 aa, Chlorokybus atmophyticus
MAAATLSSSISSCSGLRAQAKAATPTKARRVAAAPSRHVLGGFSGLKAVRNNVLLVQKRPTDEDRLFAQAAAPQASSSAGKQETTMKLRVAINGFGRIGRNFLRCWHGRGDDSPLEVIAINDSGGVKQATHLLKYDSMLGTFNANVGIIDEKTISVDGKPITIVSNRDPAQLPWAELGIDLVIEGTGVFVDGPGAGKHLQAGAKKVLITAPAKGAEIPTYVVGVNEDQYDHDASAIISNASCTTNCLAPFVKVLDEEFGIVKGTMTTTHSYTGDQRLLDASHRDLRRARAAALNIVPTTTGAAKAVALVLPQLKGKLNGIALRVPTPNVSVVDLVINTEKKGITADQVNAAFRKAAEGPLNGVLAVSDLPLVSIDFRCSDVSSTIDSSLTMVMGDDMLKVVAWYDNEWGYSQRVVDLAHIVANNWPGQKADSEEESGDPLDKYCATNPEADECRVYDE

SEQ ID NO: 24423 - protein, 693 aa, Bacteroides thetaiotaomicron VPI-5482
MKRIIHICLWLLTGIFAEVSLSAQNPFIYHKGKTYKDVAAYRMEEIIDLNTHTPSTPILYEQQVPEHQSTLSYKVALPLYVRGIFFSRDSRPGDYQWPNNTNRLLPWMFNHLEDLTRSDYASIPSNALPSASGDALLLELADGEYLFAKAIAGSNSLSWFQVNQDGTLTLYVSTLGEDALTGRLPLLIFRKSSSVYHVFSDAYDSLIADKAVSALRKRADKQYFNAFDYLGWCTWEHYHYDIDETKILNDIDAIEASGIPVRYVLIDDGHIANKNRQLTSLVPDKKRFPNGWSRIMKRKQADKIRWIGLWYSLSGYWMGISAENDFPPEIRQVLHSYNGSLLPGTSTEKIETWYEYYVRTMKEYGFDFLKIDNQSFTLPLYMGGTQVIRQAKDCNLALEHQTHRMQMGLMNCMAQNVLNIDHTLYSSVTRASIDYKKYDENMAKSHLFQSYTNTLILGQTVWPDHDMFHSCDTVCGSLMARSKAISGGPVYLSDSPSEFIADNIRPLIDETGKIFRPAAPAIPTPESILTNPLQSGKAYRVFAPTGDEALSVICYNLNTSPAYREVESFVKREDYLLRESTGKSADSSCDSILAFNWEKQSAEVLNASERKIKLSGFIDSLFHLCPIRKGWAVIGIQEKYLSPATVQILKRTTEKLILDVHCTGTLRIWADSHGKQELRSIPIKKAGRIEIMK

SEQ ID NO: 24424 - protein, 204 aa, Oryza sativa
  misc_feature (173)..(173): Xaa can be any naturally occurring amino acid
  misc_feature (201)..(201): Xaa can be any naturally occurring amino acid
MAERGGSRGGFGTRGSRGEGGEGRGRGRGGGRGRGRGRRGQGPKDDSSKGWTPVTKLGRLVNDGKIKSLEEIYLFSLPIKEADIIDRLLPDLKDEVLKIMPVQKQTCAGQRTRFKAIVVVGDGKGHIGLGVKCSKEVATAIRGAIILAKLSVIPVRRGYWGNKIGAPHTVPCXVTGSCGSVLVRLIPAPRGTSLVCAPVPXKLL

SEQ ID NO: 24425 - protein, 594 aa, Synechococcus sp. CC9311
MAQIDLTRRTKIVATIGPATESPERIRELIQAGATTFRLNFSHGDHSEHAERIATIRQVAHELGAHIGILQDLQGPKIRLGRFEEGPITLAKGDQFALTAKQVRCNQTVATVTYDKLAEEVTAGSRILLDDGRVEMKVERVDGVDQTLHCSVTVPGVLSNNKGVNFPDVQLSVRALTTKDRQDLAFGLQQGVDWVALSFVRNPSDMQEIRELIRKHGYSTPVVAKIEKFEAIDQIDAILPLCDGVMVARGDLGVEMPAEEVPLLQKDLIHKANSLGIPIITATQMLDSMASSPRPTRAEVSDVANAILDGTDAVMLSNETAVGDFPVEAVETMATIARRIERDYPQRPIDTHLPSTIPNAISGAVSSIARQLNAAAILPLTKSGATAHNVSKFRPSTPILAITSEVNVARKLQLVWGVTPLLIETQKSTTATFTLAMAYAQEIGVVKDGDLCVQTAGTLAGISGSTDLIKVGIVSAVLGRGTGFGSGSVSGKVRIAISASDCARLEPGDILVARDTSADYLDGIRDAAAVITEQPGEDSHAAVIAKRLGVPVITGVVNATQDLREGEVVTLHVKDGVVHRGTGSNLAMKLDTML

SEQ ID NO: 24426 - protein, 268 aa, Physcomitrella patens subsp. patens
MGTLGRVVFSLGKAARTTGQALDRLGSRLQGGNTFKDEVSKHQTVLSIFDKKPVIEESAFVAPGASVVGEVEIGKQSSVWYGCVLRGDVHHIKVGSETNIQDNTVVHVAKTNVSGNVEPTVIGNRVTIGHNSVLHACTVEDESFVGMGSTILDGAVVEKGAMVAAGSVVTQRTRVPSGQIWAGSPAKFLRELTDEERSSLSENAILYMDLAEVHASENRKTAGEIEADKALRRKWEIQSDDYDSHLGIVRSKRPEIHFPNKMISKGPH

SEQ ID NO: 24427 - protein, 366 aa, Geobacillus kaustophilus HTA426
MGLTAGIVGLPNVGKSTLFNAITKAGAESANYPFCTIEPNVGVVEVPDERLDVLTEMFRPKRTVPTVFEFTDIAGIVKGASKGEGLGNKFLSHIRQVDAICQVVRCFSDENITHVAGKVDPLADIETINLELVLADLETIDKRIERVGKIAKQKDKEAAFEYDILRRLKETLEDGKPARTLEFTDEEMKVVKQLHLLTIKPMLYVANVGEEDIADPSGNPFVKDVREFAKRDNAEVIVVCAKIEEEIAEFSDEEKRQFLQELGIEQSGLDQLIRAAYSLLGLATFFTAGEQEVRAWTFRKGMKAPQCAGIIHSDFERGFIRAETVSYDDLVAAGSMAAAREAGKVRLEGKDYEVQDGDIMHFRFNV

SEQ ID NO: 24428 - protein, 566 aa, Oryza sativa
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGGRPDPSQTPRKIIVSGSRARSVDLDAMDEKELLKLNLQKMQNRVVELERACKEMRGQMSKMAKGGRPSSSFGAAACHQTGGRGLPRLC

SEQ ID NO: 24429 - protein, 179 aa, Zea mays
MSSPRRRIETDVMKMLMSDYEVTLVNDNMQEFYVRFKGPAETPFEGGTWKVHVELPDTYPYKSPSIGFVNRIFHPNIDELSGSGCLDVINQTWSPMFDMINIFEVFLPQLLRYPNPTDPPNGEAAALLIREPKSYDAKVKEYVQKYASKEAADEAGAESEDDDELSSVASFGDDDDEQQ

SEQ ID NO: 24430 - protein, 674 aa, Triticum aestivum
  misc_feature (60)..(60): Xaa can be any naturally occurring amino acid
  misc_feature (180)..(180): Xaa can be any naturally occurring amino acid
IDRHKESSALRNPWRPRRRPLPRAPGPSPPPPRPRRPPPGAPMPLPQQTPPRHPPPPPPXPPPSSPPSAPPPKLAASPPPASPPPTPPAALPTPKPAPSTSTPPPTTTSPPAPPPKRSPAAAPPPTTTAPAPRPTPAAPAPRTEPTSPSPTASPPAHAPPHAKPSPPPSAGHRPQLPTPXRPSTRPTSTAGAPTSPPRSPPGSGAARPPPRRAAATGGASNGVVIAVGAVLAFLVVTLIAAAVLYTKKRRRGRDDYRAGFRSPPYSSSELPPSGSVPSGGGSANAAMLSSADPSVHTNYSAGSPRLKACLSDMSVGNSRFFTYQEMYQITDGFSPRNLLGEGGFGSVYKGRLPEGKDVAVKQLRDGSGQGEREFQAEVEIISRVHHRHLVSLVGYCIANSQRLLVYDFVSNDTLHYHLHGQGRPVLEWSARVKIAAGAARGIAYLHEDCHPRIIHRDIKSSNILLDNNFDALVADFGLARLALDAVTHVTTRVMGTFGYMAPEYASSGKLTEKSDVFSFGVVLLELMTGRKPVDSSRPLGDESLVEWARPLLSRALETGKLEGLVDPRLERNFNEVEMFRMIESAAACIRHSSSKRPRMSQVVRVLDSLADIDLTNGVQPGQSELFNVANTADIRMFQQMVQGNQDDSSAFSQYSWISRSRADAEATSSNSRIL

SEQ ID NO: 24431 - protein, 483 aa, Streptomyces avermitilis MA-4680
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 24432 - protein, 316 aa, Streptomyces avermitilis MA-4680
MRYDSPLAAVGNTPLVRLPRLSPSEDVRIWAKLEDRNPTGSVKDRPALHMIEQAEKDGRLTPGCTILEPTSGNTGISLAMAAKLKGYRIVCVMPENTSQERRDLLGMWGAEIVSSPAAGGSNTAVRVAKELAAEHPDWVMLYQYGNPDNAGAHYATTGPEILADLPSVTHFVAGLGTTGTLMGVGRYLREQKPDIKIVAAEPRYDDLVYGLRNLDEGFVPELYDASVLTTRFSVGSADAVTRTRELLQQEGIFAGVSTGAALHAAIGVGNKAVKAGETADIVFVVADGGWKYLSTGVYTAATTEEAIATLQGQLWA

SEQ ID NO: 24433 - protein, 554 aa, Pseudomonas putida GB-1
MAYYRTPHDVTALPAWQALQQHRDAMQGFSMREAFAADAQRFDQFSLSCCGLFLDYSKNLITEQSRDLLVNLANEVGLQDAIKSMFAGEIINASEGRPVLHTALRRPVGDKLSVNGVNVMPEVHKVLNQITELVGRIHDGLWRGYSEKPITDVVNIGIGGSFLGPELVSEALLPYAQRGVRCHYLANIDGSEFHELSANLRAETTLFIVSSKSFNTLETLKNAMAARTWYLAQGGSEAELYRHFIAVSSNKAAAVAFGIREENIFPMWDWVGGRYSLWSAIGLPIALAIGTANFKELLSGAYTMDQHFQTAPFDKNMPVLLALLGVWYGNFWGANSHAILPYDHYLRNITKHLQQLDMESNGKSVLQDGTPVKTDTGPVIWGGVGCNGQHAYHQLLHQGTQLIPADFIVPVVSFNPVADHHQWLYANCLSQSQALMLGKTREEAEAELRGKGLNEADIEKLAPHKVIPGNRPSNTLVVERISPRRLGALVAMYEHKVFVQSVIWGINAFDQWGVELGKELGKGVYQRLVGSLEESAEDGSTQGLINYFRGRHRG

SEQ ID NO: 24434 - protein, 281 aa, Campylobacter jejuni subsp. jejuni NCTC 11168
MIMQKYLEKANVLIEALPYIRKFNSKIILIKYGGSAMENEELKHCVMQDIALLKLVGLKPIIVHGGGKDISAMCEKLGVKSEFKNGLRVSDKATIEVASMVLNHINKNLVHSLQNLGVKAIGLCGKDGALLECVKKDENLAFVGTIQKVNSKILEELLEKDFLPIIAPIGMDENFNTYNINADDAACAIAKALRAEKLAFLTDTAGLYEDFNDKNSLISKISLEQAKILAPKIEGGMHVKLKSCIDACENGVKKVHILDGRVKHSLLLEFFTDEGIGTLVG

SEQ ID NO: 24435 - protein, 395 aa, Campylobacter jejuni subsp. jejuni NCTC 11168
MKMDYKEQSHIIPTYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGVKGGQFIAFKHSFHGRTLGALSLTANEKYQKPFKPLISGVKFAKYNDISSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKSVKVAKVIQKCQENALLLISCGENDLRFLPPLILQKEHIDEMSEKLRKALKSF

SEQ ID NO: 24436 - protein, 172 aa, Oryza sativa Japonica Group
MEQNNDTFVLHSELERKSKIKPVHVVDVPGHAGLKPKLDEVLPQAAGIVFAVDAQDFLSTMQVVAEYLYDILTKATVVKKRIHVLIFCNKTDKVTAHSKEFIKKQLEKEINKLRESRKDISSADTTDEVKLGNPGETFYFSQCQNRVTVAEGAGLTGNVSAVEQFIREYVKA

SEQ ID NO: 24437 - protein, 214 aa, Staphylococcus epidermidis ATCC 12228
MVKILPSLLSIDFLNLKEELQLLETAKVDGLHFDVMDGKFVPNISIGIPILDAVRQQSHLPIDVHLMIEQPENYINLFAEHGADMISVHVESTTHIHRAIEQIKQLGKKAGVVINPGTSVETILPILSIVDYVLVMTVNPGFGGQTFIEQCVTKIEQLNQLKHENHLTFDIEVDGGINDQTSKRCVEQGATMLVTGSYFFKQEDYAKVTSLLKE

SEQ ID NO: 24438 - protein, 283 aa, Pseudomonas fluorescens PfO-1
MTDTSVLLHKHSFVELGARQRAKALLDAGTFRELLDPFQRVMSPWLERQGVVPQADDGVVIAKGSLDGLPVVIAAIEGAFQGGSLGEVGGAKIAGALELAAEDNREGIPTRAILLLETGGVRLQEANLGLAAIADIHAAIVDLQQYQPVVGVVAGSVGCFGGMSIAAALCSYLLVTQEARLGLNGPQVIEQEAGIEEYDSRDRPFIWSLTGGEQRFASGLVDRYVADDVAQIRGQVGELLYQGLPAQPRSQRAEWFLKRLTSLDTDKQIEPSVVRDLYQGERS

SEQ ID NO: 24439 - protein, 144 aa, Streptococcus pseudopneumoniae
FKNLYHPTDEELKEHFIRGQYRSGKIDGMKYISYRSEPNVNPESTTETFTSGAFFVNSDRFRGVPFFFRTGKRLTEKGTHVNIVFKQMDSIFGEPLAPNILTIYIQPTEGFSLSLNGKQVGEEFNLAPNSLDYRTDATATGASP

SEQ ID NO: 24440 - protein, 71 aa, Triticum aestivum
GAKNGAIAGTVVAVPTLVGCRVLPWVKANFNYSAQAFIISAACISGFFITADKTILRNGRQNTIGKLDKST

SEQ ID NO: 24441 - protein, 185 aa, Ostreococcus tauri
ALEKISEDNTRFTYTADGHTFNYVVENGFTYLVVADSSQGRHVPFACLDRIKAEFARDHASEAQDAIAHSLNKSFAPRLKEHLEFCSANPEAVSKVSQVQQQVSQVKEIMMDNIEKVLDRGEKIEILVDKSDALRFQADNFHKTGRQLRRRMWCENMKMKVLVGVIVLAILFTLIFTLCGKKCTG

SEQ ID NO: 24442 - protein, 379 aa, Bacillus cereus ATCC 14579
MVAEKGTQTKTQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRGIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAVWLPVSTLSGSKTPKVTTGLRRK

SEQ ID NO: 24443 - protein, 287 aa, Triticum aestivum
  misc_feature (77)..(77): Xaa can be any naturally occurring amino acid
  misc_feature (97)..(97): Xaa can be any naturally occurring amino acid
  misc_feature (123)..(123): Xaa can be any naturally occurring amino acid
  misc_feature (139)..(139): Xaa can be any naturally occurring amino acid
  misc_feature (166)..(166): Xaa can be any naturally occurring amino acid
  misc_feature (195)..(195): Xaa can be any naturally occurring amino acid
MAKEVSEEPEHAAPAHKDYSDPPPAPLFDMGELRMWSFYRALIAEFVATLLFLYITVATVIGYKVQSAADPCGGVGXLGIAWAFGGMIFVLVYCTAXGISGGHINPAVTFGLLLARKVSLLRXAVMYIVAQCAGGIVGXGIVKGIMKDAYQANGGGANMVASGFSXGTALGAEIVGTFVLVYTVFSATDPKRSAXRDSHVPVLAPLPIGFAVFMVHLATIPITGTGINPARSLGAAVIYNKKAAWDNHWIFWVGPLVGALAAAAYHQYILRAAAIKALGSFRSSRSN

SEQ ID NO: 24444 - protein, 129 aa, Ostreococcus tauri
MSDAKVRRASCSVKRANRGRSTVRVEAVSVEIRHEGQTVTVEVGDDDNILDVALDAGLDLRYDCKMGVCMMCPAKVLSGAVDQSGSMLSDDVEEKGYALLCCAKPEGEGVVIQTVSEDELLEEQLCSSG

SEQ ID NO: 24445 - protein, 138 aa, Synechococcus sp. CC9311
MIGLEWKTLMNPVSRRLSDIERTGPADSDRSDLCALHPSMASYKVTLVSESEGLNKTIEVPDDQYILDAAEEQGIDLPYSCRAGACSTCAGKITAGTVDQSDQSFLDDDQIEAGFVLTCVAYPTSDCTIKTHAEEELY

SEQ ID NO: 24446 - protein, 651 aa, Bacteroides thetaiotaomicron VPI-5482
MISVEGLSVEFNATPLFADVSYVINKKDRIALVGKNGAGKSTMLKILAGLQNPTRGVVAVPKDVTIGYLPQVMILSDVRTVMEEAELAFEHIFELQANLERMNQQLADRTDYESEEYHQLIDRFTHENDRFLMMGGTNFQAEIERTLLGLGFSREDFNRSTSEFSGGWRMRIELAKLLLRRPDVLLLDEPTNHLDIESIQWLENFLSTRANAVVLVSHDRAFLNNVTTRTIEITCGQIYDYKVKYDEFVVLRKERREQQLRAYENQQKQIQDTEDFIERFRYKATKAVQVQSRIKQLEKIDRIEVDEEDNSSLRLKFPPASRSGNYPVICEDVRKAYGQHVVFHDVNLTINRGEKVAFVGKNGEGKSTLVKCIMGEIDFDGKLTIGHNVQIGYFAQNQAQMLDENMTVFDTIDRVATGDIRLKIRDILGAFMFGGEASDKKVKVLSGGERTRLAMIKLLLEPVNFLILDEPTNHLDMRSKDVLKEAIREFDGTVILVSHDRDFLDGLATKVYEFGGGTVKEHLGGIYDFLQKKKIDSLNELQKGVSLSTSPTASAKGNEADTEQPSENRLSYEAQKELNKKIKKLERQVADCEASIEETESAIAILEAKMATPEGASDMQLYERHQKLKQQLDTTVEEWERVSMELEEVKN

SEQ ID NO: 24447 - protein, 535 aa, Idiomarina baltica OS145
MAILASKVNTRDEQFKANYESMQAVVDDVNAKVEQIKQGGGPKYQERHLSRGKLLPRQRINKLLDAGSAFLEIGQFAAWDVYDDYVPAAGVVAGIGRVEGVECMIVANDATVKGGTYYPLTVKKHLRAQEIAERCHLPCIYLVDSGGANLPRQDDVFPDKDHFGRIFFNQANMSAKGIPQIAVVMGLCTAGGAYVPAMADESVIVKEQGTIFLAGPPLVKAATGEEVSAEELGGADVHTRVSGVADHFAHNDEHALALARRSVARLNRPAPTQLDQRESKPPRYDAKELYGIVGTDLRKPYDVHEVIARVVDDSDFDEFKANYGTTLVTGFARIHGYPVGIVANNGILFSESAQKGAHFIELCAQRKIPLVFLQNITGFMVGKKYEAEGIAKHGAKMVMAVSCAKVPKFTVLIGGSYGAGNYGMCGRAYDPTLMFMWPNARISVMGGEQAAGVMAQVTKDNLARKGEQLSAEDEAKLKQPIVEQYEKQGHPYYASGRLWDDGIIDPAQTRDVLGLSIAASLNAPIEDSQFGVFRM

SEQ ID NO: 24448 - protein, 222 aa, Zea mays
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKTATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKCGSK

SEQ ID NO: 24449 - protein, 815 aa, Haemophilus influenzae R2866
MRVLKFGGTSLANPERFSQAAKLIEQAHLEEQAAGVLSAPAKITNHLVALSEKAALNQSTDTHFNEAIEIFYNIINGLHTENNQFDLNGTKALIDAEFAQIKGLLEEIRQAGKVEDAVKATIDCRGEKLSIAMMKAWFEARGYSIHIVDPVKQLLAKGGYLESSVEIEESTKRVDAANIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLESIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSEGKSADEFMAMLPQLDEEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 24450 - protein, 576 aa, Candida albicans SC5314
MSRKSSIDMPKEASSPECYTTSTSSNEISEKPGMWRNFKDSFKPPVPIDDIENGSISSTQLKGGQNVPLQQSLKKRQLQMIALGGCVGSGLLVASGAALRNGPASLLIAWFIVSTFLYCTMQCLAELSSTFPVSGSFAVYSIKFIDPSWGTAMGYNYALFWVVVMPLELVASSMTIKFWPSNINTSVWVAVFYVLIIGTNLFGGTRAFGETEFVASVIKLLGIVGFNILAIVLICGGGDQGYIGGKNWHPPFTTGVKGVISVLLTATYSLAGTELVGLTSAEAAGDARKVLPKAIKQVLWRILIFYLLTLTLVGFLVPASDPQLIGGGSGASASPFVIAIREGGIKGLPSVFNVVVLVALLAIANSAVYGFSRTILALAEQGVAPSIFKYVDRQGRPLAGIATSAIVGLLSFVSASKQQEQVFDWLVALSGLSTFFTWGSINAAHIRFRIAMKVQGRSLDELPYKANTGVLGAYYGLIMNVAVLALQFWLAVWPIGGKPDATYFFKQYLAAVLVLAVYVIHKVATRNWKFMVDYKDMDLDSGRSDIDIDILKQELEEEREAYKRQPWYYKFYQFWC

SEQ ID NO: 24451 - protein, 552 aa, Methanothermobacter marburgensis str. Marburg
MMVEDLVYRYALMNAVKHKGKANPGAVMGAVMSNEPELRKRAPEVKEAVQAAVEKVNSLKPEEQQSEMERLGLEIRERKQKKRQGLRNLPDVKGEVVLRFAPNPSGPLHIGHARAAILNHEYARRYDGKLILRIEDTDPRRVDPEAYDMIPSDLEWLGVEWDETIIQSDRMEIYYEYTERLIERGGAYVCTCTPEAFREFKNEGKACHCRDLGVRENLQRWREMFEMPEGSAVVRVKTDLQHPNPAIRDWVSMRIVEAEHPRTGTRYRVYPMMNFSVAVDDHLLGVTHVLRGKDHLANSEKQEYLYRHLGWEPPVFIHYGRLKMDDIALSTSGAREGIVEGKYSGWDDPRLGTIRAIARRGIRSDAIRKLMVEIGVKIADSTMSWKKIYGLNRNILEEEARRYFFAADPVRFEIEGLPGPIRVERSLHPDKPELGNRILELNGDVYLPRGDLREGPLRLIDAVNVIYSDGELRYHSEGIEEARELQAAMIHWVPAESALKAVVVMPDASEIEGVIEGDASELEVDDVVQLERFGFARVDSSGERLVFYYAHK

SEQ ID NO: 24452 - protein, 641 aa, Coccidioides immitis RS
MPSILSDADKETVRRTVPKPSNKILTAAVARLYVAYPDRHKWTYTGLQGAAVIANDLVGHTFWIKLVDISPSGRGVLWDQELYDGFSYNQDRTFFHTFELEECLAGLSFADEKEAKTFLKKVSEREKHASKETKATPFASARGQGPAPVANGKTHHRFGLGSLLGHRSSSAPTPPPPAAAAAAESIIPPKPAPSELLPAPVRHAGPDGKASPMDTVDPSWKGLLDELLAMGITEEQIANNADFIKSYIESKQNDDQQQSAENPSQELARKPKAAPPAPPTVPPSKASLTPQNTGGTNSRGAPPPPPPPRKPHADTTPPSPPRESPPASPKRDPSPLRPRFRAPPPIVDAGKYAYTSAPAARNRAASGSHTAGAAPMPPPRPPKTPEDGPSRLQPPAPPFRGEIKSPTPPAPSSRGPVPLPPRHDVSPLQPPPLPPKTPHATSPSLVPPPPPPRAAATPPPPPPPRQAQPPSSTATTPQPPPPPPPPPSSSGPPAPGPPAPPPPPPPPSAAPAPPPPPPPPMPSSSGPPPPPPLPSSGGAAPPAPPAHPPRPGSAAMPKPVPGKDDLMASIRAAGGGGLRRVKDSEKRDRSAVVLPGASTETPAASSAAPPAGGMMGALQEALAKRKQKVSGSDDEKSDDDW

SEQ ID NO: 24453 - protein, 96 aa, Brassica napus
  misc_feature (76)..(76): Xaa can be any naturally occurring amino acid
  misc_feature (86)..(86): Xaa can be any naturally occurring amino acid
MPAVIRSFVSGGNVVRSSLLQHLRVVNPAIQPSVLSTRYESTQPARMEEHGFESTSISDVINAKGKSADGSWLWCXSDETGYDAGXSMTQHNVGAL

SEQ ID NO: 24454 - protein, 390 aa, Pseudomonas putida GB-1
MAHPYSARSRAIEPFHVMALLARANELQAAGHDVIHLEIGEPDFTTAAPIVAAGQAALAAGHTRYTAARGLPALREAIAGFYGQRYGLSIDPERILITPGGSGALLLASSLLVDPGKHWLLADPGYPCNRHFLRLVEGGAQLVPVGPEVNYQLTADLVERYWDKDSVGALVASPANPTGTVLGREALASLAKATHERHGHLVVDEIYHGLTYGMDAPSVLEVDDSAFVLNSFSKYFGMTGWRLGWLVAPPGAVADLEKLAQNLYISAPSMAQHAALACFQPETLAIFEERRAEFARRRDYLLPALRELGFRIAVEPQGAFYLYADISAFGGDAFAFCRHFLETEHLAFTPGLDFGRHLAGHHVRFAYTQSLPRLEEAVQRIARGLRSWQG

SEQ ID NO: 24455 - protein, 323 aa, Bacillus halodurans C-125
MEMLAKVSQFFSKYFAFFVIIISFVAFLSPDHFTWITPHITILLGVIMFGMGLTLKLSDFRIVLQKPIPVLVGVLAQFVIMPLVAFALAYAFNLPPELAAGLVLVGACPGGTASNVMVYLAKGNVAASVAMTSVSTMLAPIVTPFILLLLAGQWLPIDAKAMFVSILQMIIVPIALGLFVRKMAPNAVDKSTAVLPLVSIVAIMAIVSAVVGANQANLMSGAALLFLAVMLHNVFGLLLGYLTAKFVGLDESTRRAISIEVGMQNSGLGAALAGNHFSPLAALPSAIFSVWHNISGPVLVSIWSRSAKSAQKRQSDADMKVDL

SEQ ID NO: 24456 - protein, 317 aa, Oryza sativa Japonica Group
MADSPSPRLDEEDAFGRDFNSSPSPTAPPARSGEKRPFGDLDDDDEDVFASKKVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVET

SEQ ID NO: 24457 - protein, 77 aa, Staphylococcus epidermidis ATCC 12228
MENFDKVKDIIVDRLGVDADKVTEDASFKDDLGADSLDIAELVMELEDEFGTEIPDEEAEKINTVGDAVKYINSLEK

SEQ ID NO: 24458 - protein, 1173 aa, Crocosphaera watsonii WH 8501
MTANIQKSYSYKVGGSLGFAHPTYVERQADQTLLTALTAGKFCYVFNCRQMGKSSLRVRAMHQLQAKGMSCASVDITSLGSDISQKQWYSGIITQLFLGFNLIGKVNLKVWLREREELSGIQKFSEFLEEVLLVHCLGEKVYIFIDEIDKILSLNFSLDDFFSVIRFFYNQRAENPKFNRLVFSLFGVATPTDLIQDKTQTPFNIGFPIELTGFTSKEIEPLAPGLTSITDHPQKVLETILDWTGGQPFLTQKVCDLLLTQGKIIPAGQEKEWVNKLIREFIVENWESHDEPVHLKTIRERIFRQEKRAGRLLGMYQQILQEGFLKSDESSEQTELRLSGLVVKKDGNLVAYNKIYQSVFNEEWVKKELEKIRPYSEMLTGWMNSNYEDDSRLLRGKLLKDALSWAMDKSLSDLDYRFLTESQNLDKREAEINLKAQQKANEILTRANQKAQRMIRLGMTILGVSVVGATFAFTQARIAFQKQREAQIGTQLERSGDSAWRQFEFEQLDGLVSAIEANQELKTIVKDQRLLEDYPATSPISALEQILNRIQEKNKLIGHQDAVNSVTFSRDGQWIATASSDGTIRLWNRQGQQKAVLRGHEGNIYGVAFSPDSQTLATAAQDDTARVWNLQGKQLALLKGHDASVYSVTFSPDGQRLATTSRDNTARVWDKQGNSLLVLKGHKKSVDDVAFSPDGQYIATASRDGTAKLWDSQGNLRKTLQEKATPLFSISFSLDSQRIAAGARDGTIYIWDKQGNLTLNLNGHQELVNSVVFSQDGNLIASGSSDGTARLWSTEGEEITVLKGHQDPIYDVALNYQSTELATASSDGKVKLWAVKQTLNNGFNTLDSYVTSADFSEDGKFLAIADERGQVYTWNLQGKNLEKFEAHGSGINAIRIAPNGQIMATTANNGVVKIWDLQGNLLGNLRDNKVRIYSLDFSSDSKKLVLANRSGEVELWDLEKQPYQLIKKFQAHEDTINHIVFNQNSTKIATASADKTVKVWDKQGNLERLLSGHQERVNWLSFAPNSNYLATASEDSTIKLWDSKGELITTLKSDLFPISRVNFSSDGEYFVTASQDGTVRLWDREGKLHTKMKGYQESLESVKFTPDNQTILTVARDGTVKMWPLESEFVRLSSLLEQGCHWLKDYLISHPSEQPKLSSCPHSNDAKKPLTQY

SEQ ID NO: 24459 - protein, 144 aa, Streptococcus oralis
FKNLYHPSDEELKEHFIRGQYRSGKVDGMKYISYRSEPNVNPESMTETFASGAFFVDTDRFRDVPFFFRTGKRLTEKGTHVNIVFKQMNSIFGEPLAPNILTIYIQPTEGFSLSLNGKQVGEEFNLASSSLDYRTDATATGASP

SEQ ID NO: 24460 - protein, 244 aa, Streptococcus pneumoniae TIGR4
YYSTKLEKEKIMTKTILVTGGTSYIGSHTVKALLNAGYQVHVLDNLSTGNRAAVDSRASFKELDVYDASALKAYLEENQIDAVLHCAGEIVVSESIENPSKYFTANVAGMNQVLKVLSEVGIQKIMFSSTASLYGNNCIDKPVTEDTLLDPVNPYAETKLMGERMIYWMANRYDWKYVIFRYFNVAGAEMDASNGLRVKNPTHIIPNINKTALGQNDSLKIFGDDYDTRDGSCIRDYIYVLDLA

SEQ ID NO: 24461 - protein, 452 aa, Bacillus halodurans C-125
MKEKVQMQRRYFHTNETKELSFRMNMLKKLKKALLDYENELLAALKEDLNKSTSEAFLTELGPLYHEITFMLKHLPTWMKRKKVKTPLTHVGSKGYIHYEPYGVVLIIAPWNYPLQLAINPLIGAIAAGNCAIVKPSELTPATSGVITKMIENTFPEEYVCSVEGGVETSQALLAEKMDYIFFTGSVGVGKHVMKAASRHLTPVTLELGGKSPAIVCEDAQIAVTAKRIAWGKFLNAGQTCVAPDYVLVHDSKKEDFLKALQTEIKTLFQRKIDRGDYPTIVSDRHFARLIRFLQDGDVVIGGQHERNKRFIAPTVLTNVSWESPVMEDEIFGPILPVFSFSELDEVIEKVRERPHPLALYLFTESKETEEKLIHSLSFGGGCINDTVMHLATPYLPFGGVGESGMGAYHGEESFYTFSHRKSVLKQPTSVDLPIRYKESKLSLKMLRKLFQ

SEQ ID NO: 24462 - protein, 260 aa, Oryza sativa
MDKYGLNTDCLTLTRFFLSEQHKHQDATGELTQCLNAILTAVKALQSAVRRAGVAKLYGLAGNTNSTGDDQKKLDVLSDELFINMLKSSFTTCVLASEEDEDIIIVEKERRGKYIVCFDPLDGSSNIDCLVSIGSIFGIWKRPDEDEDKEPTVKDALQPGSKMICSGYALYGSACMIVLATDSGVNGFMYDPSIGEFILTIPDIKIKPRGNIYSINEGYTQAWDDVVKEYVARKKNPTSGKAYGSRYVGSMVADLHRTLV

SEQ ID NO: 24463 - protein, 1001 aa, Zea mays
MTEVAIRQSLPERGLRRAGGRPLPEGPSVFMVCSEDACQPCLGALGRDLASARVEWGGTQPASRTSASSANSGRKSSTTPIPEPFRRTAGRFHLQGQGILEGVCWWVRAGQRRRWMETGAAAAPASRADGVRRCKILVPWRFQPGFVRQPLKQAANDAAVNGDGGNTAGAPDAKSCRADGAASDGGETNVFRDAKKFGSGRATRGKNGEVDGGEEHSERCTSSQSLKSPDVENGGRPGPGDACNLGESVRGGWVKSSPLEGTGNSRGANGGVEAGEDYNLGSSNCDASWKDARTQEFRGAGDGAACDPEVIESNVGAEKCFAKGLKKPFMDQTGSKSNGSSAPGLESEDPEGNVGLEDSSYQAAKGCSMGDGAAKENEATANGCSSATPGSIGNGTYVRKGRKAAVPWRFQARYKRSFSDAFGSNNESPDLPAYMFDSSSTQCTPATRSTVRCYASAHSGVRVSAMNNFSVKGDTECKKRKTNNDYQDESMLNNGGVVVRERIMRSLQDLRLIYRDLLDEEDNSREKVLNVRPDLKAYRIFRERFCTDFDDEKYIGSVPGIYPGDIFHLRVELCVVGLHRPHRVGIDCTKKDDGTTVAVSIVSCAQSHDIKYNLDAFVYTGLVAVAVNQRIEGTNLALKKSMDTNTPVRVIHGFTTFNGKKKFPAYIYGGLYLVEKYWREKEHGDRYVYMFRLRRMEGQKHIDIQEILQTGNSGSNDNVIIKDLSRGLERVPLPVVNKISDERPMPYCYISHLRYPRNYRPTPPAGCNCVGGCSDSNKCACAVKNGGEIPFNDKGRIVEAKPLVYECGPSCKCPPTCHNRVGQHGLKFRLQIFKTKSMGWGVRTLEFIPSGSFVCEYIGEVLEDEEAQKRTNDEYLFAIGHNYYDKSLWEGLSRSIPSLQKGPGKDDENETGFAVDASEMGNFAKFINHNCTPNIYAQNVLYDHEEISVPHIMFFACDDIRPNQELAYHYNYKIDQVHDANGNIKKKKCLCGSVECDGWLY

SEQ ID NO: 24464 - protein, 493 aa, Glycine max
TQRFLSVQSWKTSRTSRNLRNSKPGSGIAHAVLTSDIDEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGMTFGDGFVEVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPKGSDLKAMRVDTTLLGLLPQEAEKHPYIASMGVYVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASLVAEGKVPIGVGANTKIRNCIIDKNAKIGRNVIIANTDGVQEADRAKEGFYIRSGITVTLKNATIKDGTVI

SEQ ID NO: 24465 - protein, 326 aa, Bacillus cereus ATCC 14579
MQKETVIIIGGGPCGLAAAISLQKVGINPLVIEKGNIVNAIYNYPTHQTFFSSSEKLEIGDVAFITENRKPVRNQALAYYREVVRRKSVRVNAFERVEKVQKDGEAFQVETTKRDGSKEIYIAKYIVVATGYYDNPNYMNVPGEELKKVAHYFKEGHPYFDRDVVVIGGKNSSVDAALELVKSGARVTVLYRGIEYSPSIKPWILPEFEALVRNGTIQMHFGAHVKEITEHTLTFTVDGEALTIKNDFVFAMTGYHPDHSFLTKMGVQIDEETGRPFYTEDRMETNAENIFIAGVIAAGNNANEIFIENGRFHGDAIAQTIASREK

SEQ ID NO: 24466 - protein, 404 aa, Mycobacterium avium subsp. paratuberculosis K-10
MREAPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRLHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 24467 - protein, 324 aa, Bacillus cereus ATCC 14579
MKRILVLHTGGTIAMEEDKETGVVQPGEENPLLKFIPDLEADVDLIVEDVFHLPSPHMTPSEMLQLQVIIDERVKQDNIHGVVITHGTDTLEETAYFLDLTVQATIPIVVTGAMRSSNELGADGLYNFLSAVKVASCDEAAEKGVLVVLNDEIHCATNVTKTHTSNVATFQSPQYGPIGMVTKRGVVFHHALVHHETYTINKVSKNVVVLKAYAGMDDTLLAAIENLPVDGIVIEALGQGNLPPRTLPSLERLLNRGIPVVLVSRCFNGIVQDVYSYEGGGKHLKDMGIVFTYGLNAQKARIKLLVALENTNSHESIQNMFMHE

SEQ ID NO: 24468 - protein, 415 aa, Mesostigma viride
MAAATFANFTGLKATSLFSAKSADEAFAARLAPVQATGSSQKQVTEAKLKVAINGFGRIGRNFLRCWVGRENSPLEVVAINDSGGVKQAAHLLKYDSMLGTFKADVKVISETALAVNGKTIEIVSSRDPLQLPWAKMGVDLVIEGTGVFIDGPGAGKHIIAGAKKVLITAPAKGAEIPTYVVGVNEKDYTHDVSNIISNASCTTNCLAPFAKVLDENFGIVKGTMTTTHSYTGDQRLLDASHRDLRRARAAALNIVPTSTGAAKAVSLVLPKLKGKLNGIALRVPTPNVSVVDLVINTTKKGMTAEEVNAAFRKEANGAMKGILAVSDLPLVSIDFRCSDVSCTIDSSLTMVMGDDMVKVVAWYDNEWGYSQRVVDLADIVANNWPGMVQETGSDPLETFCNTNPDADECRVYND

SEQ ID NO: 24469 - protein, 456 aa, Photobacterium sp. SKA34
MSINAEQNLHLRCEGDTNTTEARKQWYRNLNSPQTEAMLEQDSQYFLHQSMSTPCMNALAAADGIYIEDINGKRYMDFHGNNVHQLGYGHPKVVERIQQQLTELPFAPRRFTHQSAIDCAKKLTEIAGGELERVLFAPGGTSVVGMALKLARIITGNAKVISLWDSFHGASLDAISVGGEACFRQGMGPLMAGVERIPPPITYRGAFPREDNSDLQYADYLEYVIEKEGGVGAFIAEGIRNTDVQVPSKAYWQRIREICDKHNVLLIIDDIPNGMGRTGHWFSYQAFGIEPDILCIGKGLGGGVVPFAALITKDKYNQAADISLGHYTHEKSPIGCAAALATIDVIESEKLLAKVKQDQDYVSERLFQMKKSYSVIGDIRGIGLLWGIELVTNRLTKTRAHDAAEQVLYRCLELGLSFKVSQGNVLQLSPPLIIKRKDLARALDIVEQAISEVIIN

SEQ ID NO: 24470 - protein, 286 aa, Triticum aestivum
  misc_feature (245)..(245): Xaa can be any naturally occurring amino acid
  misc_feature (254)..(254): Xaa can be any naturally occurring amino acid
MSTPSDPAASAQPPSTAATSSSGLTFKLHPLVIVNVSDHYTRVKAQASFPAEAPSPGKAQASCSAEGSSAPAEPPRVFGCVIGVQRGRTVEIFNSFELVLDPVTGTLERAFLEKKLELYKKVFPEFYVLGWYSTGSDVQDTDILIHKALMDINESPVYLLLNPAINHSQKDLPVTIYESELHVIDGGPQLIFVKSNYTIETVEAERISVDHVAHLKPSDGGSATTQLAAHFKGIQRAIKMLNTRXRVIQKTLVXLQKGDAPGTIPLGQFNLVKDSHYEFKKSQMIS

SEQ ID NO: 24471 - protein, 371 aa, Oryza sativa Japonica Group
MTYGPVLLCGLCLCLSPLPTRRLLSPSPSASLTTTTVRCSKGEMAVVKCIRVHELGGPEVLRWEQVEVGEPKEGEIRIKNTAIGVNFIDVYYRQGVYSAPLPFVPGREAVGVVTAVGPGLTGRKVGDVVAYAGNPMGSYAQEQIIPASVAVPLPPSIDHNTAAAIMLKGMTAHVLLRRVYKVQSGDCVLVHAAAGGVGSLLCQWANALGATVIGTVSNEEKAAQAAEDGCHHVIIYTKEDVVTRVKEFTAGKGVNVVYDSVGKDTYKGSVECLAWRGMLVSFGQSSGRPDPIPLSDLASKSLLVTRPSLMHYTATRDELLESAGEVFANVGSGVLRIRVNHTYPLSQAARAHADLQARKTTGSILLIPDDA

SEQ ID NO: 24472 - protein, 229 aa, Thermotoga maritima MSB8
MGGKTKKHAMRLFDRIAEKYDLLNRILSFGMDTKWRKRVVELILEVNPEKVLDLATGTGDVARLLKRKAPHLEITGLDSSSKMLEIAEKRLKDGEFIVGDAHNLPFYDRSFDAITVAFGFRNFSDRRRVLRECRRVLKRKGRLVILELLPPNTKRFTGKIYSFYLKTWVPFVGGLFSGDFHAYRYLSTSVLNFLTPDQIVEMMKEEGFEVSFEPLFFSVAGIFIGDLIW

SEQ ID NO: 24473 - protein, 350 aa, Arabidopsis thaliana
MSSTAASSTVGGGGSSEISGVKKTSKRPKYSRFTQQELPACKPILTPRWVILTFLVAGVVFIPLGVICLFASQGVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGLQ

SEQ ID NO: 24474 - protein, 277 aa, Brassica napus
  misc_feature (108)..(108): Xaa can be any naturally occurring amino acid
CKYGLTCRFNHTKPNSDVPPSAPELNFLGLPIRPGEIECLFYMRNGSCKFGADCKFNHPDPTTLGGTDSPSFHGNNGGSVGSFSPKSTFQPSSTSWSSPRHANGTAPXIPSMLSQSRGASSQAPEWIGYQATSMYPSERSVFSTSTTYLMNNSTAETSIFTPYKYQKPAEEFPERPDQPDCSYYLKTGDCKFKFTCKYNHPKNRLPKQPPFALNDKGLPLRPDQVICTHYSRYGICKFGPACRFDHSIQLPDSTGSSHVVVEPPQVGAHGNESDGWN

SEQ ID NO: 24475 - protein, 430 aa, Robiginitalea biformata HTCC2501
MVIKEPKSKKPVKQGMLDNVMRQFDHAADLLELNPNIRKILEVTNNELLVHFPVRMDDGTVKIFTGYRVQHNNALGPYKGGLRYHPTVDIDAAKALAMWMTWKTSLAGLPFGGAKGGIQLDPSRYSQEELQRITRRFTFALGDNIGPELDIPAPDVNTTAQTMAWILDTYMSTKSPAERSTNLHVVTGKPIGAGGSAGRDRATGYGVYLTIKFWAETRGHTLHGKTFAVQGFGNVGYWASHFLEEEGGVLIGVQDASGTLYRAEGIDVGELAEYARANRGRIHGFSKASPIDSGDFFGLDCDILIPAALGNQITAKNAPDIKASLIAEGANGPTDVSAEAILLEKQVDIIPDILCNSGGVIGSYFEWLQNKNSEIWPMEEVMDRLEKKMRESFNRVTAEAEERQVDWRSAAFIIAIERLADAYTQRGIFP

SEQ ID NO: 24476 - protein, 464 aa, Oryza sativa Indica Group
MAAARSVGMEAEVAALRGRFAAGGTRGAEWRAAQLRGILRMAAEAEAEIALVKSSCKFALKNLKKWMKPQKVTAPLMTFPSTARVAAEPLGVVLIISAWNYPFLLSIDPIIGAIAAGNAVVLKPSEVAPATSSLLAELLPRYVDGSCIKVVEGGVAETTTLLEQKWDKIFYTGNGKVGRIVMASAAKHLTPVVLELGGKCPVVVDSNVNLHVTAKRIAAGKWGCNNGQACISPDFIITTKSFAPKLLEALEKVLEKFYGRDPLRSSDLSRIVNSNHFNRLKKLMDDENVSDKIVFGGQRDEHQLKIAPTIFMDVPLDSGIMKEEIFGPLLPIITVDKIHESFALINSMTKALAAYLFTKDSKLQEQYEAAISAGGMLVNDTAVHLTNQYLPFGGVGESGMGAYHGRFSFEAFSHKKAVLVRRFAGEAAARYPPYSPAKLKILRGVLKGNLGAMIKAILGFPRGK

SEQ ID NO: 24477 - protein, 689 aa, Arabidopsis thaliana
MVERGKRTHNRFRDNNNDNNRNQRRRLSYESEEKKIDNKDDLVVVYRILCPSGVMGSVIGKSGKVINLIRQETRARIKVVDPFPGCSERVITIFCSVSEKKDIVDIEYSELDYSVPLCSAQAALLKVHDAIVASLATAAENTKIDRDDFRECRLLVPSSQCSIVIGKSGSIIKNIRGRTRANVKVVSKDVSDPSHTCAMDFDNIVMISGETESVKKALFAVSAIMYKVSPREQIPLDTTVQEVPASIIIPSDLSIYPQAGLYPSQDSIFQHGANVSSFIGTLPQGYGENAANPVPVFSASALPVVHGFGGSSRSEKLAIKVICSSSKIGRVIGKGGLTIKGIRQASGSHIEVNDSRTNHDDDCVITVTATESPDDLKSMAVEAVLLLQEKINDEDEDKVKMQLLVSSKVIGCIIGKSGSIISEIRKRTKADIHISKGNNTPKCADPNDELVEISGEVSNVRDALIQIVLRLRDDVLRDRETGSRNQPPARSENNNFFSSSSSNTGLALPQSFMSSVPQVASVDFNRRPETGSSMSMLPSSGGIYGYGSFPVGNTSYGSNSSYSSNLYGGLPQSTTMEVRIPANAVGKVMGRGGGNLDNIRRVCLIFIFIFPSSLLSDCHSFIRLFFPLSYITFSHGMCPLSLSLSQISGAMIEISDSKNSHGGRVALISGTSEQKRTAENLFQAFIMST

SEQ ID NO: 24478 - protein, 357 aa, Synechococcus sp. CC9311
MPQHRVVLLPGDGIGPEITAVAKQLLEAVSTRHGFSLEFSEAPIGGSAIDATGEPLPASTLEACKAADAVLLAAIGSPRFDSLPREKRPESGLLALRAGMELFANLRPVKIVPALIGASSLRPEVVEGVDLMVVRELTGGIYFGQPKGRVQADGEERAFNTMTYSDSEIDRIARVAFKLACERRGQLCSVDKANVLDVSQLWRDRVEGMKSDYAAVDVSHLYVDNAAMQLVRDPRQFDVVLTGNLFGDILSDISAMLTGSIGMLPSASLGSEGPGLYEPVHGSAPDLAGQDKANPMAMVLSAAMMLRTGLKQNAAADDLEHAVDRVLAAGFRTGDLMSEGCTALGCQAMGEELLKTL

SEQ ID NO: 24479 - protein, 175 aa, Triticum aestivum
MEHKEAGCQQPEGPILCVNNCGFFGSAATMNMCSKCHKEMVMKEEQAKLAASSFDSIVNGGDGGKAPVVAAVAASAEVAVAQVDVKALVVQPAADVAGTRNSSRFLSPRLLGPSRCSTCRKRVGLTGFNCRCGNLYCATHRYSDKHECKFDYRAAAMDAIAKANPVVKAEKLDKI

SEQ ID NO: 24480 - protein, 348 aa, Oryza sativa Japonica Group
MDVLRKQASKFKEQVAKQQQAVIKQFSTTGYEHSDAVVIDEVELQRHQQLEKLYTSTRSGRDFQKDIVRAAEGLVSIGIRHVEVGTKFSEDCYRYGGESSASDEALAKAASLYGGALRNVEKEYEEFNRILSSQTIDPLRAMAAGAPLEDARGLAQRYSRMRHEAEILSAEIARRKQRVREAPLAEHTTKLQQSESKMIEHKASMAVLGKEAAAALAAVESQQQRITLQRLVGMVEAEKLFHLRLAAILDDVEAEMSSEKQKRESAPPTIHSHKRAEKAQYFLAEAVHNFNGTTEKELSLIVGDYVVVRQIAPNGWAEGECKGVAGWFPAAYVERRENIPPNKVFPQA

SEQ ID NO: 24481 - protein, 408 aa, Bacteroides fragilis
MDACFMGLGYIGLPTAIIAAKHGVKVTGVDINPKVVEMTNEGKLHIIEPGMQDILEEVVANGMLTASTIPTVSDAYFMVVPTPFKGNHEPDISYVEAATRAIIPFLKEGDLYVIESTSPVGTTGKMADLIFSLRPELRCKIYIAYCPERVLPGNVIYELVHNDRVIGGIDERSTDKAIEFYSQFVKGKLHKTDCKTAEMCKLTENSSRDVQIAFANELSLICDKAGINVWELIDLANKHPRVNILQPSCGVGGHCIAVDPYFITADFPIESQIIAKAREINNYKAFWCAEKVENEMLKFEIKYGRKPIIAMMGLAFKPDIDDLREAPAKYITTKVMQSCNNADILVVEPNVVEHKVFKLTNYKDAYAKADIIVFLVAHSVFKTLLYDDNKVILDFCGIYKKQLSRSPL

SEQ ID NO: 24482 - protein, 462 aa, Silicibacter pomeroyi DSS-3
MATYDVIIIGAGPGGYVCAIRCAQLGLKTAVVEGRETLGGTCLNVGCIPSKALLHASHSLHEAQHNFAKMGLKGKSPSVDWKQMLAYKDEVIEGNTKGIEFLFKKNKIDWIKGWASIPAAGKVQVGDDTHEAKNIIIASGSEPASLPGVEVDEKTVVTSTGALELGKIPKSLVVIGAGVIGLELGSVYARLGAEVTVVEFLDVITPGMDGEVQKTFQRILKKQGLTFVMGAAVQKTEIARGKAKVTYKLLKKDTEHEIEADTVLVATGRKPYTAGLGLDKLGIEMTQRGQIKVGKDWQTNVPGIYAIGDVIEGPMLAHKAEDEGMAAAEQVAGKHGHVNYGVIPGVIYTTPEVANVGATEESLKAEGRAYKVGKFMFMGNGRAKANFASDGFVKILADKETDRILGAHIIGPAAGELIHEVCVAMEFGASAEDLALTCHAHPTYSEAVREAALACGDGPIHS

SEQ ID NO: 24483 - protein, 398 aa, Silicibacter pomeroyi DSS-3
MVPTLGESVTEATVSTWFKKVGDSVAQDEMLCELETDKVSVEVPAPASGVLTEIVAAEGATVNASAKLAVISGSASGASPAPAAPAAAVTPAVATGKDIANAPSAEKAMAEAGITPAQVTGTGRDGRIMKEDVTAAVAAAAAAPAPAAAAPAPAAAPRAPALAEDAAREERVRMTRLRQTIARRLKDAQNTAAILTTYNEVDMTEVMALRNTYKDAFEKKHGVRMGFMSFFTKACCHALKEVPEVNAEIDGQDIVYKNYVHMGVAAGTPQGLVVPVIRDADQMSFAEIEKAIAEKGKRARDGKLSMAEMQGGTFTISNGGVYGSLMSSPILNPPQSGILGMHKIQDRPMVINGEIKIRPMMYLALSYDHRIVDGKGAVTFLVRVKEALEDPRRLLMDL

SEQ ID NO: 24484 - protein, 466 aa, Synechococcus sp. CC9311
MVSASTNEAFQAADLKTLRTPVVSGQTRPEAWRRLQLKRLSDLLDRHEADILQALRVDLAKPGLEGMFEIVALLQELKVTRRRLKAWMRPRRIPVPIPQRPGRAQLIREPLGCVLVIGPWNYPFMLTLQPLISALAAGNTVVLKPSEHAPATAALITRLITEEFPSDVVRVVNGDGSIAAALVDLGFDHIFFTGSGAIGAKVLAGAARHLTPVTLELGGKNPAVVLDSADLAVTARRLIWGKSVNAGQTCIAPDHLLVQTSIREQLVNALKEERRNLYGEDPLASADLSCLIHDRHFQHLEGLLTAAREEGRILFGGECDRQRRKIAPTLIEVHSDQDPLMAAEIFGPLLPMLTVESLDGAITRIQQQDKPLAIYLFGGDHNDQSEVLQRTSSGGVCFNDVLMQKGVPELPFGGVGPSGMGSYHAETGFRTFSHERSVLSRPFFLDLRLRYPPYTLNPALFRRFVS

SEQ ID NO: 24485 - protein, 539 aa, Bacillus halodurans C-125
MSVMFDPQSYPYPSRRNVVYAKNGMVATSQPLAAQAGLDILKAGGNAIDAAIATATALTVLEPTSNGIGSDAFALVWTKGKLHGLNGSGRAPMSLTMEAVKAKGYEQELPPYGVIPVTVPGAPGAWAELAKMYGNLPLAASLAPAIRYAEEGYPVTPTLAKYWKAAYDRFKTEWTDDVYQPWFDTFAPKGRAPRVGEVWRSQGHADTLRSIAESNGESFYRGELADQIHAFFDKHGGYLTKEDLACYRPEWVEPISIDYRGYRVWEIPPNGQGLVALEALNIVKGFEFYHKDTVDTYHKQIEAMKLAFVDGMKYVTEPSDMSVSVEQLLSDEYATERRKEIGEQALTPEPGTPPRGGTVYLATADGDGNMVSFIQSNYMGFGSGVVVPGTGIAMQNRGHNFSLDPNHDNALKPGKRTYHTIIPGFLTKNDQPIGPFGVMGGFMQPQGHMQVMMNTIDFGLNPQAALDAPRWQWTNGKQVQVEPTFPVDIAQALVRRGHKIQVVLDEGAFGRGQIIWRDPTTGVLAGGTEPRTDGQVAAW

SEQ ID NO: 24486 - protein, 501 aa, Streptomyces avermitilis MA-4680
MSASAPQAHGPAATGTVTTDVPARLDRLPWSRWHWMIVIGLGTVWILDGLEVTTVGNIAGRLSEDGSGLSITSAQVTGVAAALYVAGACAGALFFGWLTDRFGRKKLFMVTLVVYLSATALTALSFNSWWFFTFRFLTGFGIGGEYAAINSAIDELIPAKYRGRVDLIINGSYWLGAIGGALLSIVMLDTSIFPKDLGWRLTFALGVVLGLVILLVRRHVPESPRWQFIHGRGEDAEALVSSVEREIEQEKGEPLPRAESEITIEQRKSIGFGLIAKTVFGRYPKRAVLGLALFIGQAFLYNAITFGFGAILTTFYDVPTGGTGYYFAVIAAGNFIGPLLLGKLFDTVGRRIMIASTYLLSGLLLFGTAWLFDRGSLSAMTLTACWCAVLFFASAGASSAYLTVSEVFPMETRAMAIAFFYALGTAAGGISGPLVFADLTESGVVGDTVLAFQIGAGLMCAAGLVAAFLAVNAERRSLEDIAEPLSVAQTTAPAPASASGT

SEQ ID NO: 24487 - protein, 510 aa, Solanum tuberosum
MANIDIAGIMKDLPNDGRIPKTKIVCTLGPSSRTVPMLEKLLRAGMNVARFNFSHGTHEYHQETLDNLKIAMQNTQILCAVMLDTKGPEIRTGFLTDGKPIQLKEGQEITVSTDYTIKGNEEMISMSYKKLVVDLKPGNTILCADGTITLTVLSCDPPSGTVRCRCENSATLGERKNVNLPGVVVDLPTLTEKDKEDILEWGVPNNIDMIALSFVRKGSDLVNVRKALGPHAKRIQLMSKVENQEGVINFDEILRETDSFMVARGDLGMEIPVEKIFLAQKMMIYKCNLAGKAVVTATQMLESMIKSPRPTRAEATDVANAVLDGTDCVMLSGESAAGAYPELAVKIMSRICIEAESSLDNEAIFKEMIRCTPLPMSPLESLASSAVRTANKARAKLIVVLTRGGSTAKLVAKYRPAVPILSVVVPVLTTDSFDWSISDETPARHSLVYRGLIPLLGEGSAKATDSESTEVILEAALKSAVTRGLCKPGDAVVALHRIGSASVIKICVLK

SEQ ID NO: 24488 - protein, 570 aa, Zea mays
KLGTRKLGPLEGYSRAAAVGGGRKAGAAAACRPLRGEKDRLQLLHRALRLGGRRRAGVLLLLAVVSAAVFSSLFAVVKDDSNSISIVNNYEVPNAIQKSVFPSTSLPLMMSGNQYSTSVVNKIELPNRLHLTYANFTHPCEGFSVPPPLVDKKRTGPRPCPVCYVSVDQAFALMPLQASPSPVVKNLNYVSEDGITANLSNLGSGFGGHPSLEQRNKSFNINESMTVHCGFVRGKKPGQGTGFDIKDDDLLEMEQCRELVVASAIFGNYDMIQHPRNISESLKANACFYMFVDEETEAYVKNSSSLYNNNKVGLWRLVVVRNLPYEDPRRTGKIPKLLLHRLFPNVKFSVWIDAKLQLVADPYLLLERFLWRKNTTFAISRHYKRFDVFEEAEANKAAGKYYNASIDYQIEFYRNEGLTHYSPAKLPITSDVPEGCVIIREHIPITNLFTCLWFNEVDRFTSRDQISFSTVRDKIRARVGWMPEMFMDCERRNFVVQAYHRELLEQMIASGRMPPSGAVVVTDAAPSRKVRAGSRKATPSKKPSVKRKKEKKSSSRRRLPKPVAGGLGAM

SEQ ID NO: 24489 - protein, 162 aa, Triticum aestivum
  misc_feature (125)..(125): Xaa can be any naturally occurring amino acid
MAPIGVGSTLPDGQLAWFDENDQMQQVSIHSLAAGKKVILFGVPGAFTPTCSNQHVPGFITQAEELKAKGVDEILLVSVNDPFVMKAWAKTYPDNKHVKFLADGAAAYTKALGLELDLTEKGLGXRSRRFALLADDLKVTVANVEEGGQFTISGAEEILKAL

SEQ ID NO: 24490 - protein, 448 aa, Oenococcus oeni PSU-1
MSLIASIYAREVLDSRGNPTVEAEVYSEDGFFGRGIVPSGASTGEHEAVELRDGDKSRYLGKGVTKAVANVNGAIAEALIGKFDVADQRGIDLAMIALDGTPNKGKLGANAILSVSIATARAAAEEAGLPLYQYLGGPNSYVLPTPMMNVINGGVHSDNKVDFQEFMIMPVGAKTVKEAIRMGSETFHNLKKLLEADGKNTSVGDEGGFAPDFANNEEPLQYLVKAIQAAGYKPGKDIALATDVAASELYDADTKKYKLKWSTGEEFTAPEFEKYIEGLVAKYPIVSVEDPLDENEWDDWVEVTKELGKKVQIVGDDFFVTNTDYLKRGIEMGAANAILIKLNQIGTLTETFEAIEMAKEAGYTAIVSHRSGETEDTTIADLVVATNAGQIKTGSMSRTDRIAKYNQLMRIEDELNQGEPEGVSIYKGINSFYNLNADAKKEIQSHQG

SEQ ID NO: 24491 - protein, 316 aa, Lactococcus lactis subsp. lactis Il1403
MTEFITLGEPLVVLASENQDISLDVAEHFSKYLAGAELNVAIGLSRLGHKGIYLSKVGEDSFGNFIIESVKKAEIETTYLTKDKNYSTGFYLKQKVSEGDPKVDYYRKNSAAANLSIAELKALDLSGIKIAHLSGIFPALSETSLKTFQAFNQKLNEADILTIFDPNLRPVLWDNQEKMIRTINDLAKQSQIILPGINEGEILTGSSEPEKIANFYLEQSPLTKIVVVKLGADGAFVKLKNGEQYFVSGFKVAKVVDTVGAGDGFAVGLESALLEGKTLKEAVKRACAVGALAVQSSGDSEGYPTKEELKAFYKEM

SEQ ID NO: 24492 - protein, 257 aa, Oenococcus oeni PSU-1
MVHQLELPSSYLNYNGIMRKPIIIANWKMNFLRDQANLYVKKLIKKLGNKENIEVGIASQDLFLTDLIKLTENTPISIVAQNAYWENFGPFTGETSPKALANVGVDYVMLGHFERRELFNETNSTVNLKVRTALNNGMDVIVDVEELEQVAPVLEGVSEEQMQQIIIGFEPTFAIGTGMSASTKGAEDVAEQIRKTVRKLYGSDVADSTRILYGGSVNRDNLKSLIKQKDIDGVLVGKAALDFQSFWELVEIIENSL

SEQ ID NO: 24493 - protein, 228 aa, Pseudomonas fluorescens PfO-1
MSTIADNILQVSSRIHAATAAAGRDENSVQLLAVSKTKPSEALREAYAAGLRDFGENYLQEALGKQLELADLPLIWHFIGPIQSNKTRSIAEHFAWVHSVDRLKIAQRLSEQRPADLPPLNICIQVNVSGEASKSGCTPQDLPALAQAISALPRLKLRGLMAIPEPTEDRAEQDAAFAAVQKLQAGLDLPLDTLSMGMSHDLESAIAQGATWVRIGTALFGARDYSQS

SEQ ID NO: 24494 - protein, 272 aa, Pseudomonas fluorescens PfO-1
MSNTRIAFIGAGNMAASLIGGLRAKGLEAAHIRASDPGEETRAKVSAEHGIETFADNAQAIDGADVVVLAVKPQAMKLVCEAIRPSLKPNQLVVSIAAGITCASMTAWLGEQPIVRCMPNTPALLRQGVSGLYATGKVSAEQRQQAEELLSAVGIALWLNEEQQLDAVTAVSGSGPAYFFLLIEAMTAAGVKLGLPKETAEQLTLQTALGAAQMAVSSDVDAAELRRRVTSPAGTTEAAIKSFQAGGFEALVEKALGAAAHRSAEMAEQLGK

SEQ ID NO: 24495 - protein, 310 aa, Francisella tularensis subsp. holarctica
MMKMNFIQKYFAIIVIAGVILAISIPSIFIPLKPYITYLLAAIMLIIGLHLQAKDFVKVAANLKGKLLVILFLKLTVTSIAAFIIGKLFGLSLTALIGLVIVGACPGGTASGVMALLARANISLVVSLTFLTTLLAPIFMPLIIYFFFSKSIKLDWFGMFETMAIIVIVPIVLGILISKFTKLNDSTLKKISNIPILLIMLIVMVVTALNKDTMMLVPTDIILSVIILSIFANIFGYLIGRVLGLDIDSRLALLFEFSILDVGLGIVIALAFFGNQAAIAATFYAIWQNIIGPIIVNLVNICRNTKFKSS

SEQ ID NO: 24496 - protein, 340 aa, Bacillus cereus ATCC 14579
MTKITVVGAGSWGTALAMVLADNGHDVRIWGNRPELMDEINTKHENSRYLPGITLPSTIVAYSSLEEALVDVNTVLLVVPTKAYRDVLQEMKEIVTEPITWIHASKGIEPGTSKRISEVIEEEIPEHLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVEAIPDLL

SEQ ID NO: 24497 - protein, 424 aa, Ipomoea nil
MNLFQFLSCFCLACIFVPAIGSTLLFQGFNWESNKQQGGWYNSLINSIPDLANAGITHVWLPPPSHSVAPQGYMPGRLYDLDASKYGNKQQLQALVAALHDKGIKAVADIVINHRCADYKDSRGIYCIFEGGTPDDRLDWGPGLICKDDTQYSDGTGNADTGMDFGGAPDIDHLNPRVQKELSEWMNWLKSEIGFDGWRFDFVRGYAASLTKIYMENTSPEFAVGEFWDSMAYGSDGKPDYNQDNHRNELSQWVQNGGGAVTAFDFTTKGILQAAVLDELWRLKDPNGKPPGLIGISPKNAVTFIDNHDTGSTQSMWPFSKDKVIQGYAYILTHPGVPCVFYDHFFDWGLKDEISKLTSIRSRNGISETSNVEILAADADAYVAKIDDKVIMKIGSKYDVGNLIPPNFNLVTSGQDYAVWEKKI

SEQ ID NO: 24498 - protein, 153 aa, Clostridium difficile 630
MIYEGKLIGKDLKIGIINSRFNEFITSKLLSGAEDCLLRHDVSPENIEIVWVPGAFEIPLVAQKMAKSGKYDAIICLGCVIRGATSHYDYVCSEVSKGIAKVSLDSELPVIFGIVTTENIEQAIERAGTKAGNKGYDCAMNALEMANLFKSLN

SEQ ID NO: 24499 - protein, 213 aa, Triticum aestivum
  misc_feature (53)..(53): Xaa can be any naturally occurring amino acid
  misc_feature (75)..(75): Xaa can be any naturally occurring amino acid
  misc_feature (204)..(204): Xaa can be any naturally occurring amino acid
PISKPTEFLAIPLPSPPRPPPPRGSPERNRDEGFLLSVKSKSWSTRETGCQVXEGPILCVNNCGFFGSAATMNMXCSKCTKEMAMKQEQAKLAASSFDSIVNGGDAAKEHLAAGNTAVAVAHVEAKTLITAQPADIAGPSEAAMENPKGPSRCSTCRKRVGLTGFNCRCGNLYCATHRYSDKHECKFDYRAAAMDAIAKANPVXVKAENSDKI

SEQ ID NO: 24500 - protein, 397 aa, Clostridium difficile 630
MFNTIEEAIEDIKNGKMVIVVDDESRENEGDLLMAAEMATPESINFMATYGRGLICLPATEKKFKSLNIPLMVRENTDTFQTAFTVTIDGADTLTGISAYERAETVKLFCDENSTSKDFKTPGHIFPLIAKTGGVLVRDGHTEASVDLARLAGFKEIGLICEIMKDDGTMARVDDLMIFKEKHNLKIITIKDLIEYRKINETTIEKVSSAFLPTKYGNFEIIGYRDTYSNEEHIALTYGNINIENTLVRLHSECLTGDVFHSLKCDCGLQLESSMKKIVENGSGVLIYMKQEGRGIGLLNKIKAYKLQEEGYDTVEANLMLGFEEDMRDFYMAAQILKNLNIKSINLLSNNPDKINQLEKYGIKIENRIPINEEINDFNKLYLKTKKDKMGHLLDII

SEQ ID NO: 24501 - protein, 369 aa, Triticum aestivum
  misc_feature (255)..(255): Xaa can be any naturally occurring amino acid
MPPPPPTNGGKLTPNLAMDAEGTRLLNLTVLQRLDPAVEDILITAAHVTLYDFNIDLNQWSRKDVEGSLFVVKRNTQPRFQFIVMNRRNTDNLVEDLLSDFEYELQPPYLLYRNAAQEVNGIWFYNQQDCDAVANLFGRILNAYARVPPKAKVPSTKSEFEELEAVPTSAAIDGPLEPPPASTLISDTPDESLANYFGGAASIGSVSSGSMVGRAHPSTETTAASHTPLIMPSAAQSHQIPPPFGGSSAPPLPLXDTNAHASHSTNLVTPAFFAPPSSSSASLAPPISSMMPTAPPLHSTSSSTQHPQYGHGTPLLQPFPPPAPPPSFAPAHNDGSVISRDKVKDALLRLVQSDQFIDLIYRELQNAHM

SEQ ID NO: 24502 - protein, 321 aa, Spirogyra sp. SAG 170.80
KIGINGFGRIGRNFLRCWYEREDSPIEVIAVNDSGGVKNAAHLLKYDSMLGTFKADVKIVDDKTISVGGKNILVVSSRDPLQLPWAELGIDIVIEGTGVFIDTPGAGKHLTAGAKKVIITAPAKGNEIPTYVCGVNADEYSHEAANIISNASCTTNCLAPFVKVLDEEFGIVKGTMTTTHSYTGDQRLLDASHRDLRRARAAALNIVPTSTGAAKAVALVLPNLKGKLNGIALRVPTPNVSVVDLVINTEKKGMTAEEVNAAFRKAADGPMKGILGVCDLPLVSIDFRCSDVSSTIDSSLTMVMGDDMVKVVAWYDNELGY

SEQ ID NO: 24503 - protein, 482 aa, Moraxella osloensis
MTVIQSKLSPNGAEFQANAAAMQTIVDDLKAKLAVIAQGGSKSARAKHVARGKLLPRERVERLLDAGTPFLEVSPMAAYGMYDADIPAAGVIAGIGRVAGIDCMIVCNDATVKGGTYYPMTVKKHLRAQEIARENRLPCIYLVDSGGANLPNQDEVFPDKDHFGRIFFNQANMSAEGIPQIAVVMGSCTAGGAYVPAMSDESIIVKDQGTIFLGGPPLVKAATGEEVTAEDLGGGDVHTRLSGVVDHLAQNDLHALSLARNIIGNLNQQKTPIHHATAQKTPRPPKYDAKELYGIIPTDTRKPFDIRKIIARIVDGSEFDEFKARFGTTLVCGFAHIEGMPVGIIANNGILFSESAQKATHFIELCCKRKIPLVFLQNITGFMVGRKYENEGIARHGAKMVMAVANAKVPKFTVIVGGSFGAGNYGMCGRAYSPRFLWMWPNARISVMGGEQAASVLATVKRSQYHAKGEHWSSEDEEAFKA

SEQ ID NO: 24504 - protein, 435 aa, Dendrobium hybrid cultivar
MSKEFGIEAPSSKIAVSKAHGEDSPYFAGWKAYEENPYDAEDNPDGVIQMGLAENQLSFDLLEEYLEQHPEASSWGSGMSTFRENALFQDYHGLQTFRKAMASFMEKIRGGRSKFDPNRIVLTAGATAANELITFILADPGDALLVPTPYYPGFLRDLQWRTGVTIFPVHCDSSNGFQLTLSSLESAYADAKASNFNVKGLLITNPCNPLGTAASLSLLQDIIFFISDKNIHLISDEIYFGCVFSSTNLFSISDLIANAVSDQIHIVYSLSKDLGLPGFRVGALYSYNDRVVKTARRMSSFSLVSSQTQKLLAFMLSDEEFTVKYIEKNRERLRERYELVVEGLKEAGIECLKGEAGLFCWVNMETLMDEKTPEGELRLWKVIVDELKLNISPGSSCCCSEPGWFRVCFANMSRETKEVALRRLKDFAQKKTKNI

SEQ ID NO: 24505 - protein, 463 aa, Shewanella oneidensis MR-1
MSTGTVVQVIGAVVDVEFPQDAVPQVYDALKITGEGSCNGLVLEVQQQLGGGVVRTIAMGTSDGLRRGLEVVNSGSPISVPVGTATLGRIMNVLGDPIDEAGAIGEEERYVIHRAAPSYEEQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDDDKMTVSRARKIERFLSQPFHVAEVFTGSPGKYVSLKDTIRGFKGILSGEFDHIPEQAFYMVGSIDEAVEKANKKK

SEQ ID NO: 24506 - protein, 435 aa, Dendrobium hybrid cultivar
MSKEFGMEAPLSKIAVSKAHGEDSPYFAGWKAYEENPYDAVDNPNGAIQMGLAENQLSFDLLEEYLEQHPEASSWGPAMSTFRENALFQDYHGLRSFRKAMASFMEKIRDGRSKFDPNRIVLTAGATAANELITFILADPGDALLVPTPYYPGFLRDLQWRTGVRIFPVHCDSSNGFQLTLSSLESAYADAKASNFNVKGLLITNPCNPLGTTASPSLLQDIILFISDKNIHLISDEIYFGCVFSSTNLFSISDLITNAISDQIHIVYSLSKDLGLPGFRVGALYSYNDRVVKTARRMSSFSLVSSQTQKLLAFMLSDEEFTVKYIKKNRERLRERYELVVDGLKEAGIACLKAEAGLFCWVNMKTLMDEKTPEGELRLWKVIVDELKLNISPGSSCCCSEPGWFRVCFANMSRETLEVALKRLKDFAQKKTKNI

SEQ ID NO: 24507 - protein, 397 aa, Silicibacter pomeroyi DSS-3
MNIHEYQAKALLRSYGAPVSDGRVVLRAEDAKTAAGELDGPLWVVKAQIHAGGRGKGKFKEADAGEKGGVRLTKSVEEAAEEAKKMLGRTLVTHQTGPVGKQVNRIYIEAGSGIERELYLALLVDRQTSRISFVCSTEGGMDIEEVAASTPEKILSFSVDPVTGYQPYHGRRIAFSLGLEGPQVKQCVALMGLLYKAFVEKDMEMLEINPLIVAEGGSLKVLDAKVGFDGNAIYRHSDIAELRDTTEEDPKELEASKYDLNYIALDGEIGCMVNGAGLAMATMDIIKLYGAEPANFLDVGGGATKEKVTEAFKIITSDPNVKGILVNIFGGIMRCDVIAEGVVAAVKEVGLQVPLVVRLEGTNVEKGKEIINTSGLNVIAADNLSDGAEKIVKAVKG

SEQ ID NO: 24508 - protein, 459 aa, Salmonella choleraesuis
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSIFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTIRIEPPLTLTIELCEQVLKSARNALAAMQVSVEEV

SEQ ID NO: 24509 - protein, 644 aa, Cryptococcus neoformans var. grubii
MAFSPSLTPSRPAPVPPRRAAITAPYIVRVTDASAAPQSNFSATSYSPSFSYTNSSIPSTKVLDTTRSRTIRSGAASIKEEGLRAFMWSKRWLVLGSAELRIYKNESSPSPVYTVSLEDIQDVQRVDMKPYCVEIETSDKLLYLAFRSDNEVYGWMDDIYSRSPRLGVSQPTNFVHQVHVGFDPKSGGFTGLPPQWSKLLTSSAITKEEAARNPEAVLDVLQFYTQQQAGNVLEGYQQFPMPTVSNQSLTTGAAATRFEGVGLGGQQHQQQQQLRSAPFTAPGSLEAITVVPARPSFETEEKTSAQKEKEKVLNPQHQLLESTRPAMAKFDKEKVTRSPGPTMEKRISTMNEVQIMEKLRSVVSAKDPSQLYSKIRKVGQGASGMVFVAKTLLNGKKVAVKQMDLSQQPRKELIVNEIIVMRESQHPNVVNFLDAFLVRGSELWVVMEYMEGGALTDVIENNKLEENQIAAICLETCRGLQHLHSRSIIHRDIKSDNLLMNTQGEVKITDFGFCAKLTDQKSKRATMVGTPYWMAPEVVKQKEYGAKVDIWSLGIMTIEMIENEPPYLDEEPLKALYLIATNGTPTLKSPEKLSQDLKHFLSVCLCVDVAFRATSTELLKHEFLQLACSVRDLAPLLRFKQDTL

SEQ ID NO: 24510 - protein, 411 aa, Vitis vinifera
MNALAATNRNFRHASRILGLDSKLEKSLLIPFREIKVECTIPKDDGSLATYVGFRVQHDNARGPMKGGIRYHPEVDPDEVNALAQLMTWKTAVVDIPYGGAKGGIGCTPKDLSMSELERLTRVFTQKIHDLIGTHTDVPAPDMGTNAQTMAWILDEYSKFHGHSPAVVTGKPIALGGSLGREAATGRGVVFATEALLAQHGKSIKGLTFVIQGFGNVGSWVARLIGERGGKIIAVSDVTGAVKNQNGLDIVDLLRHKEETGCLTNFSGGDHMDPNELLTHECDVLIPCALGGVLNKENAADVKAKFIIEAANHPTDPEADEILSKKGVVILPDIYANAGGVTVSYFEWVQNIQGFMWEEEKVNNELQKYMTKAFHNIKAMCQSHNCSLRMGAFTLAVNRVACATTLRGWEA

SEQ ID NO: 24511 - protein, 535 aa, Photobacterium sp. SKA34
MTQLTSKVDTTSQWFKNNNHEMQLLVDDLNTHLEIIHQGGGETALAHQKKQGKQPVRQRIDQLLDKHSPWLEIAPFAALNVYSEAVPCAGIIAGIGYIHQHACMIIANDPSVKGGTYFPLTVKKHLRAQEIAEKCHLPCIYIVDSGGANLPHQAEVFADKDHFGRIFFNQAQMSAKGIPQIAVVMGLCTAGGAYIPAMADVSIMVKDQATIYLAGPPLVKAATGEEVTAQELGGADVHCKKSGLADYYANDESHALHLARDAICSCNISSTNTHHDSTASPPKYSMDDIYGIVGTNIRIPFDIRELIARLVDNSEFDEFKAMYGNTLVCGFGAIEGNPVGIIANNGILFSESAQKGAHFIELCCKRKIPLLFLQNITGFMVGKRVEAEGIAKHGAKMVMAVACANVPKFTVIIGGSYGAGNYGMCGRAYDPTLLWMWPNARISVMGGEQAAEVLSQITQAIRQRENKPWTEQDEQQIKQPILELYDKQGHPYYASARLWDDGIIDPKSTRIVLAQALSITQHVPIKDTRFGIFRM

SEQ ID NO: 24512 - protein, 413 aa, Salmonella enterica subsp. enterica serovar Typhi str. CT18
MPQQNYLDELTPGFTPLLAIKEASRCLLCHDAPCSQACPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCDVGGSLSLAQLKAEYRAVLMTVGMSCGSDLPLFEQASHVEIAVDFLQRARQADGDISVPRSALIIGGGDVAMDVASTLKILGCPSVTCVAREELAEFPASEKEFTSTQALGVSIIDGFTPVAVSGNKVTFHHVRHSGELTLEAENIILAVGQHARLDNFAEIKAQHNIIDTHNYQTDDPAIFAAGDIVKGDKTVVYAVKTGKEAAQAIHHYLEEACSC

SEQ ID NO: 24513 - protein, 1040 aa, Shewanella sp. ANA-3
MSYQVLARKWRPATFEQMVGQSHVLHALTNALTQQRLHHAYLFTGTRGVGKTSLARLFAKGLNCEKGVTASPCGVCGSCVEIAQGRFVDLIEVDAASRTKVDDTRELLDNVQYRPTRGRFKVYLIDEVHMLSRSSFNALLKTLEEPPKHVKFLLATTDPQKLPVTVLSRCLQFNLKSLTQQEIGTQLQHILTQEQLPFEHEALTLLAKAANGSMRDALSLTDQAIAFGGGTVMLNQVQSMLGSIDEQHVLRLLKALTDADIGVLMQSCAQVLAYGADAQEVLRSLLELLHQITLTQFAPAAAQQSLYSAQIQAFAEQLAPEQVQLYYQILLTGRKDLPHAPDPKSGLEMALLRAVAFVPEKPVKRWQVEDAAKVSLPAQQPTSTTPASNMPVVEQAVNQAVAEKKTPLTAERDSQTLPQAAISEPMAKSENTTASQQALSAEDMLAVDDAIDDEAELNAALIAEQQVILSQAHSQGFGANAETVSRTEALSTPEAKVDSSAESNSVSMPASNIDAEHNQAATVDTASVDQGPSPATLTEPVALSLDDIEEKTQASVNENADAVAPDEYSAEDYGQYNYAAAPLDAYQDDYSQFMAEEQGGFSGMEESSFNRDSAQSIDHRDVVHKSAADPKSQSFVDNSASTASQASTPPASTTVSLEDDDILSAVLAARDSLLSDLDALSTKEGDGKKPAAEVKLKTPSQNAHTAPVSHATSQNTPSVDASIKPQVANNASDNEFELPFDDDFEAELHLESQSNVTPTPPLDPNDRPPWEEAPVAAMDETHAPAASVNLQTESPVAAQTAVEHLGAAPVAAQISPTDREATRVVQALEQAAGQESEPATQSPEPNTPQQPQAKELTQPKTQPQTQQPASVQSQSSETVQPTSSTALALAQSITGHPLDLHWYKLMASLEIGGRVRQLAVNSICQVQANPLPLLLKPDQKHLAAPVAIEQLEQALTAALGNPRQVEVVIGTDPARETPLEMRKRFHQELLQQARQSLMMDDNVQWLINRFGAELDQDTLLYPPELLAQRSGLIPALPEPE

SEQ ID NO: 24514 - protein, 151 aa, Marinobacter sp. ELB17
MFYKLNDRVPVLEGSGHFVADNASVIGSVRLLDKTSVWFNVVIRGDNELITIGEQSNVQDGAVLHTDPGLPLNIGRGVTVGHKAMLHGCDVGDYSLIGINAVVLNGAKIGKHCLIGANTLVPEHMVIPDGSMVIGSPARVKRQLSPEQQKC

SEQ ID NO: 24515 - protein, 388 aa, Staphylococcus epidermidis ATCC 12228
MNIHEYQGKEIFRSMGVAVPEGRVAFTAEEAVEKAKELNSDVYVVKAQIHAGGRGKAGGVKIAKSLSEVETYANELLGKQLVTHQTGPEGKEVKRLYIEEGCDIQKEYYVGFVIDRATDKVTLMASEEGGTEIEEVAAQTPEKIFKETIDPVVGLSPYQARRIAFNINIPKESVGKATKFLLALYNVFIEKDCSIVEINPLVTTGDGQVLALDAKLNFDDNALFRHKDILELRDLEEEDPKEIEASKYDLSYIALDGDIGCMVNGAGLAMATMDTINHFGGNPANFLDVGGGATKEKVTEAFKIILGDDNVKGIFVNIFGGIMKCDVIAEGIVAAVKEVELTLPLVVRLEGTNVERGKAILNESGLAIEPAATMAEGAQKIVKLVKEA

SEQ ID NO: 24516 - protein, 508 aa, Pseudomonas putida GB-1
MNAPQSPNSTKVEQVKLLIDGQWVESKTTEWRDIVNPASQEVLARVPFATVEEVDAAVAAAHRAFQTWRDTPIGARMRIMLKLQALIREHTKRIAQVLSAEQGKTLADAEGDIFRGLEVVEHAASIGTLQMGEFAENVASGVDTYTLRQPIGVCAGITPFNFPAMIPLWMFPMAIVCGNTFVLKPSEQDPLSTMLLVELALEAGVPAGVLNVVHGGKQVVDAICTHQDIKAISFVGSTEVGTHVYNLGSQHGKRVQSMMGAKNHAVVLPDANRTQTINALVGAAFGAAGQRCMATSVAVLVGKAREWLPDIKAAASKLKVNAGCEPGTDVGPVVSKRAKERVLGLIESGIKEGAKLELDGRDVKVPGYEQGNFVGPTLFSGVKTDMQVYTQEIFGPVLVTLEVDTLDEAIALVNANPFGNGTGLFTQSGAAARKFQSEIDIGQVGINIPIPVPVPFFSFTGSRGSKLGDLGPYGKQVVQFYTQTKTVTARWFDDDSVNDGVNTTISLR

SEQ ID NO: 24517 - protein, 438 aa, Penicillium chrysogenum
MPISKIHARSVYDSRGNPTVEVDVVTETGLHRAIVPSGASTGLHEVVELRDGDKTKWGGKGVLNAVKNVNDVIGPALIKENIDVKDQAKVDEFLNKLDGTPNKGKLGANAILGVSLAVAKAAAAEKGVPLYAHISDLAGTKKPFVLPVPFQNVLNGGSHAGGRLAFQEFMIVPDTAPTFSEGLRQGAEVYQELKALAKKKYGQSAGNVGDEGGVAPDIQTAEEALDLITEAIEQAGYTGQIKIAMDVASSEFYKEDAKKYDLDFKNPESDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADIAVGLRAGQIKTGAPARSERLAKLNQILRIEEELGANAVYAGEKFRTAVNL

SEQ ID NO: 24518 - protein, 315 aa, Gibberella zeae PH-1
MGLTKVKHIILVLSGKGGVGKSSVTTQLALSLTSAGHSVGILDVDLTGPSIPRMLSIEASKVTQVPGGWAPVLVHEADESKGLGSLHAMSLGFLLPKRGDAVVWRGPKKTAMIRQFLKDVLWDETDYLLIDTPPGTSDEHISLAETLQKDATLGQVAGAVVVTTPQAVATADVRKELNFCTKTNIRVLGVVENMSGYVCPHCSECTDIFGSGGGKSMAEEFNVPFLGSVPMDAQFIALLEEGQRPTYPSGTTVGGKDISTKETETRTQEGNLVDKYQDCSLSHVFKDITDKVLVNVGGYSPGPQPSSPGGTSQEH

SEQ ID NO: 24519 - protein, 126 aa, Pseudomonas fluorescens PfO-1
MLRSFLMLAAFFGFTGVGLGAFAAHGLKNRLTPEYLAIFHTGVTYQLVHALALFGVALLATQLQGRLVAWAGISFTIGILLFSGSLYLLTTLGIGKLGIITPFGGLAFLIGWLCLGLAAWRLQPTA

SEQ ID NO: 24520 - protein, 527 aa, Zea mays
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDD

SEQ ID NO: 24521 - protein, 357 aa, Oryza sativa
MRTNTTATVLLAAAVALLLATAARGDGGDGGCGKEDAAAGRDRARARGLKIAAFFSILVCGALGCGLPSLGRHVPALRPDGDVFFLVKAFAAGVILATGFIHILPDAFDNLTDDCLPAGGPWKEFPFAGFGAMVGAIGTLVVDTLATGYFTRALSKKDAATAAAHEGQVHVHTHATHGHAHGSSALVAAVGEDDKETTLRHRVISQVLELGIVVHSVIIGISLGASQNPETIKPLVVALSFHQMFEGMGLGGCIVQAKFKVRSIVTMVLFFCLTTPVGIAVGVGISSVYNESSPTALVVEGILNSVAAGILIYMALVDLLAEDFMNPRVQSKGKLQLGINLAMLAGAGLMSMLAQWA

SEQ ID NO: 24522 - protein, 237 aa, Bacillus cereus ATCC 14579
MQQSKEERVHDVFEKISDKYDVMNSVISFQRHKAWRKETMRIMDVQPGSQALDVCCGTADWTIALAGAVGEQGKVVGLDFSENMLSVGKQKVEALQLKQVELLHGNAMELPFEDNTFDYVTIGFGLRNVPDYMHVLKEMTRVVKPGGKVICLETSQPTMIGFRQGYILYFKYIMPLFGKMFAKSYKEYSWLQESASTFPGMKELAQMFEQAGLERVQVKPFTFGVAAMHLGIKPESK

SEQ ID NO: 24523 - protein, 267 aa, Clostridium difficile 630
MVKIKIFVNELLTDVEENTTAYKVRDSYNNKCDVLVLNGYPIKTDMTLCENDKLTLIQKGVKPSLDELESLLIARHTPNIHNKLKKGKVAILGLGGLGSNIAISLARIGVGELLLIDYDVVEPSNLNRQQYFIDDIGKLKTDAMIENIKKINPFIKLNKRDIFLNKNNMDTIKDSDLIIEAFDDASCKAQVCNYVLINLKDKYLIASSGMAGYYDSNIITTKKIKDRFYICGDFVNEAKFGEGLMAPRVAICANHMANLATQILIDM

SEQ ID NO: 24524 - protein, 148 aa, Bacillus cereus ATCC 14579
MEKTFLMVKPDGVQRAFIGEIVARFEKKGFQLVGAKLMQVTPEIAGQHYAEHKEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 24525 - protein, 287 aa, Phaseolus vulgaris
MAKDVEQVTEQPEYSAKDYHDPPPAPLFDPDELTKWSLYRAAIAEFIATLLFLYITVLTIIGYKRQTDTSIPGNTECDGVGILGIAWAFGGMIFILVYCTAGISGGHINPAVTLGSFLGRKVSLVRALLYIVAQCAGAISGAGLAKAFQKSFYNRYGGGANTVSDGYNKGTALGAEIIGTFVLVYTVFSATDPKRNARDSHVPVLAPLPIGFAVFMVHLATIPITGTGINPARSFGPAVIFNNDKAWDDQWIYWVGPFIGAAVAAFYHQYILRAAAIKVLGSFRSNA

SEQ ID NO: 24526 - protein, 332 aa, Francisella tularensis subsp. holarctica
MQKNILVLGAGAWGTALALQLAYRGHNVRINSWKAEHNEQMLKDNNNHKYLPSIEKFPSRLKAIQDWQANIIEFDSILVATPSSGFKNTILELKECILPQQNIISATKGFCHDSYALLSEIAEDILPTTKFALLTGPSFAKELANQLPTAVVVASKDINYARYVQELFSNENFRCYTTTDIIGAQVGGAVKNVLAITAGIAAGMEFGVNAHAALITRGLAEIKKLGLKLGANSETFIGLSCLGDLLLTCSDNQSRNRRFGLYLGQGMTIQQALKEVNNVVEGYFTAKAVYNFAKKHNVEMPLVFATYRILYEAADPRDIVKELMTRQLKNEN

SEQ ID NO: 24527 - protein, 287 aa, Phaseolus vulgaris
MAKDVEVTERGSFSGKDYHDPPPAPLIDTEELTKWSFYRALIAEFIATLLFLYITVLTVIGYKHQSDLKDHGDACGGVGILGIAWAFGGMIFILVYWTAGISGGHINPAVTFGLFLARKVSLIRAIMYMVAQCLGAICGVGLVKAFQKSYYNRYGGGANSLADGYSTGTGLGAEIIGTFVLVYTVFSATDPKRNARDSHVPVLAPLPIGFAVFMVHLATIPVTGTGINPARSLGAAVIYNKDKPWDDHWIFWVGPFIGAAIAAFYHQFILRAGAVKALGSFRSNPHV

SEQ ID NO: 24528 - protein, 202 aa, Oryza sativa Indica Group
MAISRSSSRQRRWVGSARGRCAEESASAAGRRRSRSRPVGVIWSGVDGGGVGCGCGWAAAASPAGAIGRDASAMSGIKTTTTDFLSSRDKMEKVIGNKWDLYLDLLQADYTEGGSGRQRGEERYWGLMAATEMVCYGGGGRRLADGDADLSVHMWDALDALGLVRYCCRRMLMTHVDLIEKLLNYNNDGSDITSGQSTSGCV

SEQ ID NO: 24529 - protein, 550 aa, Zea mays
MAAHATLPFSCSSTLQTLTRTLSSRGAHQLRGGFLRLPSLAALPRLAHPYRRHVSASAAAAPNGASVEGEYDYDLFTIGAGSGGVRASRFASALYGSRVAICEMPFATIASDELGGLGGTCVLRGCVPKKLLVYASKYSHEFEESRGFGWTYETDPKHDWSTLIANKNTELQRLVGIYRNILNNAGVTLIEGRGKIVDPHTVSVNGKLYTAKHILVSVGGRPSMPDIPGIEHVIDSDAALDLPSKPEKIAIVGGGYIALEFAGIFNGLKSEVHVFIRQKKVLRGFDEEVRDFVAEQMSLRGITFHTEQSPQAITKSNDGLLSLKTNKENFGGFSHVMFATGRRPNSKNLGLEAVGVEMDKNGAIVVDEYSRTSVDSIWAVGDVTNRVNLTPVALMEGGAFAKTVFGNEPTKPDYRAIPSAVFSQPPIGQVGLTEEQAIEEYGDVDVFVANFRPLKATLSGLPDRVLMKILVCATSNKVVGVHMCGDDAPEIIQGIAIAVKAGLTKQDFDATIGIHPTSAEEFVTMRSPTRKIRKSSTDQVESKDEVVSKQ

SEQ ID NO: 24530 - protein, 220 aa, Arabidopsis thaliana
  misc_feature (21)..(21): Xaa can be any naturally occurring amino acid
  misc_feature (25)..(25): Xaa can be any naturally occurring amino acid
  misc_feature (149)..(149): Xaa can be any naturally occurring amino acid
MASSMLSSATMVASPAQATMXAPFXTGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKXEYPNAFIRIIGFDNTRQVQCISFICLQAHQASPVKFPLLLLCKPSKLYPPSLILSLVFLLFSSFLGFNFRT

SEQ ID NO: 24531 - protein, 602 aa, Oryza sativa Indica Group
MAISRSSSRQRRWVGSARGRCAEESASAAGRRRSRSRPVGVIWSGVDGGGVGCGCGWAAAASPAGAIGRDLSVPRYGRKRGRLMVSPGEYLWEIPGGWAAQRIGGRRVLLLSFVLWSLICGLIPLDPKREVILVLSRLFVGVAQGFIFPAIHTVLAQWVPPQERSRSVSLTTSGMYLGAAGGMLFFPSLVKHMGAQSVFFVEAVLGVAWSVIWLKFSSEPPRTDLPKVSMPKVASREKIKAQAGGVVAPRTVKIPWRRIIFSLPVWAIVVNNFTFHYALYVLMNWLPTYFELGLQLSLQDMGSSKMLPYFNMFIFSNIGGVVADHLITRRILSITKTRKLLNTIGFVVSAVALMALPLFRTPSGTVLCSSISLGFLALGRAGFAVNHMDVAPKFAGIVMGVSNTAGTLAGIVGVGLTGSILEGAKASNMDLTNSETWKTVFFVPGVLGLLLKKKQYNSLGLCTPTDMWGHPHLRDTVLSFPLSKRSKTLSDSPLLLPLFSGGGGSASEMIIPVRCFTCGKWQWKTARGGEALGSNGRDRDGLLWGGGRQLADGDADLSMRTWDALDALGLVRYCCRRMLMTHVDLIEKLLNYNTLEKTETAG

SEQ ID NO: 24532 - protein, 263 aa, Glycine max
MTEEPETNPPPPEPSIPSAPAAVEETAAPVTATTSQPSAEIVVPLALAPKRQRRPSVRLGEIGDQRASAHGHELHMRRPSMPPWSWRTPKESSRTSKARTVTNLANGGEEFGNSNSRRGKAKRGPATKRLRTNWAPRATIDENGDEEGFRDFEHEHEQSPVHSMEENGVDYWHVDRNEDPRVRVSENDGVESESQERRKSDGVRSWLYELGLSRYAPMFEIHEVDDELLPMLTLEDLKDMGINAVGSRRKMYTAIQKLRKCLP

SEQ ID NO: 24533 - protein, 369 aa, Averrhoa carambola
PDQMGLAENQLCFDLIEDWVKNNPKASICTPQGVDKFKEIANFQDYHGLPEFRQAVAKFMGRVRGNKVTFDPNRIVMSGGATGANETIIFCLADPGDAFLVPSPYYPAFNRDLGWRTRVQLIPAECDVSNGFKITRSALEAAYQKAQEANVNVKGLIITNPSNPLGTTLDRDTLKSLVSFINDKNIHLVCDEIYVATVFSSPRFISVAEVIEEMDCNRDLIHIVYSLSKDMGFPGFRVGIVYSYNDAVVSCARKMSSFGLVSAQTQYMLASMLSDEIFVEKFLAESPKRLAKRYNKFTKGFEEVGINCLNSNAGLYFWMDLRWLLKEQSNKGEIDLWRIIVNDVKLNVSPGSSSHCNEPGWFRVCFAAE

SEQ ID NO: 24534 - protein, 888 aa, Aspergillus oryzae
MMSESASDASAAQRVRRDRIRVRIGRRSSRILSLLGFRGFPNGKLSICSTAPWSVTTRADSYGLGSTPSAVDPDHPSHTANYPQTIQSFQSHCAQGIHTSRNTAVREVETIHAHPPSSPILDHRSSSVLFIPSAHSNKQRETHKDKREAGAVSRSSESYETRGPKGLGERRSRSTPAAFTHIVSRKLSTTFGNPTVIRRSRLRRRPSVRILKFPAATIPNLNNQGDSANDSSDPSSSPTSSGSPLRAKSTPPTSAEPSIFHEIVEHYQDDTVGWRPTLGTFRPVTGRKLTPIEESPGVTPTVRTVEAVANAKVFFETYFRSIYSDINQRSQRQRELEQYIHSLPLTLEEKNRVWQNWIVQEQEYLRQCRVLKSRFHGACHDETVSIAGFEVLKELGRGSFGVVHLVRENNAGETPTAVMKHPCPKLINARAARGSENHRRKVMTGEKKDVFAMKVIRKSAMIRNSQEGHLRAERDFLVASAKSRWIVPLIASFQDINHLYLIMDYMVGGDFLGLLMRRCILPEDVAKWYIAEMVLCIEEAHRLCWIHRDVKPDNFLISASGHLKISDFGLAFDGHWAHDQVYYNEHRYSLVKRLGIQVDGDVEDQKEERTRKAEQAPLNNSDDTVTFMPPSVNLLEWRDQHQMRRLARSVVGTSQYMAPEVIRGSLYDGRCDWWSVGIILYECLYGFTPFAAKDRETTKWKIHNDVFNSRSTARHLLSTDIKAHPFFRGIIWEQLHQSSPPFIPKVKSWEDTRYFEDAGGVVDNDDISITTDAQGSGDGPEGTGYKPKPIQNQAESQQKQRGPIPDENTSIDATEPPTKTTKKQKHRKRPRDKMLRDMRIQKTVLRMRKEGAFVGYTYRRPKAVALAFAPERGRLYLSRGQLSEIYGL

SEQ ID NO: 24535 - protein, 486 aa, Vibrio campbellii AND4
MTFINNVQAEKSLYIAGEWQSGVNTITNINPSDISENLGDFAQASEAQVEQAILAAKASQPEWEKTPIERKQSVLQAIGDELIARCDELGTLLSREEGKPFAEGRGEIYRAGQFFQYFAAEVLRQIGDNAASVRPGVSVEVTREAVGVVAIISPWNFPTATAAWKIAPALAFGNSVVWKPANLTPASAVALTEIIHRQGLPAGTFNLVLGSGSHVGNTLIHSKDVNGVSFTGSVDTGRKVAAATAPNFVRCQLEMGSKNALVVADDADIQIAVEATIAGSFSGAGQKCTASSRLVVMDGIHDAYVEALIKRMSQLKIGHALEEGVFMGPVVDGNQLKANFEWIERARQCGAELGFGGERLNLQYEGYYMSPTLFLNTQNSWEVNQEEVFAPMASVIRVSDLDEAIATVNDTRFGLTGGIITQSLRNSAIFKQQAQTGCVMVNLPTAGTDYHVPFGGRKESSFGPREQGQYAKEFYTVVKTAYQRPY

SEQ ID NO: 24536 - protein, 258 aa, Bordetella pertussis Tohama I
MQTPHSQPESAPQGEQSTHFGFQSVPEADKARKVAEVFHSVASRYDVMNDLMSAGLHRVWKAFTIGRAAVRPGMKVLDIAGGTGDLARAFAKRAGPSGEVWLTDINESMLRVGRDRLTDSGLLVPTAVCDAERLPFPSQYFDRVSVAFGLRNMTHKDRALAEMTRVLKPGGKLLVLEFSRVAKPLAPAYDWYSFNVLPWMGKKVANDEASYRYLAESIRMHPDQETLAGMLRDAGLDRVQYFNLTAGVAALHEGVRLG

SEQ ID NO: 24537 - protein, 1230 aa, Cryptococcus neoformans var. grubii
MNGFMPALRLHHTHSSSVSPTASNDAASSSPTSSQPHQLAAYSPLYATSPNRGSKITKGSSLSSSTAHHGLKYVRPSTSPLLKPPKGKSFSEYLGDWGSQELFTFLDIHKCGQYLAIFQENDINGKILLDLDVTALKSMGIDKISERVRLIGGIKDLRKRIADETIRAPFIQRCYPPERTLLPSLPSHSNVFLDKWDYSSSASRLGKGQIAFRPPPLDLQGHMPRKLLPHASQGIATIDTHDIRTTKPKIEAYIQQNPLGQPQSVPTKRSDSLTLCAPPSRNVRRRSPSSRHFEGRESQTDGFTILNMASDRQVPSSTMNSVTLGEDCHLQREEGLPLFLKVPQFRNTFASSHKTLIAGRGPLTRGDTISHQPSGPAIAGQDSPVNYRISKTVTTTKEASQGDLEHPFAVKSIGSQLGLLVGVSGMAHDPVTDGSKSKGKTSVPLTGTSSSDISAVNANSAALSLADLRRQLVKFINTEDDTIRTVNVMHVTSGEEILERALKKFGKWGTGMHSSPDVYGDEDGDETLEIDGWEVYTERTPDESSKPLSESSLLKTCTFHREGTAIQDKGLFLRKKQRLQKRKNIQHFFGETLPPPMSPTSPTLITGPHLGIVQGKSQLASEPAFSSSNRLSTLTNKGPNRASMISVMSGLGVPVINTLPSPQGNGLCPTGSVHSHKKKSMYNFFGHRPPSELISNHLADYFPSAKKSDVEKARHSLLRLSGDTVAYKKNGIDEGDNAPDHWSKPGNNQPPSLPPFEPSQDTLSDSLQAYASSTPVYLSRPKHNVALRRRRDSDSSSRSHTSVLMQTRRNRDRSDTASLLTVDEITAEVENRRASTIPKGDYIEETEDSSFIEGDTLPEYEESKGLLRTVCSDSNSIVDSGKSFQRDSDVDQQQELEDEEEDELDDEEEEEEEEKEDEDEQGKAFTSTGSKRIIKWIKGALIGAGSFGSVYLGMDAQSGLLMAVKQVELSAGSVKSEDRKKSMLSALEHEIELLKELQHENIVQYLDSSVDTNHLNIFLEYVPGGSVAALLNNYGAFEEGLVRNFVRQILTGLNYLHMRGIVHRDIKGANILVDNKGGIKISDFGISKKVENSLISGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKDPFIDSPRVRTTASNFISEAIVSEKMEVQVVEEM

SEQ ID NO: 24538 - protein, 511 aa, Cryptococcus neoformans var. grubii
MFARQPLSQNLLRPLSRPSSSFCRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSDIQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGAIGAGMDGEVGKQFQKILTKQGFKFKLNTKVVSGHREGDIVKLKVDSAKGGREETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKAAGVQYKIGKFPFAANSRAKTNQDSEGFVKFIVEKETDQVLGCHIIGPNAGEMIASATLALEYKASAEDIARTCHAHPTLSEAFKEAALASYDKTINF

SEQ ID NO: 24539 - protein, 476 aa, Bordetella pertussis Tohama I
MTTSISFADLGLADSLLRAIADTGYTAPTPIQAQAIPLVLQGGDLLAAAQTGTGKTAGFTLPILHRLMQTKPAARKPGRPRCLILTPTRELTAQVAESVQTYGKYASLSSMVMFGGVNINPQISALKKPLDILVATPGRLLDHAGQKTVDLSGVEILVLDEADRMLDMGFIRDIRKVLALLPKQRQNLLFSATFSDEIRSLARGVLNDPGEVSVTPRNTATELVTQTVHLVEQHHKRDLVSHLIRESGWHQVLVFTRTKHGANRLAEKLVKDGLSAVAIHGNKSQSARTRALSGFKDGSVAVLVATDIAARGLDIDQLPQVVNFELPNVPEDYVHRIGRTGRAGATGAAVSLVDDSEIKLLKAIERLIKKPIERRAVDGWTPPAGGPTAEDRADRGQRAGGDNRAPQARDGQRRATGAHPQGSAPRNAAGPRADAKRNDAGRPQGRAPGETGATRAPAPARNRPVGNGTRGVLLGK

SEQ ID NO: 24540 - protein, 246 aa, Oryza sativa Japonica Group
MELFVMIDACRRASARSITVVIPYFGYARADRKAQGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFSPPAIERLSGGIFEEVIVTNSILLPEHKCFPQLTVLSMANLVAETIWHVHRDGSVSSIFQ

SEQ ID NO: 24541 - protein, 384 aa, Glycine max
MGLVCSRGRRFREADAEENAQDAEIERRIKLETKAEKHIQKLLLLGAGESGKSTIFKQIKLLFQTGFDEAELKSYIPVVHANVYQTIKVLHDGSKELAQNDFDSSKYVISNENQDIGEKLSEIGGRLDYPRLTKELAQEIETLWEDAAIQETYARGNELQVPDCAHYFMENLERLSDANYVPTKEDVLYARVRTTGVVEIQFSPVGENKRSGEVYRLFDVGGQRNERRKWIHLFEGVTAVIFCSAISEYDQTLYEDENKNRMMETKELFEWVLRQPCFEKTSFMLFLNKFDIFEKKVLNVPLNVCEWFKDYQPVSTGKQEIEHAYEFVKKKFEELYFQSTAPDCVDRVFKIYQATALDQKLVKKTFKLVDETLRRRNLFEAGLL

SEQ ID NO: 24542 - protein, 346 aa, Zea mays
MGRSALAVRLASLLAFGLVLVSVEASLGDVDPRYRTCVRECQATGIIGENVISHCQFKENYTSVGVSWYNQEQIYIQWKELNCRTDCRYFCMMQREGERQSLGLSPVKYHGKWPFLRVSVFQEPLSTALSAVNLLMHFTGWLSFFLLVNYKLPLRPQTKRTYYEYTSLWHIYAILSMNAWFWSSIFHTRDIELTEKLDYSSAVALLGYSLILSLLRAFNVKDEASRVMFAAPILAFVTTHILYLNFYELDYGWNMKVCVVMAAVQLLTWAVWAGVSRHPSRLKLWTVVFGGALVMLLELYDFPPYMGFADAHSLWHASTIPLTYLWWSFIKDDAKFRTSTLSKKAK

SEQ ID NO: 24543 - protein, 300 aa, Lactococcus lactis subsp. lactis Il1403
MTKVSVIGSISMDLVTRTNRVPNAGETVFGEDFAMVPGGKGANQAVAFARLSPNEVSMIGAVGKDAFGESILQNFKENAVLFENVGTVPQTTGIAQITLYDDDNRIIIIPGANNEVLPSYLADLWEKIKESQLVILQNEIPHETNLAIAKFCKENAIKVLYNPAPARKTDLEMIDFVDYITPNEHECKELFPNLALEEILKKYSNRLIVTLGSEGVIFHDGETLQKIPAIKAKVVDTTGAGDTFNGAFAFGLTENLSISDSIRLAVVASHLSIQKFGAQGGMPKLSEVKAKLKELEINLY

SEQ ID NO: 24544 - protein, 267 aa, Bacillus halodurans C-125
MKQHHMLIIGAGRMAEAIFSGILKREENPFQITVSNDKDVARLEKLKKTYPVKTTTDWTAVVETADVILLACPPAAHENVLKKLSPICNGQLVITVAAGIGPTDLETHLPKGTPTAWIMPNTAASVGESMSIYCFGQHVKERDKQLISFILDAIGMSEQLTESQIHHLTAITGSAPAFLYFLAEALEQSAQSYGVAPEKARELVIGMITGSAKMLEEYKDPTQLREQVTTPGGATAAGLQSLLHDDFQGALQRAVQATNGRAQERAN

SEQ ID NO: 24545 - protein, 555 aa, Pseudomonas putida GB-1
MRIVPFQYLALAAAILSCSSVYAANLEGGAVAAPDQYGAQVAADILKKGGNAVDAAVATAFTLAVTYPEAGNIGGGGFMTLFIDGKPYFLDYREVAPKAATRNMYLDDKGEVIENLSLVGVRAAGVPGTVMGLWEAHQKFGKLPWSELLTPAIGYAKNGFKVAEKQYQYRNDAQGMFKTATNFNDYFGNMKVGELFKQPEMAQTLERIADKGVSEFYQGKTADLLVAQMQADKGLITKEDLKDYKAVWREPMAVSWRGNVVYTAPPPSSGGVALAQLLGIKEDRAADFKGVAHNSAQYIHLLAEIEKRVFADRADYLGDPAFTKVPVDQLVAKDYLAKRAAQVNPQAISDTDKVKPGLEPHQTTHFSIVDKQGNAVSNTYTLNLDYGSGVVVKGAGFLLNDEMDDFSAKPGAANAFGVVGGDANAIEPGKRMLSSMSPSLMTRDGKVELVIGTPGGSRIFTSIFQVMNNLYDYGMPLDKAVAAQRVHHQLLPKDTIYFDSYAPLTGPVADELKKMGYVLEDQGWEMGDIQAIRVDGAKLETASDPRGRGVGMIVK

SEQ ID NO: 24546 - protein, 379 aa, Arabidopsis thaliana
MSNDKDSMNMSDLSTALNEEDRAGLVNALKNKLQNLAGQHSDVLENLTPPVRKRVEFLREIQNQYDEMEAKFFEERAALEAKYQKLYQPLYTKRYEIVNGVVEVEGAAEEVKSEQGEDKSAEEKGVPDFWLIALKNNEITAEEITERDEGALKYLKDIKWSRVEEPKGFKLEFFFDQNPYFKNTVLTKTYHMIDEDEPILEKALGTEIEWYPGKCLTQKILKKKPKKGSKNTKPITKTEDCESFFNFFSPPQVPDDDEDLDDDMADELQGQMEHDYDIGSTIKEKIISHAVSWFTGEAVEADDLDIEDDDDEIDEDDDEEDEEDDEDDEEEDDEDDDEEEEADQGKKSKKKSSAGHKKAGRSQLAEGQAGERPPECKQQ

SEQ ID NO: 24547 - protein, 104 aa, Lactococcus lactis subsp. lactis Il1403
MEYNITDATFDEETKEGLVLIDFWATWCGPCRMQAPILEQLSEELDESELKICKMDVDENPATAQGFGIMSIPTLMFKKDGEEVKRIVGVQTKAQLKAVIAELS

SEQ ID NO: 24548 - protein, 144 aa, Streptococcus oralis
FKNLYHPTEEELKEQFIRGQYRSGKIDGMKYISYRSEPNVDPESTTETFASGAFFVDSDRFCGVPFFFRTGKRLTEKGTHVNIVFKQMDSIFGEPLVPNILTIYIQPTEGFSLSLNGKQVGEEFNLAPSSLDYRTDATATGASP

SEQ ID NO: 24549 - protein, 529 aa, Sulfitobacter sp. EE-36
MTQFDDLIRMQAAVQDRSILSLFDTADRAQTFSAQTGDMLFDFSKTNLDRDTMDALLGLVDAADVPARRDAMFAGEKINETEDRAVLHTALRNLDGGAVMVDGADVIPGVHDTLDRMRGFADQIRSSDITDVVNIGIGGSDLGPAMAVQALSPYHDGPRCHFVSNVDGAHISDTLRGLDAKTTLVIVASKTFTTIETMTNARTARAWMTENGGDPAKQFAALSTAQDKTSDFGIDADQVFGFEDWVGGRYSVWGPIGLSLMIAIGPRAFDAFLRGGQAMDRHFCAAAPHENMPMLLALVGIWHNQICGYATRAVLPYDQRLGQLPDYLQQLEMESNGKSTLMDGTAAPYHTGPVVWGAAGTNGQHAFYQLIHQGTRVIPCEFLIAANGHEPDLTHHHKLLIANCLAQSEALMRGRSLQEASELMAAKGLTGAELDRQARHRVFPGNRPSTTLSYPLLDPFTLGQIIALYEHRVFVEGVILGINSYDQWGVELGKELATSLQPIVEGAAPATDKDGSTAALVAFIAKHAD

SEQ ID NO: 24550 - protein, 369 aa, Salmonella enterica subsp. enterica serovar Typhi str. CT18
MATLSRLFIHPVKSMRGIGLTHALADISGLAFDRIFMVTESDGTFITARQFPQMVRFTPSPLHDGLHLTAPDGSSALVRFTDFTPQDAPTEVWGNHFTARVAPTAINQWLSGFFSRDVQLCWVGPQLTRRVKRHNAVPLGFADGYPYLLTNEASLRDLQQRCPAGVQMEQFRPNLVVSGVAAWEEDSWKVLRIGDVIFDVVKPCSRCIFTTVSPEKGQKHPSGEPLATLQAFRTAQDNGDVDFGQNLIARNSGVIRVGDEVEILATAPAKAYGATTLDDSVTPEKHPDGSVTIDWQGQTFCGNNQQVLLEQLENQGIRIPYSCRAGICGCCRIRLLEGEVSPLKKSAMGDDGTILSCSCVPKTALRLEN

SEQ ID NO: 24551 - protein, 462 aa, Coccidioides immitis RS
MAVLQALVIACLSLLLATTVALVWVFPIGRARASDSDAKKASISVQIVVLGDIGHSPRMQYHAESVAKHGGRVTIIGYQTSPPKPELLSNPLVSIVALPPPPKMLQTKNKVLFPLLAVLKVLQQTWFLWSALVYRSKPAQWMLIQNPPTVPTLVMAQLACWLRNTRLIIDWHNFGYSILAMKLGPRHPMVKFLRFHEMTACRFATAHFCVSKAMARMLQQEINLVAPILVLHDRPPELFQPIVREDEKFAFLTSLPETNNFVKAYRAGRQCELLVSSTSWTPDEDFSIFLDALCQYSTHAATVDANLPDLYVVITGKGPLQRTYLRAIAALTAEGKLRKIHIQCAWLTIQDYAKLLACSSLGVCLHTSSSGVDLPMKVVDMFGAGLPVVAWDRYEAWPELITEGVDGKGFGSAEELSRHLIDLLGEDRSQLQWLRQGARNASKRRWDDEWDPVAGEFLGLTS

SEQ ID NO: 24552 - protein, 489 aa, Sulfitobacter sp. EE-36
MVSRVIPVDPFDLVIFGGTGDLARRKILPGLFRRFCAGQMPENARVIGAARTEMDRAGYQQMIREAIAEFNGDFGHEKAQLDGFIDRLEYVAIDAKGEDGWAELQKLMAGTERVEAYYFSVSPALFGDLAERLQQWGMADAQSRIVVEKPFGRDLKTAQALNATLAKYFDESQIYRIDHYLGKETVQNLMAVRFGNMLFEPLWNSQYVDHIQITVAETVGVGGRGEYYDKSGAMRDMVQNHLMQLLCLIAMEPPARFDPDAVRDEKLKVIRALDPVLPHHIARGQYQAEPCNEAEQPGYRTAVGDPRSRTESFVALKTHISNWRWAGTPFYLRTGKRMAARSSEITVVFKETPHSIFAEDAGRHRNVLSIRLQPNEGITLGVTIKEPGPGGMRLVDVPLDMTFADALGPEGSEQVDAYERLIMDVIRGNQTLFMRGDEVEAAWAWTDPIIQGWEARNDVPKPYDSGSDGPTDANELMRRDQRQWREYSA

SEQ ID NO: 24553 - protein, 429 aa, Salmonella typhimurium LT2
MKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTIRIEPPLTLTIELCEQVLKSARNALAAMQVSVEEV

SEQ ID NO: 24554 - protein, 448 aa, Streptococcus pneumoniae TIGR4
MHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIAFPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKIPKNATILTGLASAVAAGMFPLASIAAFLNICTLAYLIMLAYGLIRLRKEKGMPKAGEFKTPLVPLLPILSIIICLSFMLQYNMNTWIAFLVALLVGSIIYFTYGYKHSTIEE

SEQ ID NO: 24555 - protein, 476 aa, Pseudomonas fluorescens PfO-1
MTADIAYLQTLQQPLEELNRLFNAQRAAYAANPMPPATQRQQWLKALRDLLSSERQALIDAISSDFSHRSADETLLAELMPSLHGIHYASQHISQWMKPSRRKVGVAFQPASAKVVYQPLGVVGVIVPWNYPLFLAIGPLTGALAAGNRVMLKLSESTPATGLLLKELLARIFPEDLVCVVLGEADVGVAFSKMRFDHLLFTGSTSVGRHVMRAAAENLTPVTLELGGKSPAIVSHDVPLKDAAERIAFGKTLNAGQTCVAPDYVLVPEARIGGFVEAYRQAVRGFYPTLADNPDYTAIINERQLARLNSYLSDATSKGALLIPLFDQGQGRRMPHSLLLNVSDEMTVMQDEIFGPLLPIVPYQDLDQAFAYINQRPRPLALYYFGYDKREQQRVLSETHSGGVCLNDTLLHVAQDDMPFGGIGPSGMGHYHGHEGFLTFSKAKGVLVKQRFNAAKLIYPPYGKSIQKLIQKLFIR

SEQ ID NO: 24556 - protein, 464 aa, Francisella tularensis subsp. holarctica
MALAKTLKPRHIELIALGGIIGSCFFLGTGYVLAEVGPAAILAYILAGIIVYAVTLCLAELTANSPNSGSFIYYTAKYVSPAIACGMGWSYWLNWIIYIPSECIAGGIIMHTFLPAVPTYMWATLFGLFITIINLTKVKIFGEIEFWLALVKIIALGLFSVIAILIFFDIIQNNTGGVLGGTYIVSDGGFFPKGKLILITTMVILLVNFQGSEIIGLAASESNNAEKQMPRIAKHVAIRIVGLYVIPVFLLATIFPWQKMSLSDSVFATALQYYHLDKFAAVFAFVVLVAAFSCANSGFYAAVRSLYGLSRARMAPSIFRKLNSAAIPHFAVYISIIAVWTFLILSFKLSASAAFTNLLAMSGFTATICWICICWSQYNFRKHLIRRNATDKILFKAPLFPYISLFGIWIQVLCLVLTLFNDELRGAFYFGAPAMIIPCCIYFFVSKKKNTKIVQRTISLKKVF

SEQ ID NO: 24557 - protein, 120 aa, Francisella tularensis subsp. holarctica
MSEINQLGKVYERPWGTYQTINFTDKSQTKIITVKPQGQLSLQKHFKRAEHWVVVTGRPTITVDDNVREYNVGEHIFIPKEAVHRLENFTDSDIQIIEVQVGDYLGEDDIVRLEDIYKRS

SEQ ID NO: 24558 - protein, 396 aa, Francisella tularensis subsp. holarctica
MQLSRRVKAMQASPVRKLVPYSIQAEKQGKKVYYLNIGQPDIKTPNEFMDAIRAYDKETIAYSIASGEPSLIKAISKYYKRFDMDFAEDEILITNGGSEALIFAAIATCNAGDEILVPEPFYTNYNGFTTAVDVSIRPITTKAEEGFHLPSKEEILACVTDKTRAIMISNPGNPTGVVYTKQELETLAEVAKEKDLFIISDEVYREFTYDGLVCTSFGNIKGVEDRVIIVDSVSKRYSACGARIGSLCSKNKEFIKEATKLCQARLCVPTLEQIGAAALYEVSEDYLKEVNTEYQKRRDITFEALSKMDNVVCEKPTGAFYVIAKLPIDDAEKFALWLLTDFEDNRETVMISPAGDFYATKGLGKDEIRIAYILEEKSLRRALELLDKAIKAYNSK

SEQ ID NO: 24559 - protein, 220 aa, Bacteroides thetaiotaomicron VPI-5482
MDDFRKYATKHLGMNGMVLDDVIKSQAGYLNPYILEERQLNVTQLDVFSRLMMDRIIFLGTQVDDYTANTLQAQLLYLDSVDPGKDISIYINSPGGSVYAGLGIYDTMQFISSDVATICTGMAASMAAVLLVAGAEGKRSALPHSRVMIHQPMGGAQGQASDIEITAREIQKLKKELYTIIADHSHTDFDKVWADSDRDYWMTAQEAKEYGMIDEVLIKK

SEQ ID NO: 24560 - protein, 479 aa, Oryza sativa Indica Group
MASGQKAKQQVMKPMEVSVEAGNAGDAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 24561 - protein, 489 aa, Salmonella enterica subsp. enterica serovar Typhi str. CT18
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 24562 - protein, 475 aa, Oryza sativa Indica Group
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWISLKTLSACCLVVSIAAAAGSIADVIDALKVYRPFSG

SEQ ID NO: 24563 - protein, 173 aa, Treponema denticola ATCC 35405
MSHQKESKRDNQHTDKEYVEKLVKLNRTAKVVKGGRRFSFSALTVVGDQKGRVGYGFGKANDVSDAIRKSIEKAKANMVTFPLKNGTIPHEVQGKFKGSSVLLRPACSGTGIIAGGTIRAIMEAAGATDLLSKSLGSSSAVNVVKATFDAASLLMDGKKIAKSRGKTLLDVWG

SEQ ID NO: 24564 - protein, 195 aa, Thermotoga sp. RQ2
MIIRDVELVKIARTPGDYPPPLKGEVAFVGRSNVGKSSLLNALFNRKVAFVSKTPGKTRSINFYLVNSKYYFVDLPGYGYAKVSKKERMLWKRLVEDYFKNRWSLQMVFLLVDGRIPPQDSDFMMIEWMKSLNIPFTIVLTKMDKVKMSERAKKLEEHRKVFSRYGEYTIIPTSSVTGEGISELLDLISTLLKEN

SEQ ID NO: 24565 - protein, 366 aa, Populus tremula x Populus tremuloides
QMGLAENQLCFDLIQDWLKKNPKASICSPEGLNEFREIAIFQDYHGLPEFRSAVANFMEKVRGNRVTFDPDRIVMSGGATGAHETVAFCLADPGEAFLVPAPYYPGFDRDLRWRTGVKLIPVDSDSSNSFMVTREALENAYEKAQLDNIKVKGLLITNPSNPLGTILDRETLRSIVRFINEKNIHLVCDEIYAATVFSQPDFISVAEILQEDIECNLDLVHIVYSLSKDMGFPGLRVGIIYSYNDAVVSCARKMSSFGLVSTQTQYLIASMLSDNEFVEMFIRESKSRLAARYRVFTRGLDQVGIECLKTSNAGLFLWMDLSRLLKEQTFKAEMGLWRVIIHEVKLNVSPGCSFHCSKPGWFRVCF

SEQ ID NO: 24566 - protein, 500 aa, Rhodopirellula baltica SH 1
MGKPTGFKEFDREKVAWRLPVIRINDYDEIYTEPKTEHLQRQGARCMDCGVPFCQSATGCPIDNLIPEWNDLVYNNRWKEAIERLHKTNNFPEFTGRVCPAPCEGSCVLGITNPPVTIKNIENAIVDRAWEEGWIVAEPPEQRTGKKVAVIGSGPAGLTAADQLNKAGHLVTVYERADRIGGLLQYGIPNMKLSKKAVQRRVDKMTEEGVTFKTGVNVGVDVSPKELQSEFDAVLLACGATKPRDLPIPGREAKGVHFAMDFLTSNTKQRVHSDNLGAEFISAEGKDVIVIGGGDTGTDCIGTSLRHGCRSMVNFELLPQPPAERADDNPWPEWPRIFRVDYGHEEAEAKFGKDPREYQILSKEYLVDDEGKLKGIKTVNVEWTKNDEGGWQMAEVEGSEKEWPAQLILLAMGFLGPEQTVAESLGLETDARSNFQAEHGKYATNIDGVFAAGDCRRGQSLVVWAINEGRGAARAIDIFLEGSSNLPAPGQTMGTSMAAV

SEQ ID NO: 24567 - protein, 365 aa, Populus tremula x Populus tremuloides
QMGLAENQLSVDSIIDWIEKHPEASICNPEGVHMFKDIANFQDYHGLPEFRQAIAKFMGRVRGGRVAFDPDRIVMSGGATGANELIMFCLADPGDAFLVPSPYYPAFYRDLGWRTGVQIVPVDCDSSNNFQITKGALEAAYDKAQQNGINVKGLIITNPSNPLGTTLDRETLKSLLSFINEKNIHIVCDEIYAATIFGSENFVSISEVVEEVMDCNRDLIHIVYSLSKDMGLPGFRVGIVYSYNDAVVNCGRKMSSFGLVSSQTQYLLASMLSDEEFVEDFLAGSSKRLKKRHGVFTKGLEQIGISCLESKAGLFVWMNLRHLLKEQTNDGEMALWRVIVNDVKLNVSPGSSFHCVEPGWFSVSS

SEQ ID NO: 24568 - protein, 515 aa, Thermus thermophilus HB8
MEALWVTAAFALGLLASRLALPPLVGYLVAGFLLAGTGIRGTAFLHQIAEIGVLLLLFSVGLKLRLKDLLDPRVLLSGGLHLGLFATLAFLYTKNLPLAIALGFSSTVLVAKVLEDKKELTSYHGRIALGILVFQDLVAVGLLTLYGGEGVSPWAALVLLFPLLRQGVAWLLEKSGHEELLVLFGLGMALGSGELFQHVGLSPELGALFTGALLSGHAKSAELTKGLWSLKEAFLVAFFLDIGLREGLQGLDLGLAAGLTLLSLLKAPLFFLVLLLVGYRARTAFVAGMYLGNHSEFALIVGVALERAGLFTDLSALALAVALSMALSAPLARYSHTLYKRLEPFLLRLERPGSHPDAEPERLEGTVLVVGMGRTGDAVYRVLEAQGESPVGLDADPAKVERHREKGRRVLYGDAEDPELWERLDLRGLKAVVLALPDLEAKALAARWLKERGFQGLVAATSYFPEEDPVLAQEGAHLIFHPFQEAGERLGERVLESLAIMGKVNYGRSQQMGSD

SEQ ID NO: 24569 - protein, 166 aa, Coccidioides posadasii
MASLKAGDSFLSDVVFSYIPWTPDNKDIKACGMPQNYEASKLWADKKVVLFSLPGAFTPTCSASHLPGYIQKLPQLKEKGVDVVAVLAFNDAWVMSAWGKANGVTGDDILFLSDPEAKFSKSIGWNAGERTGRYAMIIDHGQVTYAEIEPGREVTVSGADAVISKL

SEQ ID NO: 24570 - protein, 188 aa, Saccharophagus degradans 2-40
MQTIINTKILPFKATAFSKGDFIPVSEQDLLGKWSVVMFYPADFTFVCPTELGDMADHYAQLQEMGVEVYSVSTDTHFTHKAWHDSSDTIGKINFPMIGDPTGTISRNFGVMIEEDGLALRGTFVINPEGEIKVAEIHDLGIGRSAKELVRKIQAAQYVAEHDGEVCPAAWQPGEATLAPSLDLVGKI

SEQ ID NO: 24571 - protein, 170 aa, Robiginitalea biformata HTCC2501
MNFKDYIRDIPDFPKKGVVFKDITPLLEDPKAFRETAAALLAFTDGLKVDKVVGIESRGFFFAPLLADRLGAGFIPARKPGKLPHRIHRKEYDLEYGTDALELHAESISPGDRILVHDDVLATGGTARAICDLVTELGGEVVQCNFLIELSFLKGRTRLDGFPLKSLITY

SEQ ID NO: 24572 - protein, 380 aa, Vibrio campbellii AND4
MKTFNLPDLGEGLAESEIVKWHISVGDMVQLDQVVLTVETAKATVDVPAPYGGRIVSRHGEEGDVINIGALLLEIDETGAKNTVSQQKQTADAATVVGNVSQHAHNVNVDDFWIGGEHTPSPDNLICALPSARLLANKLGVDLTQVKGSGPDGLILDSDIYDEAGKQRPGTEVLKGARRTMVSTMADSHHNVAAVTITEEAVLDGWKQGEDISIRLVQAIVYACREEPAMNAWFDAETMTRCVHSAVNIGIAVDSQYGLYVPVLRHADEYEPQDVRRWLDQTVRGIRERKVSREQLQHATITLSNFGAIAGIYATPVVTPPQVAIVGAGRIIDKVVIQDGQAVAVKAMPLSITFDHRACTGGEAARFTKSLVEHLRRPSV

SEQ ID NO: 24573 - protein, 314 aa, Methanosarcina barkeri str. Fusaro
MGIKEDIRTVFEKDPAARSTLEVICCYPGLHAIWIHRISHSLWERHFYFLARLLSHISRMLTGIEIHPGAKLGRRVFIDHGSGVVIGETAEVGDDVLIYMGVVLGGTALEKVKRHPTIENDVVIGSGASVLGPITVGRGAKIGAGSVVIRSVPAGATVVGVPARIAETHPSVSAGQLDHDKLPDPGLIVISQILDRLSSLEDKFQAHEELVSGHGKTPQGTVLKDEQIYSLLKDVVDPGVGMDIVKLGLVKEVVVDGPNVEVNLVLTTSACPMIEYFKEQIRRKVLSAEGVEKVNVNILDEPWSWDQNKKKVVH

SEQ ID NO: 24574 - protein, 308 aa, Methanosarcina barkeri str. Fusaro
MGRIYSDITWTIGNTPLVRLNRITEGLHADVLAKVESFNPMGSVKDRIGLAMIEKAELEGKIKKGTTVIEATSGNTGIGLACVCAARGYKLILVMPETMTVERRKLLKALGAELVLTPGTEGMKGAVNKAEQMAADDPSLYFIAQQFQNPANPEIHRRTTAEEIWRDTDGKADVIVAGVGTGGTITGVASVLKKRKPAFKAIAVEPAESPVLSGGSPGPHKIQGIGAGFIPDVLQLDLVDEVIRVTGDNAAAMSRRLAKEEGILAGISSGAATYAALQVAAREEMNGKTIVVILPDTGERYLSTDLFD

SEQ ID NO: 24575 - protein, 292 aa, Oryza sativa Japonica Group
MQEMLFCGTGSFKDVDGKAAAPEAKKKKQGGGGGGGKKENPYASRGLDKFSTVLSELESRREKILRQVGGAGGGGAPGEGGGGGGGEHVLVRFVQSEGKGWVPIVVKLPPEEEEQQQRKGGKNKRKQQAAATSATSSQSSTPPTSEPASPREDVIKPARPAAAAAAAEPGSAKRKAGVRWSWSDVRPRHYMPFVAVLLLASLVVFGKVFAICCTSVWWYLVPILTASSNGAGGAGGAHGVRRSKAAVKVLGKKASDKKMAVTPLLGPSHGKRGSSGVHELISPRSHPHGKKG

SEQ ID NO: 24576 - protein, 117 aa, Zea mays
  misc_feature (47)..(47): Xaa can be any naturally occurring amino acid
  misc_feature (56)..(56): Xaa can be any naturally occurring amino acid
  misc_feature (63)..(63): Xaa can be any naturally occurring amino acid
ASRNGRCYEEGDHFGQHLLRKCCGAIAKKLAELTTLTDVTTIVGGGXNSVAAVERXGLADKMXHIWTGGGASLELLDGKTLPGVLDEFCQLACPFVSDHGVTLQSLWTWDRLAVEFW

SEQ ID NO: 24577 - protein, 311 aa, Oryza sativa Japonica Group
MAAAWAAAVAVMLLLAQVSAAAPVMGPAFLWAPNNYGFSSDETKEMVYYQTVSPKSLVKSVLEEGGWSNLVCSREDHAKSVDVAVLFLGSKLQSSDISKEKQADSTLVDMLKNSFASSEFSMAFPYVAMSDDDKLEKSLLSGFAENCNNGLGNNHITYTDTCSVSEDLKKHHDMDSIHGLVASQTKKNPSGQTDLVVFCDGGFKDNTKSEGELLSELVTLLKKSGAKYTILYASQPYGLLESPSNLPLGRYLAEKTNTTKPGRGKCDGECLVKSTLLEGSFGIVLLIILISGLKCMMGIDTPSKFDAPPES

SEQ ID NO: 24578 - protein, 94 aa, Triticum aestivum
SSLTPLCSFRTAEAAMAGAKAAAVAIVAAAVPTLASVRMLPWARAHLNPTGQALIISTVAGMAYFIVADKTILSMARKHSFEDAPDHLKNTSFN

SEQ ID NO: 24579 - protein, 394 aa, Magnaporthe grisea 70-15
MAPKKVSKSGKGKAKTDSATSSSQPSAQLLDLVESFLSDFSSKKALEEFKQHRVKKGLPKSSGKPAETLVAVFQSWESGSKTIVPVKGEDGDQDMMDVDADSESSDAESENDKKVTAKQKRPLKRKAPSSSSSSSSSSSSESSSDSSSEDEAPKAKKRKVASAPAADSSSSSSSSSSSSSSSSSSEDDSDDDEVAVENDSSSSSSSSSSSSSSSSDSDSDSDSDSSSEDEKAANFPLPDSDSSSSSDDSSSDSSDSDSSDSDKKTKKAKKAQAEDKSGSDSSDTVKTSPKVFPVSEFAPLPPDPTKTNNRKKSGPAEPKKPNEPFSRIRKDIKVDPRLASNAFNPADDWGRQANEDLIVTRGKGFTKEKNKKKKGSYRGGRIDTTARNGIKFDD

SEQ ID NO: 24580 - protein, 464 aa, Oenococcus oeni PSU-1
MKQAIETIPANKKLKYIKKIAILATFGAFLFGYDTGVINGSLSFMARGDELNLSPFMEGLVTSSLLFGAAIGAVIWGRLADRYGRKSILRVLAIIFFFSTLGSSIAPNSYVLIIGRLFMGLAVGGVAGIVPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 24581 - protein, 458 aa, Oenococcus oeni PSU-1
MKAHHLNIFFIFVFGALGGLLFGFDTGIISGASSLIESDFSLNIEQTGFITSSVLIGSSIGALSVGSLSDKFGRKKLLILASVLFLIGSGLSMSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 24582 - protein, 566 aa, Bacillus subtilis subsp. subtilis str. 168
MKQFRVTNEGDIQTTLRGLEVLSVPFLNKGVAFTEEERKELGLKGFLPPKVLTIDDQAKRAYEQYSAQPDDLSKNVYLTALHDRNETLFYRLLNDHLGEMLPIVYTPTVGTAIQRYSHEYRKPRGLYLSIDDPDGMKEAFKQYKDQSDTIDLIVATDAEGILGIGDWGVGGIAISIGKLAVYTAAAGIDPSRVLAVVLDAGTNQESLLNDPLYVGNQHSRVRGERYDQFIDDYVALARETFPNALLHWEDFGAKNARSILKRYKDKVCTFNDDIQGTGAVSLAAVLSCAKASKVPLRDHRVVIFGAGTAGIGIAEQLREALVREGLSEEESYKRFWCIDRNGLLTDDMDQLLDFQKPYARSADEVKDYQRNGDGGGIDLLEVVRQAKPTILIGTSTVSGAFTEEIVKEMASHVKRPAILPMSNPTTLSEAKPEDLIEWTEGRALITTGSPFPPVEYNGVTYHIGQANNALVFPGLGLGTIVTKSKLITDGMFEACARAIAGMVNVGVPGAPMLPKVEDLRTVSATVAVEVAKTAMKEGVATEEPEDIIQAVQDAMWYPVYKPIRAI

SEQ ID NO: 24583 - protein, 174 aa, Brassica napus
MGREVLVVGILILLCSEFVSSAPSANSPAKIVSGFISNHGSSLMKWLWSLKSTSTKTTIATRSMVKFENGYTVETVFDGSKLGIEPYSIEVLPNGELLILDSENSNIYKISSSLSLYSRPRLVTGSPEGYAGHVDGRLRDARLNHPKGLTVDDRGNIYVADTVNNAIRKISEGG

SEQ ID NO: 24584 - protein, 136 aa, Triticum aestivum
SSFTPSLSISSHLTSSSPLADVSSRFRRRWRRGSRSGGAYYKEAMEKNKQYVVQPPSVEKCQELSKQLFYTRLASLPGRYEALWKEVDGVKQLWKNRKELKVEDLGIATLFGVELYAWFCVGEIAGRGFTLTGYKV

SEQ ID NO: 24585 - protein, 495 aa, Zea mays
MESAALSRIGLAGLAVMGQNLALNIAEKGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSLMPGGSHHAYSNVQDILHKIAAQVEDGPCVTYIGEGGSGNFVKMVHNGIEYGDMQLISEAYDVLKHVGGLSNSELAEIFVEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 24586 - protein, 344 aa, Physcomitrella patens subsp. patens
MFELGENITPRYKIISKMGEGTFGRVLECWDREMQEYVAIKVIRNVQKYRDAAMIEIDVLRTLAKNDKMGIRRCVQLKTWFDYRNHVCIVCERLGPSLYDFLRKNNYRPFSADLVRDFGRQLLESVAYMHELTLIHTDLKPENILLVSSEYVRVSDYKASNPGKHFKRVPKTSEIKLIDFGSATFDSHYHCSVVSTRHYRAPEVILGLGWTYPCDIWSIGCILVELCSGDALFQTHENLEHLAMMERVLGPIPVHMIKRADRRTEKYFRHGRELNWPEGAVSRESIRAVRRLPRLRNLIMHHVDHSGGLLIDLLQGLLKFEPSERLTAKEALKHPFFKESNRRL

SEQ ID NO: 24587 - protein, 112 aa, Petunia x hybrida
MAGKLSIILFVLLVVLLAQNQVSMAKMVLDAKVQRRGNDQIYGVSQGSLHPQDCQPKCTYRCSKTSFKKPCMFFCQKCCAKCLCVPAGTYGNKQTCPCYNNWKTKEGGPKCP

SEQ ID NO: 24588 - protein, 343 aa, Zea mays
MIPTRSAQASFRDRTNEFRAAVERARRHAVPSSSSAPAAPSSSSTGPLDGLIAATSARSEFNNRASKIGLGIHQTSQKLSRLAKLAKRTSVFDDPTVEIQELTAVIKKDITALNSAVVDLQALCNSQNESGSLSKDTSNHSTTVVDNLKNRLMSATKEFKEVLTMRTENLKVHENRRQMFSSSAAKDASNPFIRQRPLVARDPSESSVPPAPWASDSASTPLFQRKKTNGDHGASSSQPFAQQQQLAVQQDSYMQSRAEALQNVESTIHELSNIFTQLATMVSQQGELAIRIDENMEETVANVEGAQGQLLKYLNSISSNRWLMMKIFFVLMVFLMIFIFFVA

SEQ ID NO: 24589 - protein, 311 aa, Bacillus subtilis subsp. subtilis str. 168
MLKIVANTADLIGDTPLVRLNRLQPENAAQVYLKLEFFNPSGSVKDRAAYQMIIEAEQNGLLKPGSVIIEPTSGNTGIGLAMNAAARGYKAILVMPDTMTKERINLLKAYGAEVVLTPGEERMPGSIKKAKELAEQIPNSYIPMQFDNTANPDAHRKTTAPEIARAIEEIGKPLGAFVASSGTGGTITGTGEALKELFPDITVHVVEPAGSPVLSGGKPGAHKLVGTSPGFIPPILNEDVYDEIIKISDEDAYTTTRRLAAEEGILVGPSSGAACFAAIETAKRLSPDKVVVCMTADTGERYLSTDLWSFI

SEQ ID NO: 24590 - protein, 502 aa, Chlamydomonas reinhardtii
MVQALCSAGAARRGGRQAYSFLASLLSQQRGFAAAAEKDVVVVGGGPGGYVAAIKAAQLGLSVACVEGRGALGGTCLNVGCIPSKALLNSSHMYMEAKQHFGSYGIKMDGLSYDFAAVQAQKDGVVSGLTKGIEGLFKKNKVEYVKGWGKLVSPHEVEVAAADGSSSRLRAKNILLATGSEVTPLPGVPIDEEKIVSSTGALALKSVPGEMVVIGGGYIGLEMGSVYQRLGAKVTVVEFLDNIVPSMDAEVRRSFMRTLEKQGLKFKMGTKVTKGEVVGGRVHLTLEPAKGGAAEKMECDVCLVSIGRRPYSKGLGLEAVGVNTDNRGRVIVDAHFRTNVPSVYAIGDLVPGPMLAHKAEEDGVAAVEIMAGKHGHVNYATVPSICYTHPEVASVGLTEEEAKAKGHEVKTGKFSFMANSRARAVGDTDGMVKIVADKKSDKLLGMTIMGPNAGEMIHEGVLALEYGASSEDIARTCHGHPTLSEAVKEAALATAFGKPIHM

SEQ ID NO: 24591 - protein, 129 aa, Methanosarcina barkeri str. Fusaro
MDYSLKVMDHFSNPRNMGSIENSDGVGEVGNAKCGDIMKIYLKVEDNRIADVKFQTFGCGAAIASSSMATEMIKGKTLEEAWKLSNKAVAEALDGLPPIKMHCSMLAEEAIHEAINDYLKKKGLEPWTE

SEQ ID NO: 24592 - protein, 256 aa, Botryotinia pelargonii
AYMLKYDSTHGQFKGDIKVLADGLEVNGKKVKFYTERDPANIPWAESEAYYVVESTGVFTTTEKAKAHLKGGAKKVVISAPSADAPMYVMGVNNETYTGDVDVISNASCTTNCLAPLAKVINDEFTIIEGLMTTIHSYTATQKTVDGPSAKDWRGGRTAAQNIIPSSTGAAKAVGKVIPVLNGKLTGMSMRVPTANVSVVDLTVRIEKGASYDEIKAVIKKAADGPLKGILAYTEDDVVSTDMNGDNHSSIFDAKA

SEQ ID NO: 24593 - protein, 256 aa, Botrytis aclada
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILGYTEDDVVSTDMNGDNHSSIFDAKA

SEQ ID NO: 24594 - protein, 512 aa, Ostreococcus tauri
  misc_feature (72)..(78): Xaa can be any naturally occurring amino acid
MAIRVITRRRLAVARARARAIARASAWVTIARAAADGRRTRAVRRWRAPGGPGWVPCTAESVSAQTPPRAPXXXXXXXILETPHDIFLVMEYVKSGELFDYIVEKGRLGENEARHFFQQIISGVEYCHRNMVVHRDLKPENLLLDSRNNVKIADFGLSNVMRDGHFLKTSCGSPNYAAPEVISGKLYSGPEVDVWSCGVILYALLCGSLPFDDESIPNLFKKIKGGIYTLPSHLSPGARDLISRMLFVDPLKRITMAEIRQHPWFVVHLPRYLVVPPQTQISQTSNLDGETLDMVVNLGFEREPLISALQHQVRNKATVTYYLLLDNRRNIYGGYLGAEYDDAEMMAEHNNMRGHGVASALGVRRPSQIQSHMMQTRLVAEQRWMLGTASKMGAQDVINELLRVLRAMNIAWKKNGPYNMKCMCVFHPDNDGEMDAGDYGESDAMEADAGDVSMATRSHAPGNAREPSVLKFELQVYKLPNDRLMVDYQRVEGGVMVALDFAAKLMTFMNLQ

SEQ ID NO: 24595 - protein, 340 aa, Silicibacter sp. TM1040
MPTLNEPKLISGNANLPLAKSISRRMSMHRGVDQDLVNARVERFNDGEIFVEVYENVRGEDMFIIQPTSNPANDNLMELLIIADALRRSSAQRITAVIPYFGYARQDRRTKARTPISAKMVANMLTGAGIERVLTMDLHAAQIQGFFDIPVDNLYASPIFALDVKAQFKDQMDDLMVVSPDVGGVARARELAKRINAPLSIVDKRREKAGEIAEMTVIGDVKDKICLIVDDICDTAGTLCKAAQILLDNGAKEVHAYISHGVMSGPAVERVTNSVMKSLVLTDSIQPTQPILDAPNIRIVPTAPLFTQAILNIWHGTSVSSLFEDKTLIPIYESLYNSQS

SEQ ID NO: 24596 - protein, 187 aa, Silicibacter pomeroyi DSS-3
MFIQTESTPNPATLKFLPGQTVLEVGTADFPSAEAAEKSPLAARIFAVSGVTGVFFGNDFVTVTKAEGVEWDHIKPAILGAVMEHYQSGQPVMGADAQTGSGHAEHSGEDAEVVTQIKALLDSRVRPAVAQDGGDITFHGFDRGVVYLHMQGACAGCPSSTLTLKMGIENLLRHYIPEVTEVRPVAV

SEQ ID NO: 24597 - protein, 326 aa, Lactococcus lactis subsp. lactis Il1403
MELFESLKQKISGKGLKIVFPEGTDARILGAANRLNADGLITPVFIGNVKEVTETLISRGINPEGFEIYDPENCGRFETMTETFVERRKGKVTEEQAKELLKDPNYFGTMLVYMKIADGMVSGAIHSTADTVRPALQIIKTKPGVKSVSGAFIMVRGRDDNEKYIFGDCAINIKPDAPTLADIAVASAETAALFDIDPKVAMLSFSTKGSGKSEDVDKVVEATKLVKEDYPEIEIDGELQFDAAFVPAVARQKAPDSTVAGRANVFIFPDIQSGNIGYKIAQRLGNFEAIGPILQGLNAPVSDLSRGSNEEDVYKLAIITAAQALK

SEQ ID NO: 24598 - protein, 206 aa, Lactococcus lactis subsp. lactis Il1403
MKKTLIIGVTGGSASGKTSVSHAILETFSNERIAMIEHDSYYKDQSHLTFEERTKTNYDHPLAFDTDYLIAQLKELQYGRAVDIPIYDYAKHTRSQETYRQEPVDVLIVEGILVLEDERLRDLMDIKIFVDTDDDVRIIRRIRRDIEERGRTLDSVITQYLDAVKPMYHQFIEPTKRYADVIIPEGVSNTVGVDIITTKIASILND

SEQ ID NO: 24599 - protein, 477 aa, Arabidopsis thaliana
DLPPSPPSLPIIGHLHLLLSVLLHRSLQKLSTKYGSILYLRVFRFPVVLISSASIAYEIFRAHDLNISYRGFTPTDDSLFAGSFSFISAPYGDYWKFMKKVLVTNVFGPQAHEQSRGVRADVLERFYGNLFDKAIKKQSVEICAEALKLSNSSICKMIMGRSCSEERFRALATELDVLTKKLFFANMLRAWFKKLVVSLFKKETTVISYRFDELLESILVEHEKKLDVHHQRTDLMDALLAAYRDENAEYKITRNHIKSIIADLLFAGTENQVQTIQWAMAEIINNPNVLERLRGEIDSVVGKSRLIQETDLPKLPYLQAVVKETIRLHPPGPFFLRFTKEGCRIRGFYVPENTSVVVNVYAVMRDPDAWEDPLVFKPERFLASSRAEQEEERREKEIKYLPFGSGRRSCPGENLAYVIMGTAIGVMVQGFEWRTTEEKINMDEAVVGLSLTMAHPLKIIPVARTSNSLTSSLQKCL

SEQ ID NO: 24600 - protein, 977 aa, Oryza sativa Japonica Group
MAFGANDIVLHIKRLMYSSVRIGYQFACDYPIVLAAGVLLLFLHRLCPSLFNFLLSSSPVFLLTALLLGALLSYGEPAVLVLGENQQTLSFKSKISITDCSIDKVETVAVEEHLDKTTTSNEVYVRERNFEGNIHDTHWEEKNGTYMTVDTALNEEIHTKDGTSDYDLQDTHREGKGITSVETDTVPCVAPSSFAYSGVTVETEDVGENSKKNDELQELGSINPESDNNKVQYQYQLGEFMSSCWEPVMRQEPQDACSDSESDLTESSPDASMTDIIPMLEELHPLIDLQTGHPSLVSRDNLNTSSDDDEDDLEEEDASTDENQLEGKIDDFANWKDVIDLNYLDMDNNSKLEGMMDLQRAKNILKFELDKRLMDLQAADAVQKMEEASRFRVQVPSISTGRQNPFDSSNGSDEIIELPHVPDSAPSCLLPRKNLFDLAVNQNMAHDSPLQETWTPLSYFSARRHRKHGNLYVRHSTSLHHNSFKLEKDEISENDAHKSHNSQSDGDAKQERNNSTLFGSLEAHIGEEIKILGMAISEVGVLEVNSGMVSSNQNADFSDDISSSPFQKPRQSTFEAKDTVHAGIEQLTSCSPYKVNNFEAHIVEADSIDEFNSLFKCRMEEVLVQSISKSSISQPLTVKLEDELSEPLSPDSGTGTHFIDGSSVEDSDPRFAQLNDEALVSSTSNATCRNESIEEKSSEALLAGNEDYSELPNELLKSGDPQTADSSEIQVQEQQCDTVEHQLQFLGLTVKKQSLHKSPTTTTTRTRGKSVMSHRDATLFSSDVASLAAPNFLLDGVINFVMAHMTTELGDESLLLVSPSVASLLANLQDYEPETVADTAQALLLASRRMVLFPVNNSERLDKADDGSHWSLLVLDNITGRFVHHDSMDGANLPAATRLADALRPLLPAPPQGPPISGPTPQQSNGYDCGVYLLAVALAICRWWKKHPRTEEAAPCWFESVMDQVTCERFTRLCIKE

SEQ ID NO: 24601 - protein, 254 aa, Zea mays
SELKKITRRFKEKVGQGGFGSVYKGELPNGVPVAIKMLENSIGEGEEFINEVATIGLIHHANIVRLLGFCSEGTRRALIYEYMPNESLEKYIFSNDSSISQDLLVPKKMVDIALGIARGMEYLHQGCNKRILHFDIKPHNILLDFNFNPKISDFGLAKLCARDQSIVTLTAARGTMGYMAPELYSRNFGGVSYKSDVYSFGMLVLEMLSGRRTSDPSVDSQNDVYLPEWIFERVITGQDLVLSREMTAAEKEKC

SEQ ID NO: 24602 - protein, 193 aa, Staphylococcus epidermidis ATCC 12228
MNIPNQITVFRVILIPFFILFALVDFGFGQISILGGNHIRIEILISAIIFVVASLSDFADGYLARKWQLVTNMGKFLDPLADKLLVASALIVMVQLGFTNSVVAIIIIAREFAVTGLRLLQIEQGFVSAAGQLGKIKTAVTMVAIIWILLGDPFVHYLRFPIGVWLLYIGVFFTILSGIEYFYKGRDVFKHSK

SEQ ID NO: 24603 - protein, 332 aa, Bradyrhizobium japonicum
MQTGSTPHDDRAGVSANGILGAQARGASGRLLPEIWMQDGAKRVEEALARLLCAEDDGETELMAAMRYATLHGGKRTRALLCLAAGALADTPAHMLDDVGAAIEMMHACTLVHDDLPAMDDDVLRRGLPTVHVKFGEATAILVGDALQAHAFLTLASLNAPGDSPIALVRELAQAVSAEGAAGGQAIDLSLVGKHVELDRIVAMHRMKSGALVRASVRMGALCAVGVNAAHAALYCALDHYSACFGLALQVIDDILDVTADTAALGKTPGKDAAAQKPTCASIMGLQEARQFALDLLRDAGEAIAPLGPRAERLAQLIQRANAYLFKHAPRA

SEQ ID NO: 24604 - protein, 433 aa, Sulfitobacter sp. EE-36
MSDFEMMGLPRRLVKALTNMGMTDPTPIQKQAIPHGMNGRDVMGLAQTGTGKTAAFGIPLVAQMLEREARPEPRTVRGLVLAPTRELANQIMENLKGFCEGTQLKTMMIVGGQSINPQIKRMERGVDLLVATPGRLLDLMDRRAVLLHKTTFLVLDEADQMLDMGFIHDLRKIAAVLPKERQTMLFSATMPKLMNEIANSYLNSPIRIEVSPPGKAADKITQEVHFIAKAEKKSLLIELLGKHTEERALVFGRTKHGCEKLMKDLVKAGFKAASIHGNKSQGQRDRAIESFKKGEVTVLVATDVAARGLDIPDVKHVYNYELPNVPDNYVHRIGRTARAGKDGAAIAFCAPDEMGELKDIQKTMKISIPVASGRPWEAIDEPAKPKGRGGRGRGRGGRPGGGGGNGGGGNGGGAGKPAGAARRRRKPAGQRAA

SEQ ID NO: 24605 - protein, 159 aa, Glycine max
MVSELINANPIIYEKKERRPRTAPSAPHDEYAVELIDQQEVFDHIRDIKDPEHPYSLEELKVITEEAVEVDDQRNYVRVMFTPTVEHCSMATVIGLCLRVKLMRSLPSRYKVDIRVAPGSHATEAAVNKQLNDKERVAAALENSNLLNMVDDCLAPSYD

SEQ ID NO: 24606 - protein, 270 aa, Oenococcus oeni PSU-1
MITLKSINEIKEMDQAGQVIAGMHHMLRDLIKPGLDTWEIEEKSRAYIENHGAIASQIGFEGFKYAVTVSVNNEVAHAFPRKGLILENGDLVKVDTVVEKDHGLADSAWTYRVGTVSPEIERLYEVAHKALYVGIDHALVGNRIGDIGAAIDHFVTDENHFGNVREYIGHGIGPTMHEDPQVPHFGVAGHGLRLRPGMTITIEPMVNTGTWEVTTDYAGDGWTVATKDGGWSAQFEHTIVITHDGPKILTSQDPEIDDKYLIKNWDNFEI

SEQ ID NO: 24607 - protein, 395 aa, Bacillus cereus ATCC 14579
MKLAKRVAALTPSSTLEITAKAQALKAEGHDVIGLGAGEPDFNTPEHIMDAAHKAMLEGHTKYTPTGGLQSLKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGVEYTSIAQLSNALKEQTLIINGVSKSHSMTGWRIGYAAGNKQLIKAMTNLASHSTSNPTSIAQYGAIAAYTGSQEPVETMRQAFEERLNIIYDKLIQIPGFTCIKPQGAFYLFPNVKEAVALSGYATVDDWAKALLEEEKVALVPGTGFGAPNNVRLSYATSLEQVEKALERIHTFMKSKVQA

SEQ ID NO: 24608 - protein, 502 aa, Oryza sativa
MAMMAMGAASWAPIPAPARAAAAFYPGRDLAAARRRRGAAAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNISGYKNEGFVEVLAAQQSPENPNWFQGTADAVRQYLWLFEEHNVMEFLILAGDHLYRMDYQKFIQAHRETDADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 24609 - protein, 104 aa, Oenococcus oeni PSU-1
MAISVLNSDSFEEATKSGVTVTDFWATWCTPCKIQAPILEKLSNEMSSVKFGKIDVDQNQETANGLGIKAIPTLIVKKDGEVVDRIVGVHNQKQLTDIIDKYTK

SEQ ID NO: 24610 - protein, 201 aa, Brassica napus
  misc_feature (179)..(179): Xaa can be any naturally occurring amino acid
MSCSSSSGSEGEEEGFDSYRKGGYHAVRIGDPFSGGRYIAQRKLGWGQFSTVWLAYDTLSSSYVALKIQKSAQQFAQAALHEIEFLSAAADGDLQNTKCVVRLIDHFKHAGPNGQHLCMVLEFLGDSLLRLIRYNRYKGLKLDKVREICRCVLTGLDYLHRELGMIHSDLKPENILLCXTIDPCKDPVRSGLTPLLEEPEG

SEQ ID NO: 24611 - protein, 641 aa, Ostreococcus tauri
MRACARAVTRRWRPGRWTRASFGDGGARAPAIGADGDDDARDVGECAWTRRPRRRTYATSRTEDGDDGAPRTMVPWNRTVISGVELLRSGRYNKGMSFARDERDRLNLRGLLPPAVFDQATQVERVIERLRRVTSGVEKHAWLPALYERNERLFYRVVKDHLEELLPVLAEPTVWQVCREAGLMYRQPRGLYVSMQDKGSVYRLLKNWPVRNVKAVVLTDGQRVTGIGDLGVQGMPAAVSKASLFTALGGLDPADVLPICIDVGTDNQTLLEDKFYIGLRQKRVGGEAYEELLDEVVSGLKRRFGPRVLLCFEEFSNANAKKLLSRYNRDSVAYVDDLQGVAAITLAAVISSLPRMGGSLLDQRFLFAGAGETGAHAADLLATYIAQEHGITLPEARKNMYFIDRKGLLTRRRAEQEDDLEFHKLPYAHDIPDGCGKTVLESVELLKPTALIGVRRHRFSFFEGSKLCDEKLFTTDVLGAMAKHTERPLIMALSRPAALHECTAEEAYAATDGRCIFVGACRSTSFEFGGRTISPSECSTDYIYPGLGLGLAIAEGTRLRDSLIIEAAQAVAASTTDADIDQGAVFPRKRLIPDVSARVAARVASKAFASGLSALPVKPKGDWLGLAKSWMFDPTYRPYTH

SEQ ID NO: 24612 - protein, 198 aa, Griffithsia japonica
TDAQPPQTTSNEPHPLQFKWTLWHDVFVKGKGAYAANLREVASFDTVEDFWALFNNLKEPSQLKPGNTYNLFKAGIEPKWEDPHNDAGGEWRVSLPSTRREVLDEYWINTVLTVIGEGFGPDESDDIAGIVLNIKRGNDRIAIWTKTALNEQLQDRIGKRWRETANIVTIRMEYTVFKDSLMATSKNSNKKARVRYLI

SEQ ID NO: 24613 - protein, 752 aa, Oryza sativa
  misc_feature (155)..(155): Xaa can be any naturally occurring amino acid
  misc_feature (182)..(182): Xaa can be any naturally occurring amino acid
  misc_feature (211)..(211): Xaa can be any naturally occurring amino acid
  misc_feature (312)..(312): Xaa can be any naturally occurring amino acid
MTRTAIARPPPMDIEDGWRRLAAGFQKLLRILDGEERLSFSGAEYSELLQITYKLCYESPAGHAAEMYDRWDKTIRHHIVYQVLPSLQDMQGEPLLKNFVHHWENHKVLMKWLKSVCMYLRLAFTNQRSLPPIMDIALNLFKNVVFEELNKKMTXIIIEMIEEDRAGKVMDCNLIKMTLSVXAELGRGGNGMDVYEGFEEVFLKNTAEHYXRKAQAWVSRGSCSKYLVKVIKSIQEEEERIQNYLKPWTEARLSKTVLLELVSRQAEWLLDDDKSGFRGILAAENDLLDDGKGNELNLMFRVFSRISGGLLXMAIAFQQHIRDILQQAVGAAHMEKGKEPSNSIVEVFVLRIMKVLQKYEAHVINNFDNHILFRKALDENFRMICNRNIADFSDGEFFIIFLERLIEQRTCGKLDDDSVEDTLAKVVKLLPYLHSKDYLVELYRNRLLGRLSIGCNIEVETSFITKLKLVLDVSILEDMLEDYSISKELQKFFKDYMSMNPESNTLVDMDTMVLKQGHFPSQQKQHLSLPPDMLNCAEAFEKFYQEFHGQATGNRRGRTLTWIYSLGNCNIVGNFEGKSVEMIVSPMQAALLLLFNEDDRLSYNDIVAKLEIMDNDAKVMLYSLSCGKYSILKKEPSNKTIAPDDIFEFNNNFSVKTGKIKVPLHHVDRGDFRASETMEDVRRYRKQNVDCAIVRIMKDRKTLDHEKLVEECKKLCDPYFKVDDDLIQMRIDHLVAENYLARKEGCTYEYLP

SEQ ID NO: 24614 - protein, 256 aa, Botrytis allii
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFDAKA

SEQ ID NO: 24615 - protein, 288 aa, Griffithsia japonica
MISTVSVFLFFALVATAFAASGTAYVADKQCAEKGGTSPDTVSYSYDMTVGENGPGEWGDSEEFSTCKTGQIQSPIDFPTEVQYGMKMDGPMPNISVSDFEMSAGSFNWALNCKESQTCGYTMFGGEKYYVLNIHMHSPSEHWLNGKQYPLEAHIVHLTPEGKPLVIATMFETYDADAYPVRVYENANMLYGTNPFLKSILNNVAKGKQEFPVHLGSIIDASKGYCSYVGSLTTPPCTEGVTFMMAQKVQMMNPKQAREYLRTAGACVDGNARPIQELNGRQVTCYIK

SEQ ID NO: 24616 - protein, 589 aa, Debaryomyces hansenii CBS767
MSVNSKVSREKSHSFSEVDHIRSGSLESTGNGGIWQSFKNSFKPAEQSRTLTLKDISEEEEAKLTNVERAALRSANSQLSRSLKSRHLQMIAIGSSIGTGLFVGSGGALRDGGPAGLIIAWTVISTGVFATVQGLGELSVALPVSGGFNIYATRFIEPAVGFAIGWNYFMQFFVLLPLELVAASITIKYWNSDLNSDIFVAIFWVSVVFITMLGVKGYGEAEFVFSLVKVVAIIGFIILSIVLICGGGPTHEFVGGSNWREPGPFANGFKGVCSVFVTAAFSFGGTEMIGLTAAETANPRKTLPKAIKQVFWRICLFYLLSLTMIGTLVSYKDESLIGASDVDATASPFVIAIRNGGIGGLPSVINAVILIAVLSVGNSSVYATSRSLNSLAEQGMAPKWTGYVDRAGRPLVAILITNVFGLFAFIAASDKQVEAFDWLLALSGLSSIFTWISINVAHIRFRRAMSYQGRTTAELPYVSQCGVWGSYYALLLNCLVLIAQFWIALFPLGGSPNAYDFFLSYLGLPVILMSWLGYKLWKKDWTLFIRAKNLDIDTGRINIDIDVLQQEIAEEKAQLAEKPFFVRFYKFWC

SEQ ID NO: 24617 - protein, 294 aa, Arabidopsis thaliana
MALTNNLWAFVFGILGNIISFVVFLAPVPTFVRICKKKSTEGFQSLPYVSALFSAMLWIYYAMQKDGTAFLLITINAFGCVIETIYIVLFVSYANKKTRISTLKVLGLLNFLGFAAIVLVCELLTKGSTREKVLGGICVGFSVSVFAAPLSIMRVVVRTRSVEFMPFSLSLFLTISAVTWLFYGLAIKDFYVALPNVLGAFLGAVQMILYIIFKYYKTPVAQKTDKSKDVSDHSIDIAKLTTVIPGAVLDSAVHQPPALHNVPETKIQLTEVKSQNMTDPKDQINKDVQKQSQV

SEQ ID NO: 24618 - protein, 474 aa, Silicibacter sp. TM1040
MANAKGKVTQIIGAVVDVQFDGELPAILNALTTDNNGKKLVLEVAQHLGENSVRTIAMDATEGLVRGQEVTDTGAPISIPVGNATLGRILNVVGEPVDEGEPIVAKETRAIHQPAPEFNDQSTESEVLVTGIKVIDLLAPYAKGGKIGLFGGAGVGKTVLIMELINNIAKVHSGYSVFAGVGERTREGNDLYHEMIESNVIKPDNLEESQVALVYGQMNEPPGARARVALTGLTLAEQFRDQSGTDVLFFVDNIFRFTQAGSEVSALLGRIPSAVGYQPTLATDMGAMQERITSTKNGSITSIQAVYVPADDLTDPAPATTFAHLDATTVLNRAISELGIYPAVDPLDSSSRLMDPQIVGEEHYKVASDVQQILQRYKSLQDIIAILGMDELSEEDKLTVARARKIQRFLSQPFDVAKVFTGSDGVQVSLEDTIASFKAVVAGEYDHLPEGAFYMVGGIDEVIAKAEKMAADAA

SEQ ID NO: 24619 - protein, 369 aa, Pseudomonas putida GB-1
MPSRRTFLQLSLAAGLGAGLGLPLGLARAEEPGRWFMPDEGELQQRAFIAFGAQDAIWEDFTADVQAALGRISQAIARYQPVTVFCRASERQLAEQHCGHHNTHFVECQLDDIWMRDIGANFVVDDDGALAAVDFNFNGWGNKQRHRNDAQLAKRVATLANARYQRSELVGEGGAIEVDGHGTGIMTESSWVNANRNPDWSKAEVEAELKARLGLSKIIWLPGIAGEDTTDGHVDFYARFVRPGVVIANLDNDPDSYDHAVTRKHLEILKQATDAEGRKLQVHVVSPPLRGRRNKFSKGNDDFAAGYINYFVINGAIIAPQFGDAQADEKARALLAALYPGRDIVQLDIDAIAAGGGGIHCVTHQCPAV

SEQ ID NO: 24620 - protein, 232 aa, Neisseria lactamica
DQGAGVTYLESSASQIGHKESIKDTARVLGRMYDAIEYRGFGQETVEELAKYAGVPVFNGLTNEFHPTQMLADALTMREHGGKPLNQTSFAYVGDARYNMGNSLLILGAKLGMDVRIGAPEGLWPSEGIIAAANAVAEETGAKITLTANPQEAVKGVGFIHTDVWVSMGEPKEIWQERIDLLKDYRVTSELMAASGNPQVKFMHCLPAFHNRETKIGEWIYETFGLNGVEVT

SEQ ID NO: 24621 - protein, 346 aa, Pseudomonas putida GB-1
MHLSLNSGWRMPAEWARHAATWMVWPHNQAVWESGWHVRLADVQQDYARVAAAIARFEPVKMVVDPSAMASARALCGANIELIELAVDDSWCRDSGPSFVCHPQHGLAGLSWRFNAWGGKSHHSLDRSLGRRMLDQLGLDGFSTSLCNEGGAIHVDGEGTLITTESVLLNPNRNPGISKAEFEACFARYLGISKTIWLPGDPQYVTSDMTDGHVDGVCAFARPGVLLVDATHEQHSVYAEVVRENRRALELATDAQGRHFELLDLYEASAAVDQNAEVFCASYTNFYIANGAIIMPAYGIAADQEAAAQLGHAFPGREIVPVRIDHIAYGGGGIHCITQQQPEVQP

SEQ ID NO: 24622 - protein, 580 aa, Lactococcus lactis subsp. lactis Il1403
MSVLEKIDSPADLKKVSNQELEELASEIRTAVLHKVSNIGGHVGPNLGVTELTIALHKVFNSPIDKFIWDVSHQTYPHKILTGRKNGFTDGHFHDITPYTSQRESEHDFFTVGHTSTSIANALGYAKARDLTNDKGNIVAVIGDGSLSGGLAMEALNNAGDFKGNLIILVNDNQMSIAENHGGLYRNLAELRATNGQAENNFFKTFGLDYKYLENGNDIESLIHLFEEVKDIDHPIVLHIHTEKGRGYQPALENKEAFHWHMPFDLETGQSKVIDSGKSYSSVMLDYMDKKVSEGLPLVAINAAIPGIFGLKQFAAKYPDRYIDAGIAEQFTITFGGAMAAAGARPIIFHNSTFVQRAYDQFWHDLAINEEPAIVIVKGGVISGSDETHQGSSAMTWISNIPNIKYLAPTSEEEFISILDWALEQHEEPVVIQMPEHGLESRPTVLTDYSTPSYQMTKSGEKVALLALGGLYSHGEKVAKVLAENGINATLINPLFINDLDQAFLENLVENHQVIATIEDGILDGGFGQKVASFLGKYDVKVLNFGAKREFNDSVPVTELYNRYHLTPELMVADILSLLK

SEQ ID NO: 24623 - protein, 471 aa, Mycobacterium smegmatis str. MC2 155
MGSMLEYDLVVIGSGPGGQKAAIAAAKLGKSVAVVERGQMLGGVCVNTGTIPSKTLREAVVYLTGMNQRELYGASYRVKEKITPADLMARTQHVISREQDVVRSQLMRNRVDIISGHGRFVDPHTVLVEEPSRGERTMVGGEYIVIATGTKPARPAGVEFDERRVLDSDGILDLVSLPASMVVVGAGVIGIEYASMFAALGTKVTVVEKRDNMLEFCDPEIVEALKFHLRDLAVTFRFGEEVTAVDVGSAGTVTTLASGKQIPADTVMYSAGRQGQTEHLDLANAGLGVDGRGRITVDSNFQTKVDHIYAVGDVIGFPAQAATSMDQGRLAAYHAFGEPAKGMTDLQPIGIYSIPEVSYVGATEVDLTRNAIPYEVGVSRYRELARGQIAGDSYGMLKLLVSTEDLRLLGVHIFGTSATEMVHIGQAVMGCGGTIEYLVDAVFNYPTFSEAYKVAALDVMNKLRALSRFRT

SEQ ID NO: 24624 - protein, 425 aa, Sulfitobacter sp. EE-36
MSTIIDIHAREIIDSRGNPTVEVDVTLEDGTMGRAAVPSGASTGAYEAVERRDGDKNRYMGKGVLEACASVNGEIADALVGIDATEQVEIDGTMIELDGTDNKSRLGANAILGVSLATAKAAADYCSQPLYRYVGGTSARMLPVPMMNIINGGEHADNPIDIQEFMIMPVAAENIRDAVRMGSEVFHTLKKELSAAGLSTGIGDEGGFAPNISSTRDALDFILKSIEKAGYKPGEEIYLALDCAATEYFKDGSYVLSGEGKTLTSAENVDYLAALCADYPIISIEDGMSEDDWDGWKLLTDRLGDKIQLVGDDLFVTNPERLAEGIKRGSANSMLVKVNQIGTLSETLQAVDMAHRAGFTNVMSHRSGETEDATIADLAVATNCGQIKTGSLARSDRLAKYNQLIRIEESLGVTAEYAGRSILKG

SEQ ID NO: 24625 - protein, 232 aa, Neisseria lactamica
DQGAGVTYLESSASQIGHKESIKDTARVLGRMYDAIEYRGFGQETVEELAKYAGVPVFNGLTNEFHPTQMLADALTMREHGGKPLNQTSFAYVGDARYNMGNSLLILGAKLGMDVRIGAPEGLWPSEGIIAAANAVAEETGAKITLTANPQEAVKGVGFIHTDVWVSMGEPKEVWQERIDLLKDYRVTSELMAASGNPKVKFMHCLPAFHNRETKIGEWIYETFGLNGVEVT

SEQ ID NO: 24626 - protein, 139 aa, Zea mays
  misc_feature (67)..(67): Xaa can be any naturally occurring amino acid
  misc_feature (75)..(75): Xaa can be any naturally occurring amino acid
VDPRVRKKLFTLSKDFYVRKYVNPYRRAFSSKNGKKVSKAPKIPRLVTPFPPQRKGARIPSKKKGIXKKSFRLFXYQKLFAQRLKEQRAPRSESLAQRRSKLFSPVKAFAPPPALENSVFWGLCKGYLGTGKGPPQLPL

SEQ ID NO: 24627 - protein, 109 aa, Oryza sativa Indica Group
LGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 24628 - protein, 249 aa, Populus trichocarpa
MKFNIANPTTGCQKKLEIDDDQKLRAFFDKRISQEVSGDALGEEFKGYVFKIMGGCDKQGFPMKQGVLTPGRVRLLLYRGTPCFRGYGRRNGERRRKSVRGCIVSQDLSVLNLVIVKKGENDLPGLTDTEKPRMRGPKRASKIRKLFNLSKEDDVRKYVNTYRRSFTTKAGKKVSKAPKIQRLVTPLTLQRKRARISDKKKRIAKAKSEAAEYQKLLATRLKEQRDRRSESLAKKRSRLSIASKPSIVA

SEQ ID NO: 24629 - protein, 335 aa, Zea mays
GSRGTRKLGPLEGYSRAAAARAVEEARALLPAPAPDYDDEDLEERAYEAAEKVIVSISGGPDPEDVDGDGDGAELCSSSGSSPPPFSWRKLWLFTGPGFLMSIAFLDPGNLEGDLQAGAVAGDTLLWLLMWATAMGLLVQLLAARLGVATGRHLAELCRDEYPDWARRALWLMAEVAMVGADIQEVIGSAIAIKILSRGYLPLWAGVVITALDCFIFLSLENYGVRKLEAVFALLITTMAVSFAWMFTDTKPNGKDLLIGILVPKLSSRTIRQAVGGVGCVIMPHNVFLHSALVPSRKIDQNKEYQVREALRYYSIESTIALVVSFMINLFVTTF

SEQ ID NO: 24630 - protein, 759 aa, Pseudomonas fluorescens PfO-1
MLNTLRKIVQEVNSAKDLKAALGIIVLRVKEAMGSQVCSVYLLDPETNRFVLMATEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVPGSPGAAVGTAVVMLPPADLDVVPDKTITDIDAELALFKTAIEGVRADMRALSAKLATQLRPEERALFDVYLMMLDDASLGSEITNVIKTGQWAQGALRQVVTDHVNRFDLMDDEYLRERASDVKDLGRRLLAYLQEERQQNLVYPEKTILVSEELTPAMLGEVPEGTLVGLVSVLGSGNSHVAILARAMGIPTVMGLVDLPYAKVDGIEMIVDGTRGEVYTNPSEVLRKQFTEVVEEEKQLALGLDTLRDLPCVTLDGHRMPLWVNTGLLADVARAQKRGAEGVGLYRTEVPFMINQRFPSEKEQLAIYREQLAAFHPQPVTMRSLDIGGDKSLSYFPIKEDNPFLGWRGIRVTLDHPEIFLVQTRAMLKASEGLNNLRILLPMISGIHELEEALHLIHRAWGEVRDEGTDVPMPPVGVMIEIPAAVYQTKELARMVDFLSVGSNDLTQYLLAVDRNNPRVADLYDYLHPAVLQALQTVVRDAHAEGKPVSICGEMAGDPAAAVLLMAMGFDSLSMNATNLPKVKWMLRQIHLSKAKDLLAELMTIDNPQVIHSSLQLALKNLGLAKMVNPAAVKPL

SEQ ID NO: 24631 - protein, 301 aa, Mycobacterium smegmatis str. MC2 155
EEIAMRDDDPEDTLGDVFLSAMFGDHPVGRPVIGSIESISEMTRAQLHSFHVRRYTPDRMVLAVAGNVDHDEVVALAREHFGRRLVQGRDAVPPRKGSGRVPGRPSLRVVERDGEQTHVSLGVRTPGRHWEHRWALSVLNTALGGGLSSRLFQEIRETRGLAYSVYSTVDTFSDSGALSIYAGCLPERFEEVVRVTTDVLETVARDGISENECRIAKGSLRGGLVLGLEDSASRMHRIGRAELNYGEHRSIEQTLAQIDAVTLDEVNAVARQLLTRDYGAAVLGPDTAKVALPQRLQDIAS

SEQ ID NO: 24632 - protein, 256 aa, Botrytis allii
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTNNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILGYTEDDVVSTDMNGDNHSSIFDAKA

SEQ ID NO: 24633 - protein, 152 aa, Frankia sp. CcI3
MAVEVGSVAPDFSLKDQNNEVVTLSEFQGKRNVVLLFYPLTFTGVCQGELCSVRDDLASFQNDDVQVLAVSVDSPFAHKVWADQQGYEFPLLADFWPHGAVASAYGVFNAERGISLRGTFVIDKEGVVRWKVVNNIPDARDQAEYLKALAIL

SEQ ID NO: 24634 - protein, 476 aa, Bordetella pertussis Tohama I
MHANFIDGAWLDGVDARPNINPSNLADVVGDYAQADAAQAGMAIAAASAAAHAWARSTGQRRADVLDAVGTELLARKEELGRLLSREEGKTLPEGVSEVTRAGHIFKFFAGEALRIQGEKLPMTRPGIEVDVTREPVGVVGIIAPWNFPIAIPAWKIAPALAYGNTVVFKPADLVPGSAWALAEILSRAGLPAGVFNLVMGRGSVVGQAILDDRRVNAISFTGSVATGRRVAEAAIGRMAKVQLEMGGKNPLVVLNDADLKVAVDCAVNGAFFSTGQRCTASSRLIVQKGIYPRFVEAVRERLQGLKVDDALAPGTDIGPVVDRSQFDQNLAYIAIGREEGAQLAWGGEPLKRANEGYYLAPALFVDCDNSLRIAREEIFGPVAAVIPVDSYEQALEVANDTEFGLSSGIVTTSLRHATHFKRESQAGMVMVNCPTAGVDYHVPFGGRKGSSYGPREQGRHAAEFYTSVKTAYTAA

SEQ ID NO: 24635 - protein, 256 aa, Botryotinia calthae
AYMLKYDSTHGQFKGDIKVLADGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFESKA

SEQ ID NO: 24636 - protein, 256 aa, Botryotinia calthae
AYMLKYDSTHGQFKGDIKVLADGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFDAKA

SEQ ID NO: 24637 - protein, 1222 aa, Ostreococcus tauri
METPSATPSEVAVHPLVLLSVVDHFGRCDEGDEASKRVVGVLLGEQRRGRIDVTSSFAVPFEEEDDASGIWFLDHVYLENMYRMSRKISAKEKIVGWYSTGPKLRDNDIDIHELFYAYAQEPVMVIVDVRAENANIPTSAFAAQIEVKEDGTEKQQKTFVHVPNSIQAFEAEEIGVEHLLRDVKDNTCTPAIRDGTLPVNHEIMGTFRMRVRPRGSTSRQRLDARRVSELVDPSRDRSARLDQQQGTKSRARTRVRRRRRYRGCRQGEQGERERKISGRRPEDDRRKVTSTSVVVIVRSSTRLAISFSHVRPKRRLARRRIAIIQICSFDASGFIRALRLTRRLASSHTRSLRARAAQATVSRRPSERALGAPSRDTGEMRAKNTAAAARKPTERRKSDAVDDDDASRPIASSAKNTKAKSSKKTNDASKSNDVGMEKDGHVEFAQAEALTGRRRTLEAKKKKSSGGFESMEILPEVFRAVKRKGYRVPTPIQRKAIPPALEGRDVVAMARTGSGKTAAFLIPVLSKLRTHSFESGCTVRGTFAFAKELSKFTNLRVAALVGGDSMEAQFADLSNNPDIIVATPGRLLHHVEEVKAFTLRTVCHVVLDERIGYWRWVSGSTLLFSATLPSALAEFVRVGLREPEVVRLDAEMKISTDLKMSFILMRNDEKVAALLYMLREVIPKGQQTVVFASTRHHVEWLHNLLEFEGVRVSSIYGSMDMMARKMALSKFRAKKADVLMVTDVAARGIDIPLLDNVINYDFPSKGKLFVHRVGRVARAGRTGNAHSFLVKEELGFLVDLHLFLGRKIAAASKLPPNSTEEAAEIARAADESATSIIGTCPLGALDMTVDRLRELMKERDELEGMERAASNAYKLYQKTRGAASSESMSRAQPLIHAGPHPLLCASGGVDATTQELAQITASIRAYRPQATVLEAEVASATKVNGSMRLTETSRAMQQKRLKDEKFIKAKREGKTIKGRALRPLGEDDPILNQEGLDNDVNDGGADYEAMAAPAEDAFNTGKFRDQDFFLDNAPRAVNHTELGLSTREGAYGALEDATMDLVEEDGAGISRQKKLYHWDARKKRYVHIRSDEIDLKRGGKRIKNEAGQRVSAVEAGATYKKWVAKTHKSITATGSMEDESTASQQVGTPRAPSKQKRRASSELAPAKTNSKMRIRFEKSAKRTRRRNKECPADEVAADEVAADEVAADEVAADEWRARRRTG

SEQ ID NO: 24638 - protein, 364 aa, Fusobacterium nucleatum subsp. nucleatum ATCC 25586
MIGIGIVGLPNVGKSTLFNAITKAGAAEAANYPFCTIEPNVGVVTVPDERLNELAKIINPQKIVPATVEFIDIAGLVKGASKGEGRGNKFLSNIRSTSAICQVVRCFDDDNITHVDGSVDPLRDIDVINTELIFADIETIDKAIEKHEKLARNKIKESVELMSVLPKVKKHLEEFKLLKTLDLTDDEKQILKNYQLLTLKPMIFAANVAEDDLATGNKYVDLVREFTKSIGSEVVVVSAKVESELQEMDEESKQEFLEALGVKEAGLNRLIRAGFKLLGLQTYFTAGPKEVRAWTIRIGDTAPKAAGEIHTDFEKGFIRAKVVSYDNFIKNSGWKMSQENGVLRLEGKDYIVQDGDLMEFLFNV

SEQ ID NO: 24639 - protein, 107 aa, Triticum aestivum
  misc_feature (14)..(14): Xaa can be any naturally occurring amino acid
  misc_feature (59)..(59): Xaa can be any naturally occurring amino acid
RTEPVGGKIKDCTXTVVAYEPVWVLAPGKVTTLDQVQEVHSNIRGGLKTNDSTEIIYTXRIMYGGSVTGASCKDFAGQPYVDVFLNGGAYIKPEFIDIMNPSTVKFT

SEQ ID NO: 24640 - protein, 251 aa, Fusobacterium nucleatum subsp. nucleatum ATCC 25586
MRRLVIAGNWKMYKNNKEAVETLTQLKDLTRDVKNVDIVIGAPFTCLSDAVKIVEGSNVKIAAENVYPKIEGAYTGEVSPKMLKDIGVTYVILGHSERREYFKESDEFINQKVKAVLEIGMKPILCIGEKLEDREGGKTLEVLAKQIKEGLVDLSKEDAEKTIVAYEPVWAIGTGKTATPEMAQETHKEIRNVLAEMFGKDVADKMIIQYGGSMKPENAKDLLSQEDIDGGLVGGASLKADSFFEIIKAGN

SEQ ID NO: 24641 - protein, 497 aa, Rhodopirellula baltica SH 1
MSSATESSSSNGAASPDETPDINLPAPEAKPAAKPAPDKFDFDLFVIGTGPGGEGAAMQAAKGGLRVGVAERYRQIGGGCTHWGTIPSKALRYAVTSTMKSLKNPVMREMGFAASPSMEQLNRGTQAIIGRQVTMRQSFYDRNSVPISRGQARFVDEHTITIDNGELITAAAFVISTGSRPYRPKGVDFSHPRIFDSDTILEMKDKPTSITVYGAGVIGTEYASMFRNLGIKVNLINTRDKLLEFLDDEIIDALSYHLRDQGVIIRHNETMESIEGLDDGVILRLKSGKVLKTDVFLWANGRQGNTDDLGLKNLPIEANSRGQIVVDEHFQTCLPHIYAVGDVIGIPSLASAAYTQGRAAGMHLLGRVDGNLRLNDIPTGIYTSPEISSVGSTERELTERCVPYEVGQAQFRSLARAQITGETTGMLKLLFHRETKEILGVHCFGANASEIIHIGQAIMNQPGRQNTIDYFIETTFNYPTMAEAYRVAALNGLNRLF

SEQ ID NO: 24642 - protein, 232 aa, Neisseria lactamica
DQGAGVTYLEPSASQIGHKESIKDTARVLGRMYDAIEYRGFGQEVVEELAKYAGVPVFNGLTNEFHPTQMLADALTMREHSGKPLNQISFAYVGDARYNMGNSLLILGAKLGMDVRIGAPQSLWPSEGIIAAAHAAAKETGAKITLTENAQEAVKNVDFIHTDVWVSMGEPKEVWQERIDLLKNYRVTPELMAASGNPQVKFMHCLPAFHNRETKVGEWIYETFGLNGVEVT

SEQ ID NO: 24643 - protein, 232 aa, Neisseria lactamica
DQGAGVTYLEPSASQIGHKERIKDTARVLGRMYDAIEYRGFGQEVVEELAKYAGVPVFNGLTNEFHPTQMLADALTMREHSGKPLNQISFAYVGDARYNMGNSLLILGAKLGMDVRIGAPQSLWPSEGIIAAAHAAAEETGAKITLTENAQEAVKNVDFIHTDVWVSMGEPKEVWQERIDLLKNYRVTPELMAASGNPQVKFMHCLPAFHNRETKVGEWIYETFGLNGVEVT

SEQ ID NO: 24644 - protein, 191 aa, Triticum aestivum
  misc_feature (64)..(64): Xaa can be any naturally occurring amino acid
  misc_feature (168)..(168): Xaa can be any naturally occurring amino acid
  misc_feature (185)..(185): Xaa can be any naturally occurring amino acid
MAAASAPLLLALALACAASLAAAGDTNRVYDPCTDTKIQRGDGFTFGLAFAANGAFYSASPSSXQLSLFRPKVDEISLLTVNTTTGFSPASAGGYMVAFAGRKYAARSQPVFVSNSSVTVSSFTLVLEFNKGKLQNLHWKKDGCGACTGKPNFICLGKQTCAIRTNIXQSNNPGSMDCSIGIQLXFSGTDK

SEQ ID NO: 24645 - protein, 103 aa, Brassica napus
MEMEKKQGFFSALRDEVIRSFTPSRSRPRSRSASPSRSNLHMKALLWGRKKLLASSGCSRTAAGGYHLASQPEPFIGRSESLRPVIEGPDPDNDQTQTDSKRI

SEQ ID NO: 24646 - protein, 232 aa, Neisseria meningitidis
DQGAGVTYLEPSASQIGHKESIKDTARVLGRMYDAIEYRGFGQEVVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVT

SEQ ID NO: 24647 - protein, 252 aa, Bacillus halodurans C-125
MDLQLKDKVVLVTGGSKGIGKGIAQAFVEEGAKVAIVARDAHGLQEAKRQLGNVLTIQADVTDKNEREKVFSQLLETYGTIDILVNNAGGSNGGLISETELSLFEEAFSLNYFSAVHFSQLALPVMKAKQSGAIINISSIFGRESGGKATYNSAKAAMISFTKSLADEVIRDGIRVNGIAPGSILHPTGNWQKRLEENREKMEQFIDQNIPAGRFGTVEEIANVAVFLASEKASWVVGATLNVDGGQSYSNF

SEQ ID NO: 24648 - protein, 297 aa, Bacillus subtilis subsp. subtilis str. 168
MRKKVRKAVIPAAGLGTRFLPATKAQPKEMLPIVDKPAIQYIVEEAAESGIEDILIITGRNKRSIEDHFDRSAELEFNLREKGKTETLKEMQQIADLANIHYIRQKEPLGLGHAVLCAEHFIGDEPFAVLLGDDIMVSETPALRQLMDVYDVYGTEVVGVQSVLPEDVSKYGIINTSGSQGHVYEVNDLVEKPSPEEAPSEIAVMGRYVLNSSIFSVLKTIGRGAGNEIQLTDALREVCRKEPIHARLLEGNRYDIGDKLGCFKASTEIGLMRPEMRSQLLAYLEDVIKRETKEMLR

SEQ ID NO: 24649 - protein, 411 aa, Hordeum vulgare
MGALKANGLDVPNGVLRSSMIPSWNLHTIVKRVLQSIRTVIFTSKLNLLMPFGPATIVLYYTTNWHGVIFLFSMLGITPLAERLGYATEQLAVYTGPTLGGLLNATFGNATEMIIAIYALKNGMIRVVQQSLLGSILSNMLLVVGCAFFAGGIIHRNKDQVFSKATAVVNSGLLLMAVMGLMFPAVLHFTHSEIQQGASELALSRFSSGIMLVAYASYLYFQLSSRNSSYSQIGSEEVPNEDATEEDEEVEISMWEAIAWLAVLTIWISVLSEYLVNAIEGASDSLNLPVAFISVILLPIVGNAAEHASAIMFAMKDKLDITIGVAIGSSTQISMFVIPFCVVVGWMMGQKMDLNFQLFETATLFITVLVVAFMLQDGVANYLKGLMLVLCYLIVAASFFVHVDPQASDDD

SEQ ID NO: 24650 - protein, 354 aa, Methanosarcina barkeri str. Fusaro
MEKTKTLEKVFKFFLIFVPLSLFAEYTHSSPIAIFVLASLAIIPLAKFIGESTEEISVRTGPALGGLLNATFGNATELIISFFALQAGLTEMVKASITGSIIGNLLLILGMAFFFGGLGKDEQEFNTTAAKTSASTLFLATAAIVMPAVFVLTSENPSDAIIETLSIAVSVIMAVSYLASLLFSLHTHKHLYTVDTTERVAKWSVKKSITILFISTVTVAVISEILVGTIEPLAENLGWTELFIGMIFIAIIGNAAEHVSAVTIAIKDRMDLALQIAIGSTTQVAMFVVPVLVFTSYFFENPMNLIFTTFELAAIVSAVLMVKSIIEDGKSNWFEGLQLLGTYGIMAVVAFLHP

SEQ ID NO: 24651 - protein, 557 aa, Staphylococcus epidermidis ATCC 12228
MSLSTLKRDHIKKNLRDTEYDVVIVGGGITGAGIALDASNRGMKVALVEMQDFAQGTSSRSTKLVHGGLRYLKQLQVGVVAETGKERAIVYENGPHVTTPEWMLLPMHKGGTFGKFSTSIGLAMYDRLAGVKKSERKKMLSKQETLNKEPLVKRDGLKGGGYYVEYRTDDARLTIEVMKKAAENGAEILNYTKSEHFTYDSNKKVNGIEVLDMIDGETYAIKAKKVINASGPWVDEVRSGDYARNNKQLRLTKGVHVVIDQSKFPLGQAVYFDTEKDGRMIFAIPREGKAYVGTTDTFYDNEKATPLTTQEDRDYLINAINYMFPTVNVKDEDIESTWAGIRPLILEKGKDPSEISRKDEVWEGESGLLTIAGGKLTGYRHMALEIVDLLAKRLKQEYGLKFESCATKNLKISGGDVGGSKNFEHFVEQKVDAAKGFGIDEDVARRLASKYGSNVDQLFNIAQTAPYHDSKLPLEIYVELVYSIQQEMVYKPTDFLVRRSGKLYFNIQDVLDYKNAVIDVMADMLNYSETQKEAYTEEVEVAIDEARTGNDQPATKA

SEQ ID NO: 24652 - protein, 292 aa, Lolium multiflorum
IELGLLEILVAAGGKSLTPTEVAAKLPSAANPEAPDMVDRMLRLLASYNVVSCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAITAHYPAIKGVNFDLPHVISEAPPFPGVTHVGGDMFKEVLSGDAILMKWILHDWSDQHCATLLKNCYDALPAHGKVVLVECILPVNPEAKPSSQGVFHVDMIMLAHNPGGSQRY

SEQ ID NO: 24653 - protein, 385 aa, Bacillus halodurans C-125
MIKPSRRLAPLATSVFTELANMKAAYKQDGRELIDLSIGSPDLPPPDFVVQKMNAYVSNPNQYGYAITGLAAFHEAVAQFYQRRYQVNVKPHQVLSLMGSQDGLAHLALAYVDAGDLLLAPDPGYPIYAASAHIAGAELYTYPLNEENQFMFDVETLPDDVKQKAKLMIVNYPGNPTAAMADEAYFEKLVAFGIEHNILIVHDYAYSELLFDQREALSIFSVPRAFETAIEFNSLSKSFNIAGARIGYAIGAESILQPLAALKSHLDYGVFLPVQYGAIEALEHGDAFLETQRELYEKRRNTFVEALQLNGWTVSKPGGGMFIWAKIPDDGRDAMSFVKQAMEHAGVIVTPGHAFGKEGEGYVRMALVQPETELRKAANQLAQIL

SEQ ID NO: 24654 - protein, 292 aa, Festuca arundinacea
IELGLLEILVAAGGKSLTPTEVAAKLPSAANPEAPDMVDRILRLLASYDVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVKCILPVNPEANPSSQGVFHVDMIMLAHNPGGNQRY

SEQ ID NO: 24655 - protein, 571 aa, Vitis vinifera
MSPIPMDVYSNGNVKNLETASTTVQIDDSDFLRLLDRPRPISIERNRSFEEKSFNELSSTLSPLLFHRNVEKNSFHIFDLLDHTFSPVRSSLNTPRSNHCFEPHPVFTDAWEALRRSLVYFRGQPVGTIAAIDHSSDELNYDQVFVRDFVPSALAFLMNGEPEIVKNFILKTLRLQSWEKKVDQFKLGEGVMPASFKVFHDPVRNYETLIADFGESAIGRVAPVDSGFWWIILLRAYTKSTGDSSLAEMPECQRGMRLILSLCLSEGFDTYPTLLCADGCCMIDRRMGVYGYPIEIQALFFMALRCALLLLKQDDKGKEFVELISKRLHALSYHMQSYFWLDIKQLNDIYRYKTEEYSHTAVNKFNVMPDSLPDWVFDFMPSRGGYFIGNVSPAKMDFRWFCLGNCVAILSSLATPEQSSAIMDLIESRWQELVGEMPLKICYPAFESHEWRIVTGCDPKNTRWSYHNGGSWPVLIWLLTAACIKTGRPQIARRAIELAESRLLKDNWPEYYDGKLGRYIGKQARKFQTWSIAGYLVAKMMLDDPSHLGMISLEEDKQLKPLFKRSLSWSH

SEQ ID NO: 24656 - protein, 378 aa, Populus trichocarpa
MAAISCHCAVPSKKVSLSSSSSALSTTPLSRCSRFSAVSVPSRASRGRISCQISSSSATSPPPPSSVNGPAKAGMEDFLHISDFDKATIMKILDRAAEVKAVIKSGDRTFLPFKGKTMAMIFAKPSMRTRVSFETGFFLLGGHAIYLGPDDIQMGKREETRDVARVLSRYNDIIMARVFAHQDILDLAKHATVPVINGLTDYNHPCQIMADALTIIEHVGRLEGTKVVYVGDGNNIVHSWLLLAAVIPFHFVCACPKGFEPDAKTVQKAQQAGISKIEITNDPQEAVRGADVVYSDVWASMGQKEEAAHRRQVFQGFQVDENLMKLAGPKAYFMHCLPAERGVEVTDGVIEAPNSIVFPQAENRMHAQNAIMLHALGL

SEQ ID NO: 24657 - protein, 448 aa, Bacillus subtilis subsp. subtilis str. 168
MTHDLIEKSKKHLWLPFTQMKDYDENPLIIESGTGIKVKDINGKEYYDGFSSVWLNVHGHRKKELDDAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECRDQCLRELAQLLEEHHEEIAALSIESMVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELSEMVAIMKQAIHEVTSLED

SEQ ID NO: 24658 - protein, 184 aa, Brassica napus
QVSFLHLPPPLHSQVPTTPNPVSPLRRRLRFGSARLEQKKMQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGLVTERDYLRKIIVQGRSSKSTKVGDIMTEENKLITV

SEQ ID NO: 24659 - protein, 135 aa, Brassica napus
  misc_feature (121)..(121): Xaa can be any naturally occurring amino acid
MSEYSFCFSTNMLRVYVILVICMHVCCASSDCTSHDEHDVVSQEEAERATTLKLGSIALLLVAGGVGVSLPLIGKKIPALQPENDIFFMVKAFAAGVILCTGFVHILPDAFERLSSPCLEXTAAGKFPFAGFVAM

SEQ ID NO: 24660 - protein, 180 aa, Griffithsia japonica
GTRIHRPAPTNRPSRTTRAQSRPFFTMGVDSYDPRVTHQLLELLYRHVSTVLLDARVCCDHADKPAIDADDVKLALRSRNTFTFTQPPPRDVTMRLAAERNAVPLPPIDARAGVALPPELGQLTRQNYRVMTQSNRPAKRSRLSQSPAARASYASYARPPRPPTGTEVIDLDAPMQQEAR

SEQ ID NO: 24661 - protein, 193 aa, Malus x domestica
MFLLDWFNGVLASLGLWQKEAKILFLGLDNAGKTTLLHMLKDERLVQHQPTQYPTSEELSIGEIKFKGFDLGGHQIARRVWKDYYAKVDAVVNLVDAYDKERFAESKKELDALLSDESLAAVPFLVLGNKIDIPYAASEEELRFHLGLNNFTTGKGKVNLQDSNVRPLEVFMCSIVRKMGYGDGFQWLSQYIK

SEQ ID NO: 24662 - protein, 159 aa, Bacteroides thetaiotaomicron VPI-5482
MKIRVGFGFDVHQLVEGRELWLGGIRLEHSKGLLGHSDADVLLHTVCDALLGAANMRDIGYHFPDTAGEYKNIDSKILLKKTVELIATKGYRVGNIDATICAERPKLKAHIPLMQETMAAVMGIDAEDISIKATTTEKLGFTGREEGISAYATVLIEKD

SEQ ID NO: 24663 - protein, 486 aa, Candida albicans SC5314
MTKKYSSTDLKSSKLLHRDLNSPPIVIDHANGNNLFTQDHHQLFDSVGGAAVISVGHNNKEVIDAITTQLQKVSYLHTGEFTVPIAEELAHELINNLDSSSGYSGGDVDPSKKIAKVYFANSGSEANEAAIKLVMQYFYEQGKHTKTQFISRHQSYHGNCLGGMSLSGHIARRKPYESIIDQSRFHKVDPCYEFRYKQSNDESNESSDQYVKRLLEQLENKILQIGPENVAAFFAETIVGATTGCVPATPGYFKGVREICDKYDILLVLDEIMCGSGRTGTFFAWQQEQEGEEQGGKSIIPDITTCGKAITSGYCPLSCVFFNKKILDVLSNGSSCFNCGHTYQSFPIACAAAHAVQKIIKRDNLLDNVVKMGVILQELLMMKIDPLEIVANIRGRGLFWGIEFCKNKSTLEPFNPSCNVSIKIGEYTKRNGVVVYPGKGTIDGIKGDHILIAPSFTITKEEIEFIVDIVAKSIKEFIANEVDLFK

SEQ ID NO: 24664 - protein, 474 aa, Silicibacter sp. TM1040
MIFDEFKTSIKNTADAGQLAATLIGEGVMIPGLRGDVPLVYADYVASGRAMRPVEDFIAEKLLPFYANSHTEASYCGQYVTRMRREARAEIARLTGAGDDCEVIFAGSGATAGLNRLVKLLGIEEATRPVVFIGPYEHHSNILPWRESRAEVVEIPEGPDGGVDLAALEAALVAHAEADLKIGSFSAASNVTGIITDPDPVTRLLRAHGALAVWDYAGGGPYLPIDMGAHGAEPKDAVVVSPHKFPGGPGASGVLVLRRDAVRAQNPSWPGGGTVSFVSPWSHRYADSLSAREEAGTPNVVGDIRAALAFLVKEAVGQEQIEAREAQYAAKARAAWADVPGLTLLGHAHAHRLPIFSFTVEGASGAPVHQQLFTRMLSDVYGIQARGGCACAGPYAHRLLEIDEPQSEALLRDLLAGRELQKPGWVRLNFSYLMAEETVDYVIESVKALVLEAENVASAYDADPSTARFQPRAA

SEQ ID NO: 24665 - protein, 503 aa, Nocardioides sp. JS614
MKELVDELRERLATARQGGSEKARRKHTDRGKLLVRDRVDRLLDPGSPFLELSPLAADGMYGGAVPSAGVVTGIGRVSGREVVVVANDATVKGGTYYPMTVKKHLRAQTVAADNRLPCVYLVDSGGAFLPMQDEVFPDREHFGRIFFNQANLSARGIPQIASVMGSCTAGGAYVPAMSDETVIVRNQGTIFLGGPPLVKAATGEVVTAEELGGGDVHARTSGVADHLAEDDAHALAIVRSIVETVGPRAAAPWEVHPVEEPHEDPTSLYDVIPADTRTPYDVREVIRRVVDGSRFHEFKKLYGETLVTGFARVWGHPVGIVANNGILFSESSLKGAHFIELCNQRGIPLVFLQNITGFMVGKEYENGGIAKDGAKLVTAVACSVVPKFTVVIGGSFGAGNYGMCGRAYDPRFLWMWPNARISVMGGEQAASVLATVAGRPDDEEFKAPIREQYETQGSPYYSTARLWDDGIIDPADTRRVLGMGLAAAANAPVPAPTYGIFRM

SEQ ID NO: 24666 - protein, 548 aa, Magnetospirillum magnetotacticum MS-1
MEMVHPVGLPAWKDLAALAATTGQKPMRDMFAADPGRFGRFSARLGDLLLDYSKNRIDAEVMAALIRLARQAGLAEARDAMFGGETFNITERRAVLHTALRNRSERPVMVDGQDVMPEIRAVLARMKTFAEQVRSGEWKGATGRAIQSVVNIGIGGSDLGPVMVTEALKPYQRDDLAVRFISNVDGSHAAEVLKLCDPETTLFIVASKTFTTQETIANAKTCRAWTVDKLGEAAIPNHFVALSTNARAVADFGIDTANMFEFWDWVGGRYSLWSAIGLSIAVAVGFGRFEELLAGGHAMDEHFRESPLEANLPVILALIGIWNANFLGADAYAVLPYDQYLHRLPAYLQQLDMESNGKGTARDGAMVGWGTGPMVFGEPGTNGQHAFYQLIHQGTRLIPCDFLAAAQTHNPLGEHHLMLLSNVFAQAEALMRGKTEAEARAELEKAGMSTAEIAFQLPHRVFPGNRPSNTLLYPRLDPFMLGQLIALYEHKVFVQGVIWDVNSFDQWGVELGKVLAKAILPELSSSAPVTNHDSSTTGLIEAVRALRR

SEQ ID NO: 24667 - protein, 595 aa, Bacillus subtilis subsp. subtilis str. 168
MSRLLVTLCQKQRNWPQPFLPTDRSLSVRLNLQSIKDWRQILLQALRLNKKRMNKPSRQKTGEKGFRPFKKKDGPYTREYKREAMLMDYEKERTERAERIRKGGAEKYHQSNREKGKLFVRERLSLLFDDDIELEDAFFAECMSDGLPADGVVTAIGKIGGQTVCVMANDSTVKAGSWGAKTVEKIIRIQEIAEKLNCPLIYLVDSAGARITDQINVFPGRRGAGRIFYNQVKLSGRIPQICLLFGPSAAGGAYIPAFCDIVVMVDGNASMYLGSPRMAEMVIGEKVSLEEMGGARMHCSISGCGDILAETEEEAIQLVRAYLSYFPANFQEKAPIHEKRPPKHFETPLADVIPQNQNAPFDMHELIERVIDEDSFFEIKALFAPELLTGLARIHGQPVGIVANQPKVKGGVLFHDSADKAAKFITLCDAFHIPLLFLADIPGFMIGTKVEQAGIIRHGAKMISAMSEATVPKLSVIVRKAYGAGLYAMAGPAFEPDCCLALPTAQIAVMGPEAAVNAVYAKKIAELPEEERAAFISSKREEYKEDINIYRLASEMIIDAVIPANSLRDELAKRLKAYMTKEMTFTNRKHPVYPV

SEQ ID NO: 24668 - protein, 131 aa, Oryza sativa
  misc_feature (24)..(24): Xaa can be any naturally occurring amino acid
  misc_feature (98)..(98): Xaa can be any naturally occurring amino acid
MVGGGRRGAAAEEVKLSTGNVFAXALETLKKKKKGGDKAKGGSSSSSGRKREQQGAQPSSQQQQQQQKEVFWAPAPLTTKSWADVEDDDDDDYFATTXPPRPVWGTGHGDDGAQKKMRGREDASRAFREVK

SEQ ID NO: 24669 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMASHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 24670 - protein, 165 aa, Methanosarcina barkeri str. Fusaro
MTERQVESVIVEIPKGSRNKFEYDNEKRLIKFDRMLSSSMVYPSDYGFFPDTLSLDGDPLDAMVLTWEPTFPGCVIEVYLVALFDMEDYKGRDQKILCVPKNDPMWNYIESVDQVPPHLFKEITHFFQTYKNLDKKQVKVIGWKSLETAVAVLQEAKDRYAEQKK

SEQ ID NO: 24671 - protein, 496 aa, Mycobacterium smegmatis str. MC2 155
MAKGVSIAISTGRMLAQGLAAREGQSMPRIDNSQGGDSLAAREFKGVAESFAPSGRAVRRVAVFGLGYVGSVTAACLASRGHSVIGVDVRREKVDMINRGQSPVVEGGLGELIFGEVAAGRLSATTNPADAVANTDIALVCVGTPSAANGSLLTTYLERVSEDIGAALAGRAGRYTVVIRSTVLPWTCEQIVLPRLQAASGLRAGEDFGVAVNPEFLREGSSIRDFFEPPKIVIGQFDAVSGDVVAQLYEGMSAPVFRVPLAVAEMVKYADNGFHALKTGFANEIGAVCKAMGLDSHAVMDIFVADTKLNISRAYLRPGFAFGGSCLPKDLRALIHRARTSDVPLPILESVCISNNGQIDRAFNVIEATGKRRVGLLGLAFKSGTDDLRESPLVALAERLVGRGFDLQIYDPQVSASRLLGANRAFAEARIPCLSQCVSDSPDEVVNHAEVCVVGAADPESIAALRRVDGRIVVDLVRFPGSVDYQDDPRYIGISW

SEQ ID NO: 24672 - protein, 1595 aa, Oryza sativa Japonica Group
MEFYAYSMLLILPLILYMSYHLTRTLAEKKPTTHGLKAHPLLGHLPAFVKNSHRFLDWSTELIAGSPEMRIGLWIPGMRSGIVTGNPADVEHILRTNFANYPKGQHAIGTLEDFLGHGLFNSDGEQWLWQRKNASYEFSKRSLRKFVVDVVQAEVANRLLPLLRRAAGDGVGGDAVVLDLQDVLQRFGFDTICMVAFGHDPRCLADGGVLEEAKSEFMHNFGEALDLVIGRFMDPIEVSWKIKKWLNIGTERRLKKAIADVHAFAMDIVRARRQSASVKDRDDVLSRFVASDEYSDEVLRDIVLSFLVAGRETTSSGLTWFFWLLSSRPDVVARIADEVRTVRKATGTRPGEPFGFDALREMHYLHAALTESMRLYPPVPTDPQSCAADDTLPDGTFVRAGWFVNYSAYAMGRLAAIWGEDCMEYRPERWLGDDGAFQPASPFRFTVFHAGPRMCLGKEMAYVQMKSIVANVIEELVVDVVKEVAGGGVPEHVFSISLRMKGGLPVKIRRKGHMRGTVRPSIQAAAPGPRWLRLAATLRPISPATAAVRYPLFPLACGHQVSAVTMAKEVDRFVELVVVRHGETSWNSSRIVQGQMDPELNEIGKQQAVVVARRLARKARPAAIYSSDLKRAAETVKIIAKVCDVSNLVLIEALRERHMGYLQGLTWDDAMNKSPGVFKGFANFEVKNGLDFDGRNHEFPDGGESLNQLSEQGISYLNKVAQNHIGERVIVVGHGAAILELCRHTDPPNSSIRRKIPNTSLNIFRISGVTGRWILERLLPRITPLPRRRLRRSHNPNPLISPAVAASLAGVLATRSTNPTWARSLAALLPSPLSDAHLAAAVSSLPDPDLAVALLSWSQSPDHHVALQDPTPLAHSTLLRLLARSRRFDAVDDTLQSMSLAGAAPTRACLGALVAAYADAGMLGKATEMCERVREQYGSLPEVTHCNRLLKLLVEQRRWDDARKLYDEMLGKDSGADNYSTCVLVRGLCLERRVEEGLKLIEARWGAGCIPHVVFYNVLIDGYCRRGDMGRGLLLLGEMETNGFLPTLVTYGSLINWLGKKGDLEKIGSLFLEMRKRGFSPNVQIYNSVIDALCNCRSATQAMVILKQMFASGCDPDIITFNTLITGLCHEGHVRKAEHFLREAIRRELNPNQLSYTPLIHGFCMRGELMVASDLLVEMMGRGHTPDVVTFGALIHGLVVAGKVSEALIVREKMTERQVFPDVNIYNVLISGLCKKRMLPAAKNILEEMLEKNVQPDEFVYATLIDGFIRSENLGDARKIFEFMEHKGVCPDIVSCNAMIKGYCQFGMMSEAILCMSNMRKVGCIPDEFTYTTVISGYAKQGNLNGALRWLCDMIKRKCKPNVVTYSSLINGYCKTGDTDSAEGLFANMQAEALSPNVVTYTILIGSLFKKDKVLRAGLYFETMLLNHCSPNDVTLHYLVNGLTSCTPCVINSICCNTSEVHGKDALLVVFKKLVFDIGDPRNSAYNAIIFSLCRHNMLREALDFKNRMAKKGYVPNPITFLSLLYGFCSVGKSVNWRTILPNEFQQEEFEIIFRYKFLFDQYATESVCCEVSRVLQHLAGCKSLQRVEQKFANS

SEQ ID NO: 24673 - protein, 366 aa, Lactococcus lactis subsp. lactis Il1403
MAKRIIGTTPKEDGFRMPGEFEAQDQIFMIWPERPDNWRDGAKPVQIAFTNVAKAISRFTPVTMLVSQSQYQNARYQLPADVRVLEVSNNDSWVRDCGPSFVINDKGELRANDWTFNAWGGLVDGLYFPWDQDDLVAQKVCELERVDSYRTDDFVLEGGSFHVDGQGTVLTTEMCLLSEGRNPHMSKEDIENKLKEHLNAEKILWLGDGIDPEETNGHVDDVACFVAPGEVACIYTEDEKSPFYEAAQDAYKRLNQMTDAKGRQLKVHKLTCPAKNVTIKKQFRIDTVEGTMPREDGDICIASYMNFLITNKGVIVPQYGDENDALALKQVQEMFPDREIVGVNTVEVVYGGGNIHCITQQQPKAK

SEQ ID NO: 24674 - protein, 502 aa, Oryza sativa Japonica Group
MPRRTDNAASANSVEPEKSEECLEFDDDEEEEVEEEEIEYEEIEEEIEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRTKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGGRYGGGGGSSGSSRPGAKRQRGDDNSSSRHKGRRRPY

SEQ ID NO: 24675 - protein, 350 aa, Zea mays
MAAGLGARPSATFVAGRFRPLAAPLRPVRSGKFVVPKRCFIVSSRLAWVEDELMEIQKSQEQSSVKSKKRPPLRRGKVSPQLPVPGHIPRPSYVGAKGLPELCKGQLHDAQGITGMRAACKLAARVLDFAGTLVKPSITTNEIDAAVHNMIIEAGAYPSPLGYHGFPKSICTSVNECVCHGVPDSTQLQNGDIINIDVNVFLNGYHGGTSRTFACGQVDDSIKHFLNAAEECLEKGISICRDGVNYRKIGKKISKLAYFYGYYVVERFVGHGIGTMYHSEPLILHHANENSGRMVEGQTFTIEPILTMEKTECVTWEDGWTTVTADGSWAAQFEHTILVTRDGAEILTKV

SEQ ID NO: 24676 - protein, 516 aa, Oryza sativa
FFFFFFFEDKNLFPFYLRIILTIPRTLNITGPRAICLFLSQCWIPKYREEIDGSRRNVAFPWMHRSRLGLGGIAAAATAAGNGGATAGNVHRAAYIRKQRDHRSGLYRPWRGHHRKQVNLHDEEDREDAEEMIRCSQSQILSLSPKKSSLSLLPALHDCTQLLPMASVAATTFPSMARPAARGIVAGAAASTVPLPRAGVASPCPTARSLGFAARGTDPRLAIHVSSRRRAASASAGSRLARAVATMAKKSVGDLAAADLEGKRVLLRADLNVPLDASQNITDDTRVIAAIPTIKHLIGNGAKVILCSHLGRPKGITPKFSLAPLVPRLSELLGIQVQKADDVIGPEVEKSVSVLPNGSVLLLENVRFYKEEEKNDPEFAKKLASLADLYKELDYLVGAVSNPKRPFAAIVGGSKVSSKIGVIESLLEKCDILLLGGDVIVADKFAPEANCQAIAKKLAELSGKGVTTIIGGKDSVAAVEKVGVANVMSHISTGGGASLELLEGKELPGVVALDEA

SEQ ID NO: 24677 - protein, 441 aa, Vitis vinifera
MVGTDENNPGVGVIGPANNQGGLRAGVGKFTTGIGHNRRALSSIDRNIIGVPPYPCAVNKRALSEKEAACDKKHPPIPMHRPITRKFAAQMASNKQQRAAIPEESRKLVLQSAPSELKDCVFVDAEDCKGTSDLPVPMSVQHTEAMLEEIDRMEEEIEMEDLVKEPVMDIDGSDNKNSLAVVEYIDEIYAYYRKTESSSCVSPDYMSQQFDINDRMRGILIDWLIEVHYKFELMDETLYLTVNLIDRFLALQPVVRKKLQLVGVTAMLLACKYEEVTVPIVEDLILISDKAYSRKEVLDMEKLMVNTLQFNMSVPTPYVFMRRFLKAAQSDKKLELLSFFIIELCLVEYEMLKFSPSLLAAAAIFTAQCTLNGSKHWSRTCEWYTRYTEEQLLECSRLMVSFHQQAGTGKLTGVHRKYSTSKFGHTAKSEPAHFLVEERPS

SEQ ID NO: 24678 - protein, 233 aa, Brassica napus
  misc_feature (211)..(211): Xaa can be any naturally occurring amino acid
MASTIAAQKPDDSEYEIIEGGSESALATGTSPWMNSATLKLRHRIGRGPFGDVWLATHHQSTEDYDEHHEVAIKMLHPIKEDQRKVVVDKFEDLFSKCQGVESVCLLRGVSSISGRICIIMKFYEGCVGDKMARLKGGKLSLPDVLRYGVDLVTGILELHSKGFLILNLKPSNFLLSDNDKAILGDVGVPYLLLSIPLPSSDMAMRLGNSXNYMAPEQGQPEVRGPLSFENDS

SEQ ID NO: 24679 - protein, 260 aa, Clostridium difficile 630
MEYYIVDSFATKLFKGNPAGVCVLDRRIPLELMQKIAEENNLPETAFVVKGKGNYELRWFTPKAEIDLCGHATLAAAYVISNFIDVNVKKIDFFTQSGKLEVTRNGNLYEMIFPEIMPIEIELSPQQANLIGCVPSDVYSSRDLILLLNSEQEVINYKPNYAQLRKLTDWLGIIITAQGSNTDFVSRYFCPELDSEDPVTGSSHCNLIPYWSEKLGKHKMVAAQLSNRGGIIQCEVLKDNTVKISGEAVLFMQGTIKIDI

SEQ ID NO: 24680 - protein, 337 aa, Vibrio angustum S14
MTDIRTLGEFIVEKQSDFPHASGELSSLLGSIKLAAKIVNREINKAGLVDITGTVGENNIQGEEQQKLDVYANDKFKAALEARDQVCGIASEEEDEAVGFDKPLNLNAKYVVLMDPLDGSSNIDVNVSVGTIFSIYRRVSPVGSPPTKEDFLQTGNQQVAAGYVIYGSSTMLVYTTGNGVHGFTYDPSLGSFCLSHENMTIPQDGVIYSINEGNYIRFPTGVKQYIKYCQEAVPEEKRPYTSRYIGSLVADFHRNLLKGGIYLYPSTASYPNGKLRLLYECNPMAFIIEQAGGKATNGFQRILDIPPTELHQRVPFFVGSTNMVEKVEGFLREYPDD

SEQ ID NO: 24681 - protein, 338 aa, Populus trichocarpa
MGKIKIGINGFGRIGRLVARVALQRDDVELVAVNDPFITTDYMTYMFKYDTVHGQWKHHELKVKDSKTLLFGEKSVTVFGVRNPEEIPWGETGADYIVESTGVFTDKDKAAAHLKGGAKKVIISAPSKDAPMFVMGVNEKSYTPDLNIVSNASCTTNCLAPLAKVIHDRFGIIEGLMTTVHSITATQKTVDGPSSKDWRGGRAASFNIIPSSTGAAKAVGKVLPALNGKLTGMAFRVPTVDVSVVDLTVRLEKGASYEDIKAAIKEESEGKMKGILGYTDEDLVSTDFIGDNRSSIFDAKAGIALNDNYVKLVAWYDNEWGYSTRVVDLITYIASVSE

SEQ ID NO: 24682 - protein, 214 aa, Paeonia delavayi
IVESVGEGVTDLKPGDHVLPVFTGECKECRHCKSEESNMCDLLRINTERGVMLSDGKSRFSINGQPIFHFIGTSTFSEYTVVHVGCVAKINPEAPLDKVCILSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVECTGSIMAMVSAFECVHD

SEQ ID NO: 24683 - protein, 124 aa, Oryza sativa Japonica Group
MATVSAAAATSVVARAVLAGPLGLPQMRARRSERVRCNYSKEAATPAAAVKGAGASLLAMAATAAPAMALVDERMSTEGTGLSLGLSNNLLGWILLGVFGLIWSLYTIYTSDLEEDEESGGLSL

SEQ ID NO: 24684 - protein, 68 aa, Populus trichocarpa
MTTSRRLADRKVDRFDKKVTKRGAVGETSTRKGKDYPVGPLLLGFFIFVVIGSSLFQIIRTASSGGMA

SEQ ID NO: 24685 - protein, 338 aa, Clostridium difficile 630
MKIKVGMNGFGRIGRAVLRIAQEELGDNIEIVPINARATTESLAHLFTYDSCYGTFRGEVEAKDEDTLVVNSKEIKILRYNDPEELPWKELGVDIVIESTGLFTQREKAEKHIKAGAKKVIITAPGKNEDITIVIGVNEKEYDNEKHNIISNASCTTNCLAPFAKVLDEKFGIVKGLMTTVHSYTNDQRILDKSHKDLRRARAAAESIIPTTTGAAKAVSRVLPQLEGKLNGFSLRVPTPTVSLVDLVCELKENVTSEQVNSVLKDAAEGELKGVLGYCDKPLVSIDYKGDSRSSIIDALSTMVIEDNMVKVVSWYDNEWGYSSRTVDLVKYVAEKLK

SEQ ID NO: 24686 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQILLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVFDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEIPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 24687 - protein, 496 aa, Photobacterium sp. SKA34
MSFASLGLSAPILEAVAKQGYEKPSPIQEQAIPAILAGKDVMAAAQTGTGKTAGFTLPLLERLANGRPARSNHVRALVLTPTRELAAQVGESVATYSKNLRLSSAVVFGGVKVNPQMLRMRKGADVLVATPGRLMDLHSQNAVKFRDVEILVLDEADRMLDMGFIRDIRKILALLPKERQNLLFSATFSDEIRELAKGLVSNPVEIDVNPRNQTARTVKQWICPVDQKKKPNLLTKLLNKRNWKQVLVFTKTKHGANKLATHLESRGISAAAIHGNKSQGARTKALANFKSGDIRVLVATDIAARGLDIEQLPQVVNFDLPHVAEDYVHRIGRTGRAGCVGEAISLVSAEEAKDLAAIERLTQQVFEREIIEGFKPTNALPQSKLDTRPIKPKKPKKQKTFVARDGGATGEKRSANNNTGAKRKPASRRPQGQSADAANNEKRSEQGARPARKPRNTDAKPQSNGDQPRRRFNDEKPKSDGRRRSPQRSRAPKATA

SEQ ID NO: 24688 - protein, 166 aa, Griffithsia japonica
GTRSNPSFTEMLKGSLVPSFGEPVGKGIFLSVSIIGSVVMAHNLFLHSWLEQKRADEAEEASSGHQVFNMNGRLSGLDKRLKYATVESCAIFLCTFLVNAAVVTAASKLPRSVEAPGLKTAGTLLESTFGHRLAGTAWAVALLASGHAATVTGALSSQAVCQGVMG

SEQ ID NO: 24689 - protein, 401 aa, Thermotoga sp. RQ2
MNVVVQKYGGSSVATPERIKNVAQRIKKKVDEGYKVVVVVSAMGKTTDNLIKLAKEISPRPDSRELDMLLATGEQVSAALLSMALKDFGVKAKSLNAFQVKIKTTPHHTSARIVDIDDSVIRENLKDYDVLVVTGFQGVNEHGDLTTLGRGGSDTSAVALAAKLRVPCEIYSDVDGIYTCDPRVHPRAKKLAYITYDEALELTALGAKVLHSRSVEIAKKYGIPIYCASSFTEEEGTMVVERLPEWLEEPVVTGATISHGQIKVSISFLPKDVKYITAIFEEVGKRALNVDMISLVPSNGKVFLSFTILEDHKEDLDEALKEALRDVEGWKSTYEGGFAKLSIVGVGMRTSPGVAARFFEALERAGVTPELVTTSEIKISCLVPEEKAEKALKSVIEEFEL

SEQ ID NO: 24690 - protein, 504 aa, Candida albicans SC5314
MSHSSLSWLSNFNVETVPSKYLRRSSIIGTIGPKTNNVDVLVKLRKAGLNVVRMNFSHGSYEYHQSVIDNARKSEEVYKGRPLAIALDTKGPEIRTGTTIGDKDYPIPPNHEMIFTTDDAYKTKCDDKVMYIDYKNITKVIAPGKIIYVDDGVLSFEVISVDDEQTLKVRSLNAGKISSHKGVNLPGTDVDLPALSEKDIADIKFGVKNKVHMIFASFIRTANDVLEIRKVLGEEGKDIQIISKIENQQGVNNFDEILEVTDGVMVARGDLGIEIPAPQVFVVQKQLIAKCNLAAKPVICATQMLESMTYNPRPTRAEVSDVGNAILDGADCVMLSGETAKGNYPVEAVSMMHNTCLTAEKAIAYPQLFNELRSLAKKPTATTETCAVAAVSAAYEQDAKAIVVLSTSGLSARLVSKYKPDVPILMVTRNERAAKFSHLYRGVYPFIYDKPSIENWQEDVENRLRWAVSEAVELGIISKGDSIVTVQGWTRGSGHSNTVRIVQA

SEQ ID NO: 24691 - protein, 340 aa, Lactococcus lactis subsp. lactis Il1403 [sequence omitted]

SEQ ID NO: 24692 - protein, 304 aa, Fusobacterium nucleatum subsp. nucleatum ATCC 25586
MKELLKELVEKNRKFTADGNVANYIPELDKADKNALGIYVTTLDGQEFFAGDYNTKFTIQSISKIISLMLAILDNGEEYVFSKVGMEPSGDPFNSIRKLETSSRKKPYNPMINAGAIAVASMIKGKDDREKFSRLLNFAKLITEDDSLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGHLLEDLSAELSLNIF

SEQ ID NO: 24693 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRSTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 24694 - protein, 506 aa, Mycobacterium smegmatis str. MC2 155
MTTQIQHFINGRRTSAGSTRTADVMNPSTGEVQAQVLLASAADVDAAVTGAAEAQKEWAAYNPQRRARVLMKFIDLVNQNADELARLLSIEHGKTVADSLGDIQRGIEVIEFAVGIPHLLKGEFTEGAGTGIDVYSIRQPLGVVAGITPFNFPAMIPLWKAGPALACGNAFILKPSERDPSVPVRLAELFIEAGLPPGVFQVVQGDKEAVDAILTHPTVQAVGFVGSSDIAQYIYSTAAAHGKRSQCFGGAKNHMIIMPDADLDQAVDALIGAGYGSAGERCMAISVAVPVGEETANRLRARLTERVKQLRVGHSLDPKADYGPLVTEAALNRVKDYIGQGVEAGAELVVDGRERATDELTFDDQSLEGGYFIGPTLFDHVKTDMSIYTDEIFGPVLCIVRAHDYEEALSLPTKHEYGNGVAIFTRDGDAARDFVSRVQVGMVGVNVPIPVPVAYHTFGGWKRSGFGDLNQHGPASIQFYTKTKTVTERWPSGIKDGAEFVIPTMK

SEQ ID NO: 24695 - protein, 335 aa, Oryza sativa Japonica Group
MSHSSPSQQSFTTIESAESATAATSIETAESTTAARDVSPPAAVSAARDVSPPPAAARDVSPPSAAASAARDVSPPSAAAPAAARDVPPPPAVVPAAALDVPPPAVVPMAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVTYDGELTGKRVAYRCVF

SEQ ID NO: 24696 - protein, 392 aa, Sulfitobacter sp. EE-36
MQLSSRITGLLGGGSDGWGVFLRARQMIEQGTQVTELTIGEHDIRTAAPILQDMHRAALAGHTGYAAIPGTTGLRDAVAARLQERTGVPTTRDNVLITPGGQSALFAAHMATCNPGDTALYIDPYYATYPGTIRGVSALPHAIAARAEDAFQPRADVIAAAAKQTNAASLLVNSPNNPTGVVYSRKTLEGIAQVCRDHDMWLISDEVYDTQVWEGAHLSPRALDGMAEHTLVVGSMSKSHAMTGSRCGWIVGPVDAIEHLTNLATHTTYGVPGYIQDAALFALNQGTGFETEIAAPFQRRRLLAQDILARQNAVSLVPAQGAMYLMLDVRSTGMSGEDFAYALLEKHHIAVMPGESFGTAAAGHIRVAMTIEDTRFAQALATVCDFAEGLAA

SEQ ID NO: 24697 - protein, 758 aa, Oryza sativa
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPFTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFNIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAASAAPLQRASTFHRSSGSPALPLGISSIRRHCFNLPESAQPAWMRCEEKRVGEGNGR

SEQ ID NO: 24698 - protein, 85 aa, Glycine max
PVSFETDSWGFGCTILEMLTGNQPWYGCPVGEIYQSVVEKYEKPLIPSGLPSSVENILSGCFEYDLRNRPSMVDILAVFRRFVSF

SEQ ID NO: 24699 - protein, 211 aa, Staphylococcus aureus
PSADMLFEPSFVNDIDVNENDVVHFCSVDLVDSPMRDTHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPPLQEVEQAF

SEQ ID NO: 24700 - protein, 358 aa, Physcomitrella patens subsp. patens
MSSRYSVIHDNYKSLEEVQRALRDNGLESSNLIVGIDFTKSNEWTGRTSFGGRSLHVIGHEQNPYEKAISIVGTTLSPFDEDNLIPCFGFGDSTTHDKHVFSFFADHRPCDGMKEALVRYRAIAPHVRLAGPTSFAPIINKAVDIVEESGGQYHVLVIIADGQLEGPQERATVDAIVNASYYPLSIVLVGVGDGPFEMMKQFDDNLPNRVFDNFQFVNFTEIMQRWLPQQQKEAKFALAALMEIPLQYKATVELGLLGVKRGQSPGFRSLPPPSWGLQMDGQAYDPRTGAPQSQSFSRMDSQNYGQTPDAEDMECPVCLLENKDMAFNCGHQTCGQCAQSLTHCPTCRQPITTRIRLY

SEQ ID NO: 24701 - protein, 304 aa, Zea mays
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 24702 - protein, 138 aa, Triticum aestivum
  misc_feature (124)..(124): Xaa can be any naturally occurring amino acid
DDLIKNAGYISTPDTGILADDEYTDTIAKRYVSINVENVEDNLRALRELLYCTPGALQYLRGVILLEETLYQSSKGGEPFGDILMAGTDRPGINVDKGTIELAGTNGETTTHGFDDLGMRCTKXYDVAAQFDKRREAP

SEQ ID NO: 24703 - protein, 256 aa, Botryotinia ficariarum
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFDRKA

SEQ ID NO: 24704 - protein, 306 aa, Candida albicans SC5314
MIQNTVRGSILRSAKFTAPRSLLSISRSLTTENTSSKPTPPPKNDETTHFGFKTVNKDDKEKLVGGVFSSVASNYDVMNDVMSMGVHRLWKHHFIQRLDAGMRPGSTQPLEFLDVAGGTGDIAFGLLDHAEKKYGDTMSKMTIADINPDMLKEGEVRFAKTKWANTDRVNFLVQNGETMDQIPDNSKDVYTIAFGIRNFTDIQAGLNTAYRVLKPGGIFACLEFSQVENPLLDYAYQAYSFSLLPLMGQLIANDRDSYQYLVESIRKFPKQEEFKGMIEKAGFYVPEPGYENLTFGVASIHIGVKI

SEQ ID NO: 24705 - protein, 384 aa, Thermotoga sp. RQ2
MGKFLKKHYIMAPGPTPVPNDILTEGAKETIHHRTPQFVSIMEETLESAKYVFQTKHNVYAFASTGTGAMEAAVANLVSPGDKVIVVVAGKFGERWKELCQAYGADIVEIALEWGDAVTPEQIEEALNKNPDAKVVFTTYSETSTGTVIDLEGIARVTKEKDVVLVTDAVSALGAEPLKMDEWGVDVVVTGSQKGLMLPPGLALISLNDKAWGLVEKSRSPRYYFDLRAYRKSYPDNPYTPAVNMIYMLRKALQMIKEEGIENVWERHRILGDATRAAVKALGLELLSKRPGNVVTAVKVPESIDGKQIPKIMRDKYGVTIAGGQAKLKGKIFRIAHLGYMSPFDTITAISALEFTLKELGYEFELGVGVKAAEAVFAKEFIGE

SEQ ID NO: 24706 - protein, 174 aa, Silicibacter sp. TM1040
MAGQESHYILPRPEFDKPVKLLIVVSPYYKDIADNMVAGAVAEIEAVGGTYEVVEVPGALEIPTAIGISDRASNFDGYVALGCVIRGETTHYDTVCNDSSRAIQLLGLQGLCIGNGILTVENRKQAEVRADPEDQNKGGGAAAAALHLIALARKWGAQTKGVGFKPASDSYRLA

SEQ ID NO: 24707 - protein, 337 aa, Debaryomyces hansenii CBS767
MVVYFDPNTAPFLNPAVDRRVAFITGGNSGIGWFTILHLYLHGYTVYVAGRTESKVRKAIEDIKIEAEKRVKEYTKEEQDARSLGSLDYVYLDLLDLSTVVAAAESFSKKEPELHILINNAGIMGVPYEETKDGYEIQYQVNFASHFLLTFKLLPLIKKVALKGSIQPRIIQLTSGGHRASYRYFQPSENMNKFPNILYTWYRYGAAKLASIQFMNLLGKANPDILCVSVHPGIIFGTELFKYWKKMPIFGYLSSASMYAVAPLIGVQIEEGSLSTLKTALDPKINLLQDNGKYYVTGGSEGSTSRVAQNEKDAITTWNWNLDYMRKHNFNIDAPKL

SEQ ID NO: 24708 - protein, 374 aa, Silicibacter sp. TM1040
MSYETPGPVESELRDAISPIEEIIDAARAGKMYILVDHEDRENEGDLIIPAEFADADAINFMATYGRGLICLPMTAERIDRLGLPMMAVNNSSRHETAFTVSIEAREGVDTGISAADRALTVATAINEQNTMAAIATPGHVFPLRAKRGGVLVRAGHTEASVDISRIAGCHPSAVICEIMKDDGTMARLPDLVEFAKTHDMKIGTISDLIAYRAKNDNLVDETARSTVTSEYGGDWEMRIFTDQTHDVEHVVLIKGDITTPEPVLTRTHALHEASDLLGLGPKPAGELPRAMELIADEGRGIVCLFRQPRNALYASDEEGVRTIKQTGLGAQILNKLGVEELILLTDSPQTKYVGLDAYGLSIVGTRPILSRDS

SEQ ID NO: 24709 - protein, 301 aa, Physcomitrella patens subsp. patens
MILKPVVEAQLQYGYYETLGCRGVENLVRTSVGLSFLTDPTASAAMLRLAFHDCQVGPGGCDGSIMVEGNGREMDAGGNFGVKRLDIINSVKADLERMCPMTVSCADIIAMVGRDAVAFSGGPEIQIPLGRKDADFSSASEADAKLPPSTSSVDTILSVFAPFGMSLAESVASLGAHTLGGGHCKNIQDRLRFNSPTAPTSLLYRTQLRAACVVNVFDIAILNNDASQFTFDNQYFKDIQNGRGLFTVDNLLSTDPRTAPIVSLYATNEAALFAAFQSAYVTLTSRAMTGTQGSVRSTCHL

SEQ ID NO: 24710 - protein, 339 aa, Physcomitrella patens subsp. patens
MNYERGNKYLLGQKIGNGSSADVFVGTNVRCNQQVAMKLENINATHPQLLYESKLYRILHGGPGIANMQWYGLQGQFRVLVMDLLGPTLEDLKEFCSVKFSCCKENLARFSLKTVLMLANQLINVLQYIHSKGFLHRDVKPENLLMGLGRQANQVHIIDFGLAKKWSDPKTKEHIPCRSEKDLVGTARYASIGNHLGLEQSRKDDLESLGYVFVYLLKGSLPWENIKAETREEKHERIMKMKIAMCAEMICEGLPSQFGKFLQVTRALPFQAEPDYEGYKKMFQDCLKLLAGYARDYVFDWSVKHYARAGVPQKFVRHSTLPCANGYGYFLLCTFVLSL

SEQ ID NO: 24711 - protein, 435 aa, Candida albicans SC5314
MSTTTDTIDLTNDGSEKINEVDNIHEDTPVEESAIDEKTQQNYRVWKKNAPLLYDYLVTNSLLWPSLSVQFFPDITHINDLGENKNEEQIIAQRILLGTFTLGQAIDHISILQIPSFKNLNQNIKINKLDFNPEREEFELTTPSLNKTKTLQKINHLGDVNKVRYMPQKPNILASANNLGNLVIYERTRHKSFKNTILDDTDLSKVQVRLVNKHIPSTTDIFAIDWNRNSEGLLLSADMNGLVNLYDLKKYESETLNESQYWENNAIGVNDIEWFPTHDSLFCTADDNGWLKLYDTRNQSAAVQNANIGNSVNSVACNPGYATGLATGDSNGVIKMWDIRNFDNSLSELHGHSDSVTQLKWNPKCHNILGSSSSDHSVKLHDMSNDSTIFTHLGHMLGVNDFDWSYADPWMVASVADDNSLHVWKPTHSVTDKFK

SEQ ID NO: 24712 - protein, 315 aa, Arabidopsis thaliana
MADEIGFFQLNTGAKIPSVGLGTWQAAPGVVGDAVAAAVKIGYQHIDCASRYGNEIEIGKVLKKLFDDGVVKREKLFITSKIWLTDLDPPDVQDALNRTLQDLQLDYVDLYLMHWPVRLKKGTVDFKPENIMPIDIPSTWKAMEALVDSGKARAIGVSNFSTKKLSDLVEAARVPPAVNQVECHPSWQQHKLHEFCKSKGIHLSGYSPLGSPGTTWVKADVLKSPVIEMIAKEIGKSPAQTALRWGLQMGHSILPKSTNEGRIRENFDVLGWSIPKEMFDKFSKIEQARLVQGTSFVHETLSPYKTLEELWDGEI

SEQ ID NO: 24713 - protein, 287 aa, Nocardioides sp. JS614
MTRRIAYQGEPGSNSHQVCKQHYPDWEAVPCASFEDVFAAVEGGPGVAPAADLAMIPIDNSIAGRVADIHHFLPGSRLHIIAEHFLRIRFHLLGVPGSSLDTITTVHSHVHALGQCRKVIREHGLKPVIAGDTAGAAREVAELGDPTLAAISPPLAAEIYGLDVLEEDVEDEEHNTTRFVVLSPDLVQAPSGNGPVVTSFIFNVRNLPAALYKALGGFATNGVNMTKLESYMVGGEFAATQFLAEVDGHPDDIGVKRALEELAFFTTDIKVLGVYPADPFRAEVSSP

SEQ ID NO: 24714 - protein, 550 aa, Cryptococcus neoformans var. neoformans JEC21
MAHSSPTQADLDILSLLTSDQSALGPLPFQSARLKPAPQPVSGKKKLIPRRDSPLDALMISAVLAGSGPITRHHFGHGLAKPGSYSSCDESRPSSPAAPRVILKSIQAPRSERLRMEHEARATFEKGAVDRKSEDELDMTKVLPQQAQAASDWAGKPLSPPTSSVKDPSKRRMSIDPVPLTQTLQRASSSSFNFFHPLVNGAPQPIPGRIQVRCMARTRIPSPHGELFLHLYHNSYDAKEHLAILLDPIQLDAEVRAAAPSSRKEIRSKSLDAVWRDGETEMERIVRGAYTGRLKAGATVSNGGEHEPSGIVGVQDIKPLVRIHSECFTGETIGSMRCDCGEQLDEAIHQIAEPQRIPVPLVAPNSYSGDSFSTSAAFHPETTAYTHVPGRGVVIYLRQEGRGIGLLEKIRAYNLQDLGHDTVTANLMLGHGADERKYDIAAEILRDLGLADEGIRLLTNNPEKVRGLAREGVKVVERVGMTPRSWQCGDDHSHENKDGAKEEKEYEDWRMRRAGVGLIGAGMASGPELEKYLRTKVERMGHIIDIPKNI

SEQ ID NO: 24715 - protein, 353 aa, Glycine max
MDIPKQTLGSLAMVILLFAGIILVYHWNSSFSNEFVLTVKEPLCKQSNLTTPNIEANGDGLDTALAKASMGNKTVIIAVVNKAYVDQDVESDTTMLDIFLGSFWLGEGTRSLIDHLLLVAVDQTAYDRCQFLKLNCFKLETDGVDFKGEKIYMSQDFIKMMWRRTFFLLEVLKRGYNFVFTDTDVMWLRNPFTRLSKNETEDLQISTDAYLGDPWLEKNPINTGFYFVRSNNKTISLFETWYGQKDKAIGKKEQDVLFNLIKSGIIKDLGLRVRFLNTLYFSGFCQDSKDFREVITVHANCCRSITAKEVDLKAVLRDWKQFRRLEANSTINTRWTMHNQCRQSWGRPVKVKG

SEQ ID NO: 24716 - protein, 148 aa, Vitis vinifera
MSVGFGKCSKIRHIVRLRQMLRRWRHKAAEASRICIPSDVPAGHVAVCVGTDGKRFVVRATYLNHPVFKKLLVEAEEEYGFTNQGPLSLPCDESVFEEILCFISRSEASNSARFVNREDFQRYCHVGIRSSLDFWPESRPLLHSKSIW

SEQ ID NO: 24717 - protein, 203 aa, Glycine max
MNQSWKPCYFLMMGMRERRMKQNIKAHENRKQIFSNNASRENPLQHQPKPTTEPPPWSNSSNASESLHQELALPSNGAPVGNQLRRRLAVDSTPSQQMEMSMVQQVVPRHDNYAQSRATALHNVESTITELSGIFSHLATMVAHQGELAIRIDDNMDESSANVEGAHSSLLRHLNRISSNRWLLIKIFVILILFLMIFIFFVA

SEQ ID NO: 24718 - protein, 150 aa, Mycoplasma genitalium G37
MSKYQKKSEAELKRTLTKLQFDVTQNAHTEPPYINEYNRNFEKGIYVDITSGEPLFISTDKFKSGCGWPAFSKPIDKNLIANYRDESHGMIRTEVRAKNSDSHLGHVFNDGPSELGGLRYCINSAALKFIPFEEMEKLGYKDYIHLFKNK

SEQ ID NO: 24719 - protein, 601 aa, Vibrio angustum S14
MSNDFLVLSVVFLAAAIIAVPLAQKLGLGSVLGYLIAGIAIGPWGLGLISDVDAILHFSEFGVVLLLFLIGLELNPKTLWQMRKPILGLGGGQVVITSGVIAVVVMSLNGFLPSLTWRDAAVIGMGLALSSTAIALRVIEEQQLSGSETGQSGFAVLLFQDIAVIPMLALLPALAGGKGGSWNDAFWMLGGIAVLLVGGHFLLRPLFRYVVMSGVRELFNVAALLLVLGIALIMQALGLSMALGAFLAGVLLAESEYRHELEIAIEPFKGLLLGLFFISVGMAVNIGLLWQYPLQILAAVFALVAVKGVVLYLLARIFGVREKSRSQMAAILSQGGEFAFVLFTAARAEGLLDAQLLAFLLVVVSISMMTTPLVLTLQNRWFVRSFKASEQPEPESDIVDRAPRVIITGFGRFGQVIGRLLFANKIKVTVLERDPSQIQFLRKFGYKVFYGDATQLDLLRAAGADNAEAIIICTDAPTEVMEVVAICQQHFPHLKILARARSRVEAHQLLGQGVECFSRETFAGALDLGRQALISLGMHPYKAKRAEAHFRKIDTQALRDLLPQHSEEVNLASRQKEARKELEEIFDREMRGEEERHHGWD

SEQ ID NO: 24720 - protein, 503 aa, Gossypium hirsutum
MAVQVPSRQLFIDGEWREPILKERLPTINPATEEIIGNIPAATAEDVELAVAAARRALSRNKGKDWATAPGAVRAKYLRAIAAKVTERKTELAKLEAIDCGKPLDEAVWDIEDVAGCFEYYADLAEGLDARQKAPVSLPMETFKSYVLKEPIGVVGLITPWNYPLLMATWKVAPSLAAGCAAILKPSELASITCLELAKVVKGSRLPPGVLNILAGLGPEAGAPLASHPDVDKIAFTGSSATGSKIMAAAAQMVKPVSLELGGKSPIIVFEDVDLDKAAEWTAFGCFWTNGQICSATSRLIVHENIAREFLDRLVKWTKNIKISDPFEEGCRLGPVVSGGQYEKVLKFISTAKSEGATILSGGVRPEHLKKGFFVEPTIITDVTTSMQIWREEVFGPVLCVKTFRTEEEALELANDTHYGLGAAVISNDLERCDRVSKNLQAGIVWVNCSQPCFCQAPWGGNKRSGFGRELGEWGLDNYLSVKQVTQYVSDEPWGWYRSPSKL

SEQ ID NO: 24721 - protein, 419 aa, Vitis vinifera
MGSVSLKIGDGTARFRRASLCSSAVNVLMLFSVITTNLFALYAFTSSPKDQAHPTQHTHKNISFISEQVSLIIREIESSQKKLAQMEKELLGYESIDLSRPNTASELKLFLQRHQLPLGKDSKTGITEMVASVGHSCDKSVDLLSQYMTYKVSGACPDDWSLAQRLILRGCEPLPRRRCFAKSVPKVGLYSFPISLWKPVSDKIVSWSGLGCKNFECLNNKKLGKDCVGCFDLANGYENQRFVKARGKNDFLIDDVLALGSGGTRTGFDIGGGSGTFAARMAERNVTVITATLNVDAPISEFVSARGLFPVYLSLDHRFPFYDNVFDIVHAASGLDVGGRPEKLEFLMFDIDRILRAGGLFWLDNFYCANEEKKKALTRLIERFGYRKLKWVVGEKPDAAGPGKSEVYLSGVLQKPVRV

SEQ ID NO: 24722 - protein, 211 aa, Staphylococcus aureus
PSADMLFEPSFVNDIDVNENDVVHFCSVDLIDSPMREAHYQLITKTLNSNGTVVFDPNVRLPLWDNAEDLRQTIHTFLPLAHIVKVSDEELEFITGIHDENEAIQSLFTGNVTVVIYTKGADGAAVYLKNGNNHYHSGYKVKPVDTTGAGDAFIGAVISRILATDVLNLTQLFENEGEEILAFSNRVAAIVTTKYGAIISLPTLQEVEQAF

SEQ ID NO: 24723 - protein, 445 aa, Glycine max
  misc_feature (119)..(119): Xaa can be any naturally occurring amino acid
  misc_feature (125)..(126): Xaa can be any naturally occurring amino acid
  misc_feature (129)..(129): Xaa can be any naturally occurring amino acid
  misc_feature (279)..(279): Xaa can be any naturally occurring amino acid
MDVIDLEDESIDAEVLNSMAVSNEHFHTALGTSNPFALRETVVEVPKVSGEDIGGLENVKRELQETVQYPVEHLEKFEKFGMSPLKGVLFYGPPGCGKTLLAKAIANECQANFISEGPXIAHYVXXREXETNLRKAFDEAQNNAPPVIFIDELDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHWYVGADLAALCTEAALQCIREKMDVIDXLEDETIDAEVLNSMAVTNEHFQTALGTSNPSALREIVVEVPNVSWEDIGGLENVKRELQETVQYPVEHLEKFEKFGMSPLKGVLFYGPPGCGKTLLAKAIANECQANFISVRGPELLTMWFGESEANVREIFDKAKQSAPRVLFFDELDSIATQVYFCTSHPCRPG

SEQ ID NO: 24724 - protein, 482 aa, Salmonella enterica subsp. enterica
MSDVPLIAVVMAGGTGSRLWPLSRELYPKQFLQLSGKNSLLQTTLLRLSALACNEPLVITNEQHRFIVAEQLRQIDQLHNNIILEPYGRNTAPAIALAALSALRRKEQEDPLLLVLAADHIIAKEEVFCNAVKKAVPIAENGNIVTFGIIPEYAETGYGYIERGVPFSVNANSTETDFYHVKKFVEKPDRLKAEKYISTGDYFWNSGIFMFKATVYLNELKKFRPDIYSVCEQVLSSSYRDLDFIRLPETLFKDCPAESIDFAVMEKTERCIVCPIDIGWSDVGSWQSLWDISEKTDEGDVCKGDILTYNTKNNYIYSESALVAAVGVEDIVIVQTKDAILVSKKSDVQDVKKIVEMLKAQERTEYIAHREVFRPWGKFDSIDQGERYKVKKIIVKPGEGLSLRMHHHRSEHWIVLSGTAKVTLDDKTMLVTANESIYIPLGATYSLENPGVIPLNLIEVSSGDYLGEDDIVRQKERYKKDN

SEQ ID NO: 24725 - protein, 523 aa, Olea europaea
MAGGGFGPGPGTGKEYPGNLTLYVTVACIVAAMGGLIFGYDIGISGGVTSMDSFLEKFFPSVYRKQEADDSTNQYCKFDSQTLTMFTSSLYLAALVSSLVASTVTRKLGRKLSMLFGGVLFCAGALINGFAHHVWMLIVGRILLGFGIGFANQAVPLYLSEMAPYKYRGALNIGFQLSITIGILVANVLNYFFAKIHGGWGWGGLSLGGAMVPALIITVGSLVLPETPNSMIERGNHDVARAKLKRIRGIANVDEEFNDLVAASEESRKVEHPWRNLLQRKYRPHLTMAILIPIFQQLTGINVIMFYAPVLFKTIGFGSDASLMSAVITGCVNVLGTMVSIYGVDKWGRRFLFLEGGIQMLICQIVVAICIALKFGVDGNPGELPKWYAIVVVLFICVYVAGFAWSWGPLGWLVPSEIFPLEIRSAAQSINVSVNMVFTFAIAQVFLTMLCHLKFGLFLFFGFWVIIMTIFIFFFLPETKNIPIEEMVIVWKQHWFWSKFMTDVNYPNGSIELENGNGTFKKV

SEQ ID NO: 24726 - protein, 640 aa, Vibrio angustum S14
MIIFSDIQLLRGGKVLLENATSTIHPGDKVGLVGKNGCGKSTLFALLKNELSLDAGNCQFPSNWEMAWVAQETPALERAAIEYVIDGDREYRELERQLLAAEQADDGTKVAELHGKMDTIGGYSINARAAELLDGLGFSQHQMQWNLTQFSGGWRMRLNLAQALLCRSDLLLLDEPTNHLDLDAVMWLEKWLQSYRGTLVLISHDRDFLDPVVNRIIHIENQTMHSYTGNYSSFEVQRAEKLVLQQAMYQKQQKQMTHMQSYIERFRYKASKARQAQSRIKALERMEKVLPAQFDNPFSFEFREPSALPNPILMMDQVAAGYDDLLILEKIRLNLVPGSRIGLLGRNGAGKSTLIKMLSGDLPAKAGDMAYSQGVKIGYFAQHQLETLYLDDTPVQHMARIAPQATEQQLRDYLGSFGFIGDKALEKVGPFSGGEKARLVLALIVWQRPNLLLLDEPTNHLDLDMRQALTLALQSYEGAMVIVSHDRYLLRATTDDLYLVHDRQVVPFDGDLNDYHKWLTEQQRNERRDQQATKPETNKDNSAASRKEQKRLEAEFRKQTAPIRKEITKLEKQMDKLNAIITDAETALSDSSIYEAENKVRMNEQLKLQGDAKSDLEDVEVAWMELQEQLEEMESQFNAE

SEQ ID NO: 24727 - protein, 473 aa, Rhodopseudomonas palustris CGA009
MSETSFDVIIIGSGPGGYVAAIRAAQLGFKTAIVEKSYLGGICLNWGCIPTKALLRSAEIYHYMQHAKDYGLSADNISFDPKAIVQRSRGVSKRLNDGVGFLMKKNKISIIWGQATIDAPGKLTVAASKTDAPKGALPPGSYQAKHIIVATGARPRVLPGLEPDKKLVWTYFEAMVPEVMPKSLLVVGSGAIGIEFASFFHTMGAKVTVVEVLPQILPVEDAEIAALARKRFEKQGIKILTGAKVTKLDKKADSVVATIDPGNGKPETAEFDRVISAVGVVGNVENLGLDKLGVKLDRGTIVTDGLGRTNVPGLYAIGDVAGPPMLAHKAEHEGVICVEAIKGLHPHPLDKSLIPGCTYCQPQVASVGLTEAKAKEQGREIRVGRFPFTANGKAIALGEDQGLVKVIFDKKTGQLLGAHMIGAEVTELIQGYVVAMNLETTEEELMHTVFPHPTLSEMMKEAVLDAYGKVLNA

SEQ ID NO: 24728 - protein, 1863 aa, Cryptococcus neoformans var. neoformans
MLPSSQQMTAAGPLPATPDQLSLRHRHSSSKQRTPRNLDDPSRSKPSPSESARRGKPIFFSSMHFPQALPQSIPSMASDERRAEIQRSQRRSKVEALTKIDRAGTPIQLAAGPAATSFVPHTVQKPTPPPAPHYLRNPLHRPKVVNPPFSIDSVRTKAPRHPRPRTEPRLFGLEDCPTFYPTPKEFTDPMAYIQSIAQQGKRYGICKIVPPEGWHMPFRLETEIFRFKARLQRLNQLEAASRAKLNFLEQLSMYHMQQGNYKIHIPLIDRQPLDLWKLRREVNRSGGNFELDRTKGWSKITEVLGHKPSWTPHIRAAYMNIVLPFDNWAVRAKSASVSPLARFNPGNSGSPSKAPPAFVNDNCSATPIKQDYGVSRLGTTSYRPTLKVRLNGMPFVPSFGNGRSPSKCASVKGGRAVADAIEINHSVSLSTVPSVAAGTPTTRRINVPGFSDQEGSDSELSDEDSPLSPSSIKKAPFEPEYQKGEVCEICKGEYDADKILLCDSCDRGFHIYCLDPPLASVPNNEWFCTSCLLSQGEDFGFEEGDEHSVASFQARDAAFSYAWWNRHMPHNSPRASVNGAQPTDNGDDERVKPRQFGKATVSEDDVEREFWRLTESPLDTVDVEYGADIHSTSHGSAGPTPETHPFDPYSKDPWNLNNMPILPDSLLRYIKSDISGMTVPWIYIGMMFSAFCWHNEDHYTYSINYMYWGETKTWYGVPGSDAEKFEAAIKSEAPDLFEQQPGLLFQLITMMNPGRLSDAGVKVVACDQRPNEFVITFPKAYHCGFNHGINMNEAVNFALPDWLPDGKDSVRRYREHNKAPVFSHNELLITITLFSESIRTALWLKDAIIEMVEEESARRDALRAKYPKLVQDVIEEDCREDQYQCAICKGFCYLAQITCSCTSQVSCLSHADQLCTCGKLRKVLRMRYSEAQLEDIRDVVIRRAALPEQWRVRFFSLMESPKPQLKSMRTLVLEGERIAHPIPELGTLKRFVDVASSLMEQIATITARKNTGRRKTKGKRDVNRKGKRAGAERDDDGNDGTDRNPGLLTDLLKQVDRLAFDAPELTQLRQLMLAVEGFRIEASSLLTTPEDQLDRRKCKNALILGQSFGLDFPELAPLEQLVQRQEWFRQLEEEVDDVNLEYDDVVALLQESLDCQIPQDHVMVKELRLREGKGRHWIDLAEKLLSSSQIAVDDISTLIEARQHVPVSIDILRKLENLRKSAISWQSSARNVFATNGSSVAASRLCKNVAAASKPLSNVVIPEIRQLQAELDHHALWREEASKILGVPVARLASTIDYIRGEFENNLAPDDDARNDRRVCFCRSSSIDNTVVCKICQHSYHLRCVDVSTRRVPQEFKCAICQRLPNDDGPSLDAFIGLISPQRWNFLINPPEFEQAQYIASAAIRYAPQAFRLADPLSLSHPCRDLELLRHTIRKIYTLPLVFDTHNSQTNERCVFVNWLFRRMQDAVKMETKEASLLAVGVQSEMDRRLSVALAAGQFALVNGETRTPCGRAKPRRRARIILAESHPREFYCLCGLPSAGKPPTTQVECPKCGQGYHGVCVKVTEELARKSVWRCPCCTVQDGRHYQKGVEVRVQLSSHRGTDQFLDYRTIINNFAEQLVIVTKPTSTSAITLECIDFVPAHIPVDVKRMEEGADSLYRTKKRKSTGVDGFFRNEQGAKSPVAHVLNTMAAKGSMGPSSTISNDISTHATSSGTCGSSIALGVRSDIETKSSAVPRTIYTSAAESNADTSGPALTPTIQNRSTFNMRSNVGPAPCFSSTPIAVGVSTTSTVRQNGGTSMAIMCGEGRETAVTGKNVHEDSIDSRRDSEEGDSYSNMRESIAVEEAVPFGHHGVDQDVIMGFF

SEQ ID NO: 24729 - protein, 235 aa, Mycobacterium leprae
MLDCPVMYDDQNGTAIVVLVAPMVAIILLGRGMSSLNVVGVRRRYRRGYFHESFSYHRCFRHYCARFAWHSAYRVRRHELREVSLIWRDVPTPAVSPATWPRCSLALLCSLGCRRSWSLEELLVMMAPDGIVFVLSDPDPEIHPGVAAKYVAVVAIGRSDFCSQINSVLVFPGVFCGALDAETSRITEKMMVAAVEAIFCVASDDFTLDRIVPSLLNFRVGEAGALATEASDVAG

SEQ ID NO: 24730 - protein, 584 aa, Bordetella pertussis Tohama I
MPLRTLLAALCAAAICQAPAWAREAPGVAREDVNPEIASARSERAQAHAQRYMIATANPLASEAGYRILRAGGSATDAIIAAQLVLNLVEPQSSGIGGGAFMVHYDRGAGELRVYDSRETAPAAARPDRFLREGKPLSYAESVNNGRAVGTPGLLRGLELAHRQHGKLPWQALFEPAIAMAEQGFAVSPRLHESIAGDKALAAQPAAARYFYGPDGQAWPVGHRLRNPEFAATLRSIAREGADAFYRGPIARDIVAAVRAHPTPGDLAEADLAGYRAVVREPVCGLYRGYRLCGAPPPSSGPLAVLQMLGELEQYPLARMRPGSVEAVHYFSEAGRLAFADRDFYVADPAFVDVPVRALLDPAYLRQRGALIRPDRSMKTALPGDPQGLLAERARDDAIEVPSTSHLVAVDAAGNVVSMTSTIEAAFGSKIFVRGFLLNNEMTDFSSSYRDPEGRLVANRVEPGKRPRSSMAPMIVFRAGKPVLALGSPGGSAIINYVAKTLVGVLDWKLDVQQAIALPNLGSRNKETELERGTALEALAPALRRMGHEVRITDFPSGIQGIVIGPHGLAGGADPRREGLALGD

SEQ ID NO: 24731 - protein, 643 aa, Cryptococcus neoformans var. neoformans
MAFNGSSLTPSRPAPAPPGRGAKQMLNSTSPHTASALESNFSSTSYSSSFASIVSSTVKPTANIVFNKDAVVRSGTANVKEEGLRAFMWSKRWLVLRNSEFCIYKNENSPSPIYAFPLENVQDVQRVDLKPFCIEIETGDRLIYIAMRTDDDVYGWMDDIYSRSPRLGVSQPTNFVHQVHVGFDPKSGGFTGLPTQWSKLLTSSAITKEEAAKNPEAVLDVLQFYTQQHVSDGRETIGPSSVPMLSQQSLSTSAAATRFEGVGLGGQQKLEHARGLMNDKKVLQSTSQMPFYHSSVSDERILKKGKVVVRYEPRSGAERRLSRDPHHLSNPPSSLPISLPVEKRISTMNESQIMGKLRSVVSVQDPTLLYSKIKKVGQGASGLVFVAKTVSSGRKVAIKQMDLSQQPRKELIVNEIIVMKESQHANIVNFLDAFLLKGSELWVVMEFMEGGALTDVIENNKLTEDQIAAICLETCRGLQHLHSRSIIHRDIKSDNLLMNSQGEVKITDFGFCAKLTDQKSKRATMVGTPYWMAPEVVKQKEYGAKVDIWSLGIMTIEMIENEPPYLDEEPLKALYLIATNGTPTLKSPDTLSQNLKHFLSVCLCVDVAFRATSTELLKHEFLQIACPVKQLAPLLKFKQSSVS

SEQ ID NO: 24732 - protein, 228 aa, uncultured cyanobacterium
HEVAGAGQHELGMKFAQLIEAADNVMIYKYVVRNVAKKYGKRPPFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEALSADRAFLTEGGVFTD

SEQ ID NO: 24733 - protein, 361 aa, Physcomitrella patens subsp. patens
MKALILVGGFGTRLRPLTLSVPKPLVDFANKPMILHQIEALKAVGVDEVVLAINYQPEVMMNFLRDFEKSLGIKITCSQETEPMGTAGPLALARNKLDDGSGEAFFVLNSDVISEYPLRQMVEFHKKHGGEATIMVTKVDEPSKYGVVVMDESNGCVQRFVEKPQQFVGNKINAGIYLLSPKTLNRIELRPTSIEKEVFPKIAAEKNLFAMVLPGFWMDIGQPRDYNTGLRLYLESLRKKDPERLASGSTFLGNVIVDESAKIGDGCLIGPDVSIGQGCTIEAGVRLSRCTIMRGVRVKKHACISGSIIGWHCTIGQWARIENMTVLGEDVRVSDEIFSNGGVVLPHKEIKTSILKPEIVM

SEQ ID NO: 24734 - protein, 160 aa, Glycine max
LLSGVLLKEEEHKEVAEVAQELQKYCVSEPVKCPLIFGEWDVAYCSRPTSPGGGYRSAIGRLFFNTKQMVQVVEAPDIVRNKVSLSVLSFLDVEVSLQGKLKALDSEWIQVIFEAPELKVGSWQVQYGGQSEVKLRITYVDEKIRLGLGSRGSLFVFQRI

SEQ ID NO: 24735 - protein, 340 aa, Xanthomonas campestris pv. campestris str. ATCC 33913
MKALVKREASKGIWLEQVPVPTPGPNEVLIKLEKTAICGTDLHIYLWDEWSQRTITPGLTIGHEFVGRVAELGSAVTGYQVGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADLGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLQKVLTHQLSIDEFQKGFDLMEEGKAGKVVLSWN

SEQ ID NO: 24736 - protein, 232 aa, Neisseria mucosa
DQGAGVTYLEPSASQIGHKESIKDTARVLGRMFDGIEYRGFGQDVVEELAKYAGVPVFNGLTNEFHPTQMLADALTMREHSDKPLNQVAFAYVGDARYNMANSLLVLAAKLGMDVRIGAPKSLWPSENIIETVQAVAKETGGRILLTENAQEAVKGVDFIHTDVWVSMGEPKEAWQERIDLLKDYRVTPELMAAAENPQVKFMHCLPAFHNRETKVGEWIYETFGLNGVEVT

SEQ ID NO: 24737 - protein, 317 aa, Physcomitrella patens subsp. patens
IHRCQTAPAMSSMNRERKAAALKRPEFTKGSAIVKQAGIGLIIYLALGVTIYAWKNDEFSGIESFSVVDALYFCVVTMCTIGYGDIVPVTPFAKLFSCVFVLIGFGFIDTLLSGMVTYVLDKQEHLLLSAVEGSHYRTAKKYFLNEKHGNRMRIRLKVAIALGVPLLCIVIGTVMMMQFEELGLLDAFYCTIMSVTTVGYGDHTFKTYYGRLFAGVWLLFSTLAVARCFLYLAEARIDKRHRAIAKWVLQRELTVGDLVQADLDHDGSISKAEYVVYKLKEMGHIQSHEIADICHQFDQLDVNNSGKITLARLQEGN

SEQ ID NO: 24738 - protein, 232 aa, Neisseria perflava
DQGAGVTYLEPSASQIGHKESIKDTARVLGRMFDGIEYRGFGQDVVEELAKYAGVPVFNGLTNEFHPTQMLADALTMREHSNKPLNQIAFAYVGDARYNMANSLLVLAAKLGMDVRIGAPKSLWPSENIIETVQAVAKETGGRILLTENVKEAVKGVDFIHTDVWVSMGEPKEAWQERIDLLKDYRVTPELMAAAENPQVKFMHCLPAFHNRETKVGEWIYETFGLNGVEVT

SEQ ID NO: 24739 - protein, 325 aa, Nocardioides sp. JS614
MRAVIATGAGGPDVLSVAELPDPEPGPGEVLLAVAAAGLNRADLLQRQGFYPPPPGASDVIGMECSGTVAALGEGVEGWAVGDPACALLAGGGYAELVAVPSGQLMPVPDGVDLVTAAALPEVACTVWSNVFMLGGLKPGEAFLVHGGAGGIGTFAIQLAHQLGAQVLTTAGTAEKRAACAALGADVTIDYRDQDFVEVARAATEGRGVDLVLDNMGAKYLDRNLDALATEGRLVIIGMQGGTRAELDINKLLRKRGAIIATTLRARPTEEKSAICASVVEHVWPLVAEGLVRPVVHGTMPLAEAGAAHALMESGEHSGKILLTV

SEQ ID NO: 24740 - protein, 128 aa, Vitis vinifera
MLKFLSKVRIEFNALDPRTASCLEFLAQCNARKAKESNPACQLLVKRRTDDHPPQITVTFVNGVEEVFDATTTPAQAIRNMILEKGQHLETEQMFREAGEAWPVIIPEEELHQFAPGTKPRKAEEKKQ

SEQ ID NO: 24741 - protein, 292 aa, Mycoplasma genitalium G37
MKTKIRKAVIPAAGLGVRLLPATKAIPKEMLPLVNKPTIQYIVEEAVKSGIEQILVIVSSKKTAILDHFDYDLILENALIQKNKLQEHKEIEDIANLAHIFFVRQKNQDGLGDAILFAESFVGNEDFAVLLGDDVVFSKEPALKQCLEAYYETNCQTIGVQEVDPCHVDKYGIITPEGDYKNKDLIKVLAMTEKPKPKDAKSNLAILGRYVLKPSIFKALRSVPYGVGGELQLTDGLNFCLKNENFYARKFTGTRFDVGTKSGFIKANLFTALNNKDISKKEVLELLNLVKA

SEQ ID NO: 24742 - protein, 185 aa, Acidovorax sp. JS42
MGPADPAGALQPSKEILMIQVGDTLPAITLMEYSEVEGNGCSLGPNPVDVQKAAAGKTIALFAVPGAFTPTCSAKHVPGYVEQAGALKAAGVDEIWCLSVNDAFVMGAWARDQKTDGKVRMLADGDAAFAKATGLTLDLNGKGLGLRSNRYSMLVKDGKVVALNVEAPGKFEVSDAATLLGQAKG

SEQ ID NO: 24743 - protein, 397 aa, Mycobacterium smegmatis str. MC2 155
MRILRLRLQDGFLLPSPVLAKTLRRAPVEVSGAQADLRIGHAKGGKVTAFVSEDPTDDDEEALDARERMARLIFAPRILAQVVKCVAQFGVADHLATGPCHPADLAAVIGLDASAAGRLLRYCTTVGLVRRDKDGRYHGTELLATLRSDDPYRLRSFAMAQNGPGQWAVLSRLDEALRTGAPQAAEALGCELYEYYGRPDVADEAAAYRQGLLGRSVDVQDAVVDFVDTRGLASVLDVGGSAGSMVMALMLANPDLRGAVLDLPDAAPAAEAQARRLGVSERFEFIAGNFFEEVPGSDLFLLKNVLGNWDDDRCVAILENSRRKALPESRWVIVENAVDESSPKRWAVDVDIVTLVAVGGRVRSVDDYRRLLTRAGLRFVRSASATAGYQLIEAVLR

SEQ ID NO: 24744 - protein, 88 aa, Brassica napus
  misc_feature (27)..(27): Xaa can be any naturally occurring amino acid
MKGIARIVNSLSRLGGRGEIISRGSSXLSSSLLLVSRRSIFISAATHFPTNSRDLTSSSRSTFSLPQKWAFLGGVGQRRTMFIQTQST

SEQ ID NO: 24745 - protein, 289 aa, Vibrio angustum S14
MSAKHPIIAVTGSSGAGTTTTSEAFRKMFNMMNINAAWLEGDSFHRYTRPEMDTEIRKAKEQGRHISYFGSEANDFAQLEQFFKQYGEDGTGRFRRYLHTFDEAVPYNQMPGTFTPWQQLAENTDLLFYEGLHGGVVDGEIHVAQHVDLLIGMVPIVNLEWIQKIVRDTRDRGHSREAVMESIVRSMDDYLNYLTPQFSRTHINFQRVPTVDTSNPVSAKGIPSLDESFVVIRFRGLNNVDFPYLLSMIQGSFMSRHNTLVVPGGKMSFAMELIMRPLIEKLINTGKIS

SEQ ID NO: 24746 - protein, 496 aa, Vitis vinifera
MTLLLFVILAFPLFLLFLYRKHRKNGGLLPPGPPGLPFIGNLHQMDNSAPHRYLWQLSKQYGPLMSLRLGFVPTIVVSSAKIAKEVMKTQDLEFASRPSLIGQQRLSYNGLDLAFSPYNDYWREMRKICVLHLFTLKRVKSYTSIREYEVSQMIEKISKLASASKLINLSEALMFLTSTIICRVAFGKRYEGEGCERSRFHGLLNDAQAMLGSFFFSDHFPLMGWLDKLTGLTARLEKTFREMDLFYQEIIEEHLKPDRKKQELEDITDVLIGLRKDNDFAIDITWDHIKGVLMNIFLGGTDTGAATVTWAMTALMKNPRVMKKAQEEVRNTFGKKGFIGEDDVEKLPYLKAVVKETMRLLPSVPLLVPRETLQKCSLDGYEIPPKTLVFVNAWAIGRDPEAWENPEEFMPERFLGSSVDFRGQHYKLIPFGAGRRVCPGLHIGVVTVELTLANLLHSFDWEMPAGMNEEDIDLDTIPGIAMHKKNALCLVAKKYN

SEQ ID NO: 24747 - protein, 498 aa, Vitis vinifera
MTVLLFVILAFPLLLLFLHRKHRKNGGLLHLPPGPPGLPVIGNLHQMDNSAPHRYLWQLSKQYGPLMSLRLGFIPTIVVSSARIAKEVMKTHDLKFASRPSLIGPRRLSYNCLDLAFSPYNDYWREMRKICVLHLFTLKRVQSYTPIREYEVSQMIEKISKLASASKLINLSETVMFLTITIICRVSFGKRYEDEGCETSRFHGLLNDAQAMLGSFFFSDHFPLMGWLDKLTGLTARLEKTLRDMDLFYQEIIEDHLKPDRKKQEQEDITDVLIELQKDNSFAIDITWDHIKGVLMNIFVGGTDAGTATVIWAMTALMKNPRVMKKAQEEVRNTFGKKGFIGEDDVEKLPYLKAVVKETMRLLPAAPLLLPRETLQKCSIDGYEIPPKTLVFVNAWAIGRDPEAWENPEEFIPERFLGSSVDFRGQNYKLIPFGAGRRVCPAIHIGAVTVELTLANLLYSFDWEMPAGMNKEDIDFDVIPGLTMHKKNALCLMAKKYN

SEQ ID NO: 24748 - protein, 482 aa, Salmonella enterica subsp. indica
MSDVPLIAVVMAGGTGSRLWPLSRELYPKQFLQLSGKNSLLQTTLLRLSALACNEPLVITNEQHRFIVAEQLRQIDQLHNNIILEPYGRNTAPAIALAALSALKRKEQEDPLLLVLAADHIIAKEKVFCNAVKKAVPIAENGNIVTFGIIPEYAETGYGYIERGAPFSVNANSTETDFYHVKNFVEKPDRLKAEKYISTGDYFWNSGIFMFKATVYLNELKKFRPDIYSICEQVLSSSYRDLDFIRLPETLFKDCPAESIDFAVMEKTERCIVCPVDIGWSDVGSWQSLWDISEKTDEGDVCKGDILTYNTKNNYIYSESALVAAVGVEDIVIVQTKDAILVSKKSDVQDVKKIVEMLKAQERTEYIAHREVFRPWGKFDSIDQGKRYKVKKIIVKPGEGLSLRMHHHRSEHWIVLSGTAKVTLDDKTMLVTANESIYIPLGATYSLENPGVIPLNLIEVSSGDYLGEDDIVRQKERYRKDD

SEQ ID NO: 24749 - protein, 262 aa, Vibrio angustum S14
MEQLFTALWQDYTQRLCPSALNIRQLLTEDAPLRNDHIALRTFALPKCGLARLAAPFIAVGYKPKGRYHFKAKKLYAEHFEHPDPAAPKVFISELQLGLCSTELQTEVRQLVDQVDDDYFANPAFLSQGKPWQLSRDSYQLLNAGSEYAGWVAAHGFGANHFTVDINQLEQFNEISEVNHFLESSGFDINQAGGAVKGDPTVMLEQSATMADKVMVTFSDGEMLVSGGFYEFAKRYLQPDGEIYSGFVEASADKIFESTYNS

SEQ ID NO: 24750 - protein, 713 aa, Cryptococcus neoformans var. neoformans JEC21
MALPETIRVSPDSPRAHWKSRPALSRAWESGLKAGPIRCRRAFRDPSPLSVVIVDHCGYSRLRCPTSYICLQNISFQLSTTHPTTSATTTMSDNEQVAFFTYILERLKQCGVKQIFGVPGDFNLTALDYIEKDPELQWVGNANELNAAYASDGYARVKGTLAVVITTFGVGELSALCGIAGCLSERVPVLHIVGAPSTSLQAKQSLLHHTLNLPESFSTFSSMSAPLSCSQALINNIEPKTPTSWTEAFDKTLKAVLEQCRPGYVEVPTDAVHAKVSAEGLKQPLPPPHSAPPPESMGTSLSNTSASAASRGAAQVSLSTAPTNVPSAPSSDDVTAHVVEDITKRFGEAKKPIILVDACAGRFGMAIEVRKLVDACGIRFFETPMGKSLMDERHPLYGGCYAGANSLPTVQKEVESADFVLYVGALKSDFNSGSFSVNIDPKVIVELHSFTTTIGYASYPTTDIRTILPLLRPAFEKLGRGKQSEGQSVEQKVEDKSVDSPVVPDPKGDEIKHEWLWPRVGKWFQDTDIIITETGTSSFGLTNVVLPSNSTYIAQILWGAIGWSVGACLGAAMAAKENGNNRRTVLFVGDGSLQLTLQEIGTMLRRGVHPYIFVLNNDGYEIERQIHGWTAEYNDIQLYDHQLLLPFLAGKKTKTPYQSYAVHTPQEFSKLLDDEEFNKPDRLRLIEVFMPRGDAPAGLIRQAKLTAEANDRI

SEQ ID NO: 24751 - protein, 495 aa, Vitis vinifera
MMILLLILLALPLFLLFLLRNRRRTPLPPGPPGLPLIGNLLQLDKSAPHIYLWRLSKQYGPLMILRLGFVPTLVVSSARMAKEVMKTHDLEFSGRPSLLGLRKLSYNGLDVAFSPYNDYWREMRKICVLHLFNSKRAQSFRPIREDEVLEMIKKISQFASASKLTNLSEILISLTSTIICRVAFSKRYDDEGYERSRFQKLVGEGQAVVGGFYFSDYFPLMGWVDKLTGMIALADKNFKEFDLFYQEIIDEHLDPNRPEPEKEDITDVLLKLQKNRLFTIDLTFDHIKAVLMNIFLAGTDTSAATLVWAMTMLMKNPRTMTKAQEELRNLIGKKGFVDEDDLQKLPYLKAIVKETMRLHPASPLLVPRETLEKCVIDGYEIPPKTLVYVNAWAIGRDPESWENPEEFMPERFLGTSIDFKGQDYQLIPFGGGRRICPGLNLGAAMVELTLANLLYSFDWEMPAGMNKEDIDIDVKPGITMHKKNALCLLARIPSH

SEQ ID NO: 24752 - protein, 482 aa, Salmonella enterica subsp. salamae
MSDVPLIAVVMAGGTGSRLWPLSRELYPKQFLQLSGEHSLLQTTLLRLSALACKDPLVITNEQHRFIVAEQLRQIDQLHDNIILEPCGRNTAPAIALAAFSALKRNEQEDPLLLVLAADHVIAKENVFCSAIKKAVPIAENGNIVTFGIIPEYAETGYGYIERGAPISVNGNSTEIDFYHVKNFVEKPDRLTAEKYISTGNYFWNSGMFMFKATVYLNELKKFRPDIYNVCEQVVSSSYRDLDFIRIPETLFKDCPAESIDFAVMEKTEHYIVCPINIGWSDVGSWQSLWDISEKTDEGDVCKGDILTYNTKNNYIYSESALVAAVGVEDIVIVQTKDAILVSKKSDVQDVKKIVEMLKTQDRTEYIAHREVFRPWGKFDSIDQGERYRVKKIIVKPGEGLSLRMHHHRSEHWIVLSGTAKVTLDDKTMLVTANESIYIPLGATYSLENPGVIPLNLIEVSSGDYLGEDDIVRQKERYKKDN

SEQ ID NO: 24753 - protein, 382 aa, Zea mays
MSSTAARVVHPAAAAPPPPRPRRLAPARCAAGSATDTATAGPTRVTTVSNRGDSLAICRVLNGMWQTSGGWGRIDRDAAVDAMLAHADAGLSTFDMADHYGPAEDLYGMFINRIRRERPPEFLEEVKGLTKWVPPPVKMTRSYVEDHINRSRKRMDVTALDMLQFHWWEYSNPGYLDALKHITDLKEEGKIKTVALTNFDTDRLQIILEHAIPVVSNQVQHSIVDMRPQQRMAELCQLTGVRLITYGTVMGGLLSEKFLDTNVSIPFAGPPLNTPSLQKYKRMVDAWGGWSLFQTLLQALKKVSLKHGVTISAVAVKYILNQTSVAGSMVGVRLGLSEHIKDTNAIFSLEWDEEDMNIITEVSKRGRNLIDIIGDCGDEYRA

SEQ ID NO: 24754 - protein, 406 aa, Vibrio angustum S14
MTTEQRVERNLFDEVMVPCYSPMAEIPVRGSGARVWDQHDREYVDFAGGIAVSCLGHCHPIMVNALKDQADKLWHLSNVLTNEPALRLAKKLTELCFADKVFFANSGAEANEAALKLARRYAVDKFSTEKDQIIAFHQGFHGRTFFTVTVGGQEAYSDGFGPKPQAVTHIPYNDLSALAEIMSERTCAVMMEPLQGEGGLVSPSVEFVQGVRELCDKHQALLIFDEVQTGNGRTGDFYAYQGLGVTPDILTTAKSLGGGFPIGAMLTTTALAEHLKVGTHGSTYGGNPLACAVAEAVINEVSKPDVLAGVKEREHWFREGLTAINAKYPIFAEIRGKGLLLGASLTEEWQGRARDILVQAGKEGLMMLVAGTNVVRFTPSLVIEKADVDEGMARLERAIATLYNAE

SEQ ID NO: 24755 - protein, 177 aa, Physcomitrella patens subsp. patens
MGWLWTVVYQSYALSGPVMMLLYPLYASIMAIESHDKEDDQQWLTYWVLYSLVSLMEMAAGPVIAWIPFYSTFKLIIASWLVLPQFRGGIILYEKFVSPYLNAATGVTDQKLTDGQRKWLGSISPEAQASVAAFIKENGSSAFDAFMKSATGDVKQDKIEETVEKKEGEAAGSSDSD

SEQ ID NO: 24756 - protein, 474 aa, Salmonella enterica subsp. salamae
MNYIQPVILCGGNGTRLWPLSRELFPKQFLNINASESMLQRTLSRLEGLPVGAPVLICNEKHRFITAEQIRATNRKPESIILEPFGRNTAPAIALAALKNIEDAKDPLMLILAADHVFNDETSFRRAIMSACYYAESDKLVTFGIVPTKPETGYGYIKRGDSVNTCSSYLAFNVSAFVEKPDIEKAATYVSSQEYYWNSGMFLFKASKYIEELKKFRPDIIEACTKALALSHADLDFIRIDQQAFQTCPSDSIDYAVMEKTSDAIVVPMDAGWSDVGSWSSVWDVAVKNIENNVINGDVVALDTVNSYLHADGCLLTTIGINDLVIVCTKDAVLVAERNASQNVKNIVDTLKRNGRYEHQKHREVYRPWGKYDSIDSSERYQVKRITVKPGEGLSLQMHYHRAEHWIVVAGTARVTINDEVRLLGENESIYIPIGAKHCLENPGKIALELIEVRSGAYLEEDDIIRFADKYGRV

SEQ ID NO: 24757 - protein, 419 aa, Mycobacterium leprae
MPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 24758 - protein, 211 aa, Staphylococcus aureus
PSADMLFEPSFVNDIDVNENDVVHFCSVDLIDSPMREAHYQLITKTLNSNGTVVFDPNVRLPLWDNAEDLRQTIHTFLPLAHIVKVSDEELEFIIGIHDENEAIQSLFTGNVTVVIYTKGADGAAVYLKNGNNHYHSGYKVKPVDTTGAGDAFIGAVISRILATDVLNLTQLFENEGEEILAFSNRVAAIVTTKYGAINSLPTLQEVEQAF

SEQ ID NO: 24759 - protein, 173 aa, Physcomitrella patens subsp. patens
MGWFWSLVLKSNALAGPIVMLLYPLYASVMAIESPFKEDDQQWLTYWVLYSFVSLLEMAAAPVFAWIPLYSTIKLAVAAWLVLPQFRGGFILYEKYVRPNFQNVTGYSGAKLTESQRKFLATISPETRSSVAKYIEAIGPESFENLIQKELEESRKKRAEEHQQGAVENPHVE

SEQ ID NO: 24760 - protein, 511 aa, Cryptococcus neoformans var. neoformans
MFARQPLSQNLLRPLSRPSSSFSRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGAIGAGMDGEIGKQFQKILTKQGFKFKLNTKVISGHREGDIVKLKVDSAKGGKEETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKGAGVQYKIGKFPFAANSRAKTNQDSEGFVKFIVEKETDQVLGCHIIGPAAGELIASAVLAMEYKASAEDIARTCHAHPTLSEAFKEAALSSYDKPINF

SEQ ID NO: 24761 - protein, 479 aa, Bacillus thuringiensis serovar konkukian str. 97-27
MTTSNTYKFYLNGEWRESSSGETIEIPSPYLHEVIGQVQAITRGEVDEAIASAKEAQKSWAEASLQDRAKYLYKWADELVNMQDEIAEIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLVKEQVAKLSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 24762 - protein, 427 aa, Rhodopseudomonas palustris CGA009
MTAIVDIIGREILDSRGNPTVEVDVVLEDGSVGRAAVPSGASTGAHEAVELRDGDKARYLGKGVQKAVEAVNGELFDALGGMDAEQQVQIDQTMIELDGTPNKGRIGANAILGVSLAAAKAAAASYDMPLYRYVGGTSARTLPVPMMNIVNGGVHADNPIDFQEFMIMPVGAPTFADALRCGSEIFHTLKGELKKAGHNTNVGDEGGFAPNLPSADAALDFVMAAIGKAGYKAGGDVMLALDCAATEFFKDGSYVYGGENKTRSRSEQAKYLADLVARYPIVSIEDGMSEDDMDGWKELTDLIGSKCQLVGDDLFVTNVTRLADGIKNGRANSILIKVNQIGTLTETLAAVEMAHKAGYTAVMSHRSGETEDSTIADLAVATNCGQIKTGSLARADRTAKYNQLLRIEQELGAHAHYAGKAALKALR

SEQ ID NO: 24763 - protein, 432 aa, Bifidobacterium animalis subsp. lactis
  misc_feature (8)..(8): Xaa can be any naturally occurring amino acid
  misc_feature (10)..(10): Xaa can be any naturally occurring amino acid
  misc_feature (12)..(12): Xaa can be any naturally occurring amino acid
  misc_feature (423)..(423): Xaa can be any naturally occurring amino acid
MAVIESVXAXQXLDSRGNPTVQVVLDTEDGAQGLGLVPSGASTGEAEAWERRDGDKSVYGGKGVLNAVKAVNEVIAPKVIGMDAADQRALDDLMIELDGTPNKGKLGANAILGVSLAALYASAESAGLPLYRYIGGTNGHILPVPNMNIMNGGAHADFATDIQEYMISPYGFDTYSEALRAGVEVYHTLKNVLKKEGLNTGLGDEGGFAPKMKSNEDSLKYIMDAISAAGYEPGKQIGICLDVASSEFYNKETGKYRFDGEERDSAYMLDYYENLINEYPIVSIEDPFNEEGWEDWAAITARLGDRLQFVGDDLLVTNPARLQKAIDLGAANSLLVKLNQIGSVTETLDAIELATANGYTSMVSHRSGETPDTTISDLAVAKNTRQIKTGAPARGERVAKYNRLLEIEEELGSTAQYAGYSAXGTCKKYLAK

SEQ ID NO: 24764 - protein, 93 aa, Zea mays
  misc_feature (60)..(60): Xaa can be any naturally occurring amino acid
MEAEGDEDEWDREDQGNAAVKVMCRLCFSGENEGSTKAAKMLPCKLCSKRSWVCPSCRSXCEVCRRPGDPNKLMFCKRCDGAYHCYCQQPSHK

SEQ ID NO: 24765 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLATGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 24766 - protein, 185 aa, Ehrlichia ruminantium str. Gardel
MFIQIEDTPNPNTLKFMPGIPVNNGKIGEFTDSITAESSPFAKALFEIEHIVGVFFGGDFVSVTKSSDIEWDVLKPEILTVIMDFLTLNPNDSVENHDEEDLQEFFDAKDEEIVSKIKELIDDYIKPAVAQDGGDIKFKGYSNGIVFVKLRGACSGCPSASITLKEGIYNMLTYYLPDIQSVESV

SEQ ID NO: 24767 - protein, 168 aa, Glycine max
MSLSPQVGYLVPLNRNFKEEASVPKFAVSDGINVIGRNNIPVPDKRLSRKHLTLTASPNGSASLLVEGTNPIVVNSGNKRRKLNPKEEATICNGDIIELIPGHHLFKYQVLGGDGKSSTCRNNEAQSSFKNKASGRSSQDKVETSSQKQGRNADARKSSGEDNSVEAI

SEQ ID NO: 24768 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 24769 - protein, 228 aa, uncultured cyanobacterium
HEVAGAGQHELGMKFAQLIEAADNVMTYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEALNADRAFLTEGGVFTD

SEQ ID NO: 24770 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINPERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 24771 - protein, 64 aa, Arabidopsis thaliana
MRSILIDWLVEVHVKFDLSPETLYLTVNIIDRFLSLKTVPRRELQLVGVSALLIASKYEEIWPP

SEQ ID NO: 24772 - protein, 364 aa, Candida albicans SC5314
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHQNILTIQDMIFEEPKMSNRTDIITMRGSFYTVTPYMSSDLVGLLENPKIKLELGQIKCIMQQLLKGIQYVHNQKFLHRDIKAANILIGHDGVLKIADFGLARIYHGNVPRLGMGPGGGEKAYTGLVVTRWYRPPEILLGERKYTTAVDLWGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKI

SEQ ID NO: 24773 - protein, 480 aa, Physcomitrella patens subsp. patens
MMLLGSLVVAAIVGHFVLAWNRKRRNLPPVVDSAVPFVGGLLKFIKGPVPLLKEEYGRLGQVFTLQMLTRNVTFLIGPEVSAHFFKAQEADLSQREVYQFNVPTFGPGVVFDVDYSIRMEQFRFFTEALTVKRLRSYVEMMVEEAHLFFSKWGEEGEVDLKVELEQLIVNTASRCLLGPEIRNSHLEKVTSLFHDLDNGMLPVSVLFPYLPIPAHKRRDRARKELAEIFSKVIKARKASGKKEPDMLQAFMDSTYRSLKRGTTEEECTGLLIAALFAGQHTSSITSTWTGAYLMKYKQFMPAVIEEQKEIMRRHGDHLDYDVLNEMSCLHRAMKEALRLHPPLILLLRQNHTDFSVTTREGKSYTIPKGHIVGTSPAFANRLPYVYKDPDTFNPDRFAPGNEEDVKAGQFSYIAFGGGRHGCLGETFAYMQVKTVWSYLLQHFELELTGPKFPEVDWNAMVVGIKGEVMVRYKRRQLTCD

SEQ ID NO: 24774 - protein, 501 aa, Methanosarcina barkeri str. Fusaro
MSDKPEKLITDDGLRLDGRHADEIRPMKIEIGVLSRADGSCYLEWGRNKVLVGVFGPREAHPRRSQRADTAVIRYKYNMASFSTEDRARPGPSRRSIEISKVSREAFEPVIMAELFPKTAIDIFVEILQADAGTRTAAINASSIALADAGIPMKGLVTSCAFGKVDGQIVLDLNKEEDNYGEADFPVAMTQDGEITLLQMDGNLTTDEIRKGFELVKKGCKEILEIQQAVLRTKFETPVEEPEAKAAEEVEETELEVVETESSLEYAPEAAVVEEIIEEAEEPEEGISEETVEACAVNKEAPECEELEKVIKDAEAEVVEGEVTEKVVEAEVEEEAEEEAFEDKADFESSFEASFEEVSEAEELEEPESEEVVSGEEAEVESEIEESADEEAQPEVETQLEVETQLEEKAEVEEETQLEEKVQPEEEAGIEEVQPEEEAGIEEVASEETFESEPEIESEAESKKEAPAEQTIEESEEEKCKGPWKVVKDPSESGSRGENDE

SEQ ID NO: 24775 - protein, 260 aa, Methanosarcina barkeri str. Fusaro
MSEVIATLKKDYIYNLMIKGKRQDGRGFKDFRDIKLETNVIPKAEGSAKVTLGDTQVLVGVKLQPGTPFPDSQDEGVIITNLELNPIASPEFEPGPPREEAIEMARVVDRGIRESGAIDIKKLCISVGESVWIAYIDVHVLNDDGNIIDASSLAAIAALMTTIVPNEQHGIGADVPLAMKEMPVGVTLAKIGSKLMVDPSLDEGAVCETKLTVVSSSDGSVAGMQKMGTVPFTEAEVLEAIDMACEKAAEIRKLYLEALV

SEQ ID NO: 24776 - protein, 189 aa, Debaryomyces hansenii CBS767
MGKAKKTRKFALVKRTLNAKDPRINKNKAVAKKDEKDPELTKSVPQVSSSLFFQFNKSIKPPYQILIDTNFINFSIQKKIDITKGMMDTLFAKCIPMITDCVMAELEKLGPKYRIALKLAKDPRIQRLSCSHKGTYADDCLVNRVIQHKCYIVATNDADLKRRIRKVPGVPIMSVGGHAYVIERLPDVF

SEQ ID NO: 24777 - protein, 228 aa, uncultured cyanobacterium
HEVAGAGQHELGMKFAQLIEAADNVMTYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAGELQKIATVPPSLNGALEALNADRAFLTEGGVFTD

SEQ ID NO: 24778 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVELFSDVNVRSIGAMYAACTNWAGSLVIASTFLTMLENITPTGTFSFFAGLCFIAFFFVYFLLPDTAGLELEETTDFLSNGFNVKQAAQLSKERKKHSKFAKSKPTV

SEQ ID NO: 24779 - protein, 374 aa, Physcomitrella patens subsp. patens
PPPPPARSLLYRSVTYLHRRASLQRTYYQRAPPLSSYTAARNAEGVITMMSFLGTEGSNADVDMVVLMAHIQAACKHIAAILSSPRELQYNYEPYFEGGKRDDSRSLKSISNYIFQLALRNSGKVAAISSEEDEAPIWFGDGPYIVVFDSLDGFEDFDELTPTSTMFSIYHRIHEADHLLLEQKATINVMQRGDRLVAAGYTIYSSSTMMCFSLRTGLHGFTLDHDVGEFVLTHPDIQIPERGNVYSVDDGRYFDWPPGLRHYVDNIRQGQGQSSQRYSARHVSSLVADLHRTILFGGIVMNPRTQLHLIHEANAVSFLVENGGGQAIDGRRRILEIQPTHLHQRMPLFLGSSADVSELEAYGDIQEVFDPNSE

SEQ ID NO: 24780 - protein, 293 aa, Fusobacterium nucleatum subsp. nucleatum ATCC 25586
MKKGVDIMKIFVCDAFSSKIFKGNQAGVVILEENENYPRETLMKNIAAELKHSETAFVKKIDNKKFKIRYFTPTEEVELCGHATISVFSVLRELNIVSVGKYIAETLAGNLEIIIDKDFIWMDMASPKIEYIFNLDEIKEIYSAFNLDVNQAPKNLIPKVVNTGLSDIIIPIENKETLDSFVMNKEKVIEISKKYKVVGAHLFTLDKIKKVTAFCRNIAPLVGIDEECATGTSNGALTHYLKDYNIISTQDINIFIQGESMGKTSTILSRYKEDKKTIQIGGNAVISFECKLY

SEQ ID NO: 24781 - protein, 189 aa, Triticum aestivum
  misc_feature (25)..(25): Xaa can be any naturally occurring amino acid
  misc_feature (104)..(104): Xaa can be any naturally occurring amino acid
  misc_feature (126)..(126): Xaa can be any naturally occurring amino acid
  misc_feature (150)..(150): Xaa can be any naturally occurring amino acid
PLRCARFPRAVRNLTWPCRRWWSTXVVFPPVARPPGSAGSHFLGGAGVRGLEIGGNFIKFTAIGVYLEDAAVPALAKKWGGKTADELASDAAFFRDVVTGDFEXFTRVTMILPLTGEQYAEKVTEXCVAFWKAAGLYTDAEGSRGEFKEXFQAKDFAPGASSSYASPAGSQRRLSRISVNGRAGKHALR

SEQ ID NO: 24782 - protein, 459 aa, Vitis vinifera
MASPPDTSKTTKLERYNSYIRRVNSTKLMAASSKLLFRATLLVALVLIFFFTLNYPPLSDNPHHVLTHQNFLSSAFYGSGASWEKQVRHSSTPRRPNGFSVLVTGAGGFVGTHCSLALKKRGDGVLGLDNFNDYYDPSLKRARQAMLSKHQIFIVEGDLNDAPLLSKLFDMVPFTHILHLAAQAGVRYAMQNPQSYVRSNIAGFVNLLEIAKAADPQPAIVWASSSSVYGLNTENPFSELHRTDQPASLYAATKKAGEEIAHTYNHIYGLSLTGLRFFTVYGPWGRPDMAYFFFTKDILQGKPITIYQTQDDKEVARDFTYIDDVVKGCLGALDTAEKSTGSGGKKRGPAQLRIYNLGNTSPVPVGRLVGILEGLLNVKAKKHVIKMPRNGDVPYTHANVSLAYRDFGYKPSTDLATGLRRFVKWYVSYYGIQTRLLLWSMLACRIRSIGRCCPFLFVV

SEQ ID NO: 24783 - protein, 288 aa, Oryza sativa
  misc_feature (208)..(208): Xaa can be any naturally occurring amino acid
  misc_feature (261)..(261): Xaa can be any naturally occurring amino acid
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLXFDVCGIKADWKMQDVLDEKIRTIQSMVGPDEHVICALTGGVESTVAATLGHKXIRDKLHLCFLLNNGPIKKKMKGERGKG

SEQ ID NO: 24784 - protein, 589 aa, Acidovorax sp. JS42
MTFSIHGLAVARGIAIGRAVLAVSSRMEVVHYFIEPGQVEAEILRARRGRDAVAEELQRLQADMPHDAPPELAALLDVHLMLLQDEMLVNGVKHWITDRLYNAEWALTTQLEIISRQFDEMEDEYLRERKADLEQVVERILRHMRGVASPVAPPPSAPRRQAEAGAEAEFLLGGAADAPLVLVAHDLSPADMLQFKQSVFAGFVTDVGGKTSHTAIVARSMDIPAVVGARSASQLVRQDDWVIIDGDAGVVIVDPTPIILAEYGFRQRQITLEHERLMRLRHTPAVTLDAQAIELLANIEQPGDAGAALRAGAAGVGLFRSEFLFMGRSGRLPDEEEQYRAYREAVEGMQGLPVTIRTVDVGADKPLDKGYKDSSLNPALGLRAIRWSLADPAMFRTQLRAVLRAAAHGPVRLLFPMLAHVSEIRQTLAQVDLARAELDARGAAYGAVQLGAMIEVPAAALMVRQFLRYFDFLSIGTNDLIQYALAIDRADEAVAHLYDPLHPAVLRLVADVIAEGARQGKSVSVCGEMAGDVAMTRLLLGLGLRSFSMQPAQILAVKQEVLRADARKLGEWAQQLLDADDPAASLQAP

SEQ ID NO: 24785 - protein, 378 aa, Dunaliella salina
MAFALRTGVAPSVLPRGQSRRQMVCRAGKFDEELMKTARTIASPGRGILAMDESNATVGKRLDSIGLENSEANRQAYREMLVSTKGLGQYISGAILFEETLYQSGSNGKRMTDMLVENGIVPGIKVDKGLAPLANSNNEQWAMGLDGLDKRCAEYHKAGARFAKWRSVVSIPNGPSPIAVRETAYGLARYAAICQNNGLVPIVEPEILLDGDHDINRCLAVFEDVWAETFKYLADNKVLFEGILLKPSMVTPGAESPARATPQQVAEMTLIGLKRRVPPAVPGIMFLSGGQSELEATLNLQEMNRQPNPWHVSFSYARALQNTVLKTWQGKPENVPKAQEALLKRAKANSDAQRGQYDPATEGSTEAAQSMYQEGYSY

SEQ ID NO: 24786 - protein, 433 aa, Salmonella enterica subsp. enterica serovar Paratyphi A str.
MKNELMQRLRLKYPPPDGYCRWGRIQDVSATLLNAWLPGVFMGELCCIKPGEELAEVVGINGSKALLSPFTSTIGLHCGQQVMALRRRHQVPVGEALLGRVIDGFGRPLDGRELPEVCWKDYDAMPPPAMVRQPITQPLMTGIRAIDSVATCGEGQRVGIFSAPGVGKSTLLAMLCNAPDADSNVLVLIGERGREVREFIDFTLSEETRKRCVIVVATSDRPALERVRALFVATTIAEFFRDNGKRVVLLADSLTRYARAAREIALAAGETAVSGEYPPGVFSALPRLLERTGMGEKGSITAFYTVLVEGDDMNEPLADEVRSLLDGHIVLSRRLAERGHYPAIDVLATLSRVFPVVTSHEHRQLAAILRRCLALYQEVELLIRIGEYQRGVDTDTDKAIDAYPDICTFLRQSKDEVCGPELLIEKLHQILTE

SEQ ID NO: 24787 - protein, 473 aa, Salmonella enterica subsp. indica
MIPVILAGGTGSRLWPLSRELFPKQFLKLSSELTMLQATFARLNDLNYKNSIVICNEAHRFIVAEQLREIGKLSNNIILEPHGRNTAPAITLAALAVKQRFPDKDPLILILAADHIIKDDRIFCNLIKKAAPLANKGKFVTFGIVPFKPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLIGENESIYIPLGATHCLENPGKIPLDLIEVRSGSYLEEDDVVRFEDRYGRV

SEQ ID NO: 24788 - protein, 224 aa, Vibrio angustum S14
MKDFLIAPSILSADFARLGEDVDKVLAAGADVIHFDVMDNHYVPNLTFGAPICKALRDYGITAPIDVHLMVKPVDRIIPDFAKAGATMITFHVEASDHVDRTLQLIKEHGCKAGVVFNPATPLHHLDYIMDKVDMILLMSVNPGFGGQSFIPSTLDKLREVRKRIDASGRDIRLEIDGGVKVDNIREIAAAGADMFVAGSAIFNEPDYKVAIDKMRAELAEAKC

SEQ ID NO: 24789 - protein, 548 aa, Xanthomonas sp.
MTEITVNGMTCTSCATHVKDALEKIPGVNAAVVSYPESRAQVMADTAVSHNQLLAAIAALGYQGSIRVGDFKDEPKIRDALEGAGLHIAIIGSGGAAMAAALKAVEQGATVTLIERGTIGGTCVNIGCVPSKIMIRAAHIAHLRRESPFDGGIAATVPAIDRSKLLAQQQARVDELRHAKYEGILDGNPAITVLHGEARFKDDQSLVVRLNEGGEREVTFDRCLVATGASPVVPPIPGLKESPYWTSTEALVSDTIPARLAVIGSSVVALELAQAFARLGSQVTILARSTLFFREDPAIGEAVTAAFRAEGIEVLEHTQASQVAHVNGEFVLTTGHGELRADKLLVATGRAPNTRSLALDAAGVTVNAQGAIVIDQGMRTSNPNIYAAGDCTDQPQFVYVAAAAGTRAAINMTGGDAALNLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFNKDVKQLSCCAG

SEQ ID NO: 24790 - protein, 381 aa, Arabidopsis thaliana
MDLTDRRNPFNNLVFPPPPPPPSTTFTSPIFPRTSSSGTNFPILAIAVIGILATAFLLVSYYIFVIKCCLNWHQIDIFRRRRRSSDQNPLMIYSPHEVNRGLDESAIRAIPVFKFKKRDVVAGEEDQSKNSQECSVCLNEFQEDEKLRIIPNCCHVFHIDCIDIWLQGNANCPLCRTSVSCEASFTLDLISAPSSPRENSPHSRNRNLEPGLVLGGDDDFVVIELGASNGNNRESVRNIDFLTEQERVTSNEVSTGNSPKSVSPLPIKFGNRGMYKKERKFHKVTSMGDECIDTRGKDGHFGEIQPIRRSISMDSSVDRQLYLAVQEEISRRNRQIPVAGDGEDSSSSGGGNSRVMKRCFFSFGSSRTSKSSSILPVYLEP

SEQ ID NO: 24791 - protein, 652 aa, Escherichia coli
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDVALSGMAKSRRLRTARQEHQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVGVTVYDRHPEIGGLLTFGIPSFKLDKSLLARRREIFSAMGIHFELNCEVGKDVSLDSLLEQYDAVFVGVGTYRSMKAGLPNEDAPGVYDALPFLIANTKQVMGLEELPEEPFINTAGLNVVVLGGGDTAMDCVRTARRHGASNVTCAYRRDEANMPGSKKEAKNAREEGANFEFNVQPVALELNEQGHVCGIRFLRTRLGEPDAQGRRRPVPVEGSEFVMPADAVIMAFGFNPHGMPWLESHGVTVDKWGASSRMWKASTVTRPPIRKSSLVVTPCVVRIWWLPQWQKDVMRHRGLLTGWG

SEQ ID NO: 24792 - protein, 478 aa, Salmonella enterica subsp. enterica
MAAETLIPVIMAGGTGSRLWPLSRELYPKQFLCLQNNLSMLQSTISRLDGIKHASPIVICNEKHRFIVADQLLQMNQLTNNIILEPVGRNTAPAVALAALVAKNNSSKEDPLLLILAADHVFTNENEFRITVSKAIPFADRGKLVTFGIVPSKAESGYGYILRGNKLQLEDDIIAFDVEQFVEKPSIETAQAYVASGDYYWNSGMFLFRAGRYLEELKKYRPDILIACEKSISDLNIDLNFVRINEDDFYPCPDVSIDYAVMEHTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFRDRYGRK

SEQ ID NO: 24793 - protein, 211 aa, Staphylococcus aureus
PSADMLFEPSFVNDIDVNENDIVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGISHYHSGYKVKSVDTTGAGDAFIGAVISRILANDVLNLTQLFENEGEEILAFSNRVAAIVTTKYGAINSLPTLQEVEQAF

SEQ ID NO: 24794 - protein, 185 aa, Zea mays
  misc_feature (12)..(12): Xaa can be any naturally occurring amino acid
  misc_feature (148)..(148): Xaa can be any naturally occurring amino acid
  misc_feature (171)..(171): Xaa can be any naturally occurring amino acid
MRKIWCILAVYXGGPTMGGIVLYRPHIEDSALEISKRRIQDCNTETVPIYQHDLHDDVNELRGMKLLFSSDAVNHGHDVDIILAPVNIPMKTGVLGAGKAGELTYCESAARMSLHESESDNIVAEKSSDRDNSAEAMREYLDYTSEGXCNYQILSNPEFLAEGTAIEDLFXPDRVLIGGRETPEA

SEQ ID NO: 24795 - protein, 471 aa, Salmonella enterica subsp. enterica
MIIPIIMAGGSGTRLWPLSRSLYPKQFLSLTSQHSLLQETLNRLKGLDCLSPIIVSNNEHRFIVAEQLRQLGINNFQIILEPVGRNTAPAVALAALKALELYGDHLMLVLAADHAIQNVDAFHTAIVAAEKEALNNKLVTFGIVPTKPETGFGYIKKGERVNDSSFQVESFVEKPDIETAKDYLKQNCYLWNSGMFMFKASTYLEELNKYRPDILSACKESLSGACTDLDFIRLNSEKFAACPDESIDYAVMEKTQDCVVVPLDANWSDIGSWSSLWDISEKDKNKNVSHGDVINYNSKNNYIYSESALISTVGVNNLIIVQTKDAVLVAQQDNVQDIKKIVEILKDSKRNEHISHREVYRPWGRYDSVEHGERYKIKRIMVKPGECLSSQMHHHRAEHWVVVAGTAKVTCGEQTYYVAENESTFIPIGTIHSIENPGKIPLEVIEIQSGPYLEDDDIIRLADKYGRVGEK

SEQ ID NO: 24796 - protein, 860 aa, Arabidopsis thaliana
MRSEITRETKLLFDLPQDVIEEIFSKVPVTCLRRIRSTCKRLYALLKDRGFIRKHFAKSARQYHALMLKNFRFYSVSFNPNGTEMDVASLFNGERSLIDPYSSSEAIISQAFHCDGLLLCTTKENRLVVLNPFSGQTKWLQPQNRCKIDEAYVLGYDNSDLCHSYKILSFPDLYEQELETIKNAGRDLDVTPEGDLELKTDDFSSNSWRRNLGVTPHGGLGLKIYDFSSNSWKKLDVITPEGCLKSYGVSLKGNAYWVYMSKRRGVNDYSLLSFDFSTESFQHLCVPFHQEADCFGTMALSVVREEHLSLLYQSCETLKVEIWMTKEIDTTFVSWKKFLTVDLEPHLPHLLMFSCRMSFFIDEEKKVAVCCDRDNKVHVVGEDEYRVSSGQKPQDKQTRMFTDLPRDLETEILSRVPATSLQKLKPTCKRWYTLFKDPEFLKKHVGRAEREVISLMSLRVYSLSVNLSGIHSSVEMTGMLNSLKDSEDVKISDITECNGLLLCTTDDSRLVVWNPYTGETRWIPYKSNSPYEMYQKFVLGYDNTNKSRYSYKILRCYHGLIDFGYEFEIYEFNSHSWRRFYDNSPNCSFESKGVTLKGNTYWFASDTEGRHIILRFDFATERFGRLSLLYQSGGYVDNVVETGVLSAVREEKLALLYERFDELNDSSEMKIWVTNTKIVEAKDLSWSDFLVVDSSKFMVTRMTNVMSFLVDEEKKMVVVCDTDIDQHMNRFYIVGEDIYKEVYKDIAQGWFSYWPLLISYAPSLVQIQQVILRITIRYIEMGKSKKMSTLSVIRALLPCCSNSGDDWSDEGVIIRSRIMTSDEDGRLWIAEPGVDRRATSYIARFYENRVSDPNYKTLSP

SEQ ID NO: 24797 - protein, 230 aa, Ehrlichia ruminantium str. Gardel
MKEKSKFVHQVFTSVASRYDIMNDIMSFGLHRLWKDQVVQSIHKGSLLDVACGTGDIAVKVANYKKDVDIVVCDININMLNRGRDNAVNANILNLKWVCGNAEQLPFYDNTFDYYTISFGIRNVSNRQLALNEAYRILKPGGKFICLEFSPLKKNHCLYTLYNFYSFKVIPNIGQLVAKDRASYQYLVDSIQAFPYQDDFIQEIQNSNFVQARYRNLCFGIVTLYTAWKV

SEQ ID NO: 24798 - protein, 415 aa, Ehrlichia ruminantium str. Gardel
MTKILVKKFGGTSLQNIKCINQVTEIIKQDVCSNHKVVVIVSAMGKFTDNIISQIKKISDVKSYNELSEYDLIISSGEQISCGMLSLALQKLGIKAQSWLGWQLPIVTTDDHTKARIMEINTSALQDFLANNDVAIIAGFQGMHKENRVTTLGRGGSDTSAVAIAAALGIDLCYIYTDVDGIYTSDPNIVPKARKLDYIAYDEMIEMASLGAKVLQVRSVELAMKYNIKLHVLSTFNSIKGTILCKKGEIKMESQLITGITYNSNTASITLKKVRALFGITTLFSIIADNGINVDMIIQNMDNNANDITFTIPEEDLSITETLLIKTKDKLMYEELIINPDVAKVSVIGVGMISHPGIAYKMFDTLTSNNITILAVTTSEIKISVLVLRKDGQLATQYLHSSFKLDSQSNLHTTS

SEQ ID NO: 24799 - protein, 145 aa, Zea mays
MASSMLSSAAVVTSPAQATMVAPFTGLKSSAAFPVTRRADNDITSIASNAGRVSCLKVWPPVGRKKLETLSYLPDLTEAELGEEGDYLLRHTWIPCVEFEPHHAFGAPRTTARTPWMLPRTGAWTSVDTSPPLLRMRLDVVLEGG

SEQ ID NO: 24800 - protein, 228 aa, uncultured cyanobacterium
HEVAGAGQHELGMKFAQLIEAADNVMTYKYVVRNVAKKYGKTATFMPKPVFNDNGTGMHVHHSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKISTVPPSLNGALEALSADRAFLTEGGVFTD

SEQ ID NO: 24801 - protein, 488 aa, Leifsonia xyli subsp. xyli str. CTCB07
MRRAKIVATLGPATSSYDNIRAIVDAGVDVARMNLSHGSYEVHEGVYANVRKAAEDAGKPVAVLVDLQGPKIRLGKFEAGPYELAEGDIFTITTEEIIGTKEISSTTFKGLPQDVKPGDFLLIDDGKVRVRVLETDGTAVTTEVVVAGPVSNNKGINLPGVAVNVPALSEKDEADLRWGLNLGADLIALSFVRNAGDIERVHEIMAEEGRKVPVIAKIEKPQAVDALEGIIEAFDGIMVARGDLGVELPLEAVPIVQKRAVELARRAAKPVIVATQMLESMISSPVPTRAETSDVANAVLDGSDAVMLSGETSVGEYPKITVQTMAKIVKSTEEHGLDRIAPLGTKPRTQSGAITLAATEVADFVEAKYLCVFTESGESARRMARLRSKIRILAFTPEESTRRKMALYWGVESFVVDRVTHTDQMVAQVDEALKSTGRAENGDKVVIISGSPPGIPGTTNDIRVHRVGDVLCSETQRRASRFGDRSRL

SEQ ID NO: 24802 - protein, 563 aa, Coccidioides immitis RS
MGYRKLINVNDVNPEEVIEQLRNDPEESHRQHVFTLNAVATRTAYSTRYASSEEIPKFRIPQLGASAEAVYRLLRDELDLDGIPNLNMASFVGTFMEREAQQLLVENIGKNLADADEYPALMDLHARCISMIANMWHPQPGEQPIGTATTGSSEAIQLGGLAMKRRWQEKRRAEGKDTSKPNILMGANAQVALLKFARYFDVEARILDVSENSHYRLDPNDIKKNVDENTIGIFVILGSTYTGHYEPVEELSRILDQVQEEHGWDIPIHVDAASGGFIAPFTYAGAGGSKWDFELPRVHSINVSGHKFGLVYVGLGWIIWRDRAYLPKDLIFELHYLGGTEESFGLNFSRPGIQVIGQYYNLIRLGFDGYREVMENCLRNARLLSKALERTGWYVCVSDIHRKKGDYRFRGVGEIQPHRPGETSADYNEGLPVVAFRFSEQFKKEYPDVKQEAISLLLRAKQYIIPNYPLPPKTDNIEILRVVVRESMSGDLIDKLISDIVEVTERVMTSEPIDVAVLQSRPTSLARRHGRLETKLPAKKITKVKAGEKARHPMAKGGHRSVC

SEQ ID NO: 24803 - protein, 476 aa, Silicibacter sp. TM1040
MSNLKEPSFRESVDLMFNRAVALMDLPPGLEEKIRVCNATYTVRFGVRLRGQIHTFTGYRSVHSEHMEPVKGGIRYAMGVNQDEVEALAALMTYKCALVEAPFGGSKGGLRIDPRQYDEHELELITRRFAYELAKRDLINPSQNVPAPDMGTGEREMAWMADQYARMNTTDINARACVTGKPLNAGGIAGRVEATGRGVQYALQEFFRYEEDKAKAGLSGTLDGKRVIVQGLGNVGYHAAKFLSEEDGCKIVAVIERDGGLYDENGLDIEDLRAWIEKHDGVDGYPSGRYIKNGAKYLEEDCDILIPAALEGVINLSNAENVKAKLIIEAANGPVTAGADEILRKKGTVIIPDMYANAGGVTVSYFEWVKNLSHIRFGRMQRRQEEARHQLVVDQLEMLSESMGKTWSLDPKFKEKYLRGAGELELVRSGLDDTMRIAYQSMRQVWHERDDVSDLRTAAYLVSIDKVASSYRAKGL

SEQ ID NO: 24804 - protein, 412 aa, Streptococcus pyogenes SSI-1
MEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 24805 - protein, 228 aa, uncultured cyanobacterium
HEVAGAGQHELGMKFAQLIEAADNGMTYKYVVRNVAKKYGKTATFMPKPVFKDNGTGMHVHQSLWKGGEPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADQLAQIATVPASLNGALEALNADKHYLMEGGVFSE

SEQ ID NO: 24806 - protein, 646 aa, Burkholderia mallei ATCC 23344
MIRFNQFSLARGTKPLFDATSFTLNPGEKAGLVGANGAGKSTLFAVLRGELHADAGDFSMPPAWRIAHVSQETPAVERSALDYTLDGDAALRAIEARIAQASAAHDGAAEADAHAAFADADGYTAPARAEALLLGLGFTLAQTREPVASFSGGWRMRLNLAQALMCRSDLLLLDEPTNHLDLDAIVWLEDWLHRYPGTLVIISHDREFLDAVCDVTLHLENRQVKRYGGNYSQFEVLRAQQLELQQSAYEKQQKTIAHLQSFVDRFKAKASKAKQAQSRVKALEKMERIAPAHIASPSTFEFRTPDSAPNPMLVMENVRCGYRADDGGEIPIVERVALSIQNGQRIGLLGANGQGKSTLIKTLAGTLAPLSGELRTGRGLTIGYFAQHQLETLREDDSALAHLARLAPDTREQELRDFLGGFNFSGEMATAPIAPFSGGEKARLALALIIWRKPNLLLLDEPTNHLDLETRHALTMALAQFEGTLILVSHDRHLLRATTDQFMLVAKHRLQPFDGDLDDYRDWLLQHAAEQRAAAKAACGPAGDADGGAPAVNRKDQKRQEAEARQRLSQLKKPLQARITKIEKEMERLHAQKAELDAFVADPASYAADQKTRLTEAIRKLGDVNGQLETLEADWLGAQDELEKIG

SEQ ID NO: 24807 - protein, 228 aa, uncultured cyanobacterium
HEVAGAGQHELGMKFAKLIQAADNVMTYKYVVRNVAKKYGKTATFMPKPVFNDNGTGMHVHQSFWKGGQPFFFSEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 24808 - protein, 197 aa, Zea mays
  misc_feature (189)..(189): Xaa can be any naturally occurring amino acid
MSCLVAAYEALPCMYDIALSRPDLENRRPHLYPHRIQGRNTVTLLIYHPDLEDDVQQRRARNLFFGTDEEKHPPEAEIIFVSVNTPTKTRGLGADKAADLTYCDSAARMIADVSKSDKIVDDKSTVPVKTAEAIEKILTHNSKGINYQILSNPEFLAEGTAIEDLLQPDRVLIGERETPEAACRPALRXVYAHWDPE

SEQ ID NO: 24809 - protein, 453 aa, Persea americana
MDNKGGILMQRFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDAGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQRESLVCSQGQSL

SEQ ID NO: 24810 - protein, 228 aa, uncultured cyanobacterium
HEVAGAGQHELGMKFAELIQAADNVMTYKYVVRNVAKKYGKTATFMPKPVFNDNGTGMHVHQSFWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 24811 - protein, 228 aa, uncultured cyanobacterium
HEVAGAGQHELGMKFAKLIQAADNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEGNCSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 24812 - protein, 566 aa, Methanosarcina barkeri str. Fusaro
MKPAQNSRRSFHYSLFQGILPLKSKQIPLEIAAGITFAAFAIPEVMGYTKIAGMPVVTGIYTILFPMLAFAIFGSSRHLVVGADSATAAIIASGLTTIAVPGSSQYVAYASAIALLVAILLFLGGLLQLGFLADFLSYTILIGFLTGVGIYISISQISGMLGIPSEPDGTSVQILSLVRNLSLTNTSTLLVSLSVIGVIVLGEKLSHKFPGSLIAIIGAIAASRILDLSSYGISILGAVPQGLPQISLPQIPLSNLPEIFNISISCFIIILAQSAATSRAYAIKFSDTFNENTDLIGLSLANAAAGISGTFVVNGSPTKTEMIKNAGGRTQLTQLTTVFTVILVLLFFTRPFAYLPTAVLSSMVFLIGLHLIDIKGMTSLHRQRPVEFAVALITAITVVVIGVEQGILIAIVLSIIAHLRHSYRPLNLLLVPKAGGAMKTFPLESGQQAVEGLLIYRFGSNLYFANEGRFAEEIIDLAIKNGSLKWFCISATNIGDIDFTSAETLKKVYTELQKLDITLVLSEVVQPVMNELDRDGITQMIGKDHIFESVQDVIEEYKRSTDSSLR

SEQ ID NO: 24813 - protein, 544 aa, Mycosphaerella graminicola
MGLLQEVLAQFDAQFGQTSLWKLVGLGFLAFSTLAILLNVLSQLLFRGKLSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYGYGLVSKGAASPYLPFGAGRHRCIGEQFAYVQLQTITATMVRDFKFYNVDGSDNVVGTDYSSLFSRPLSPAVVKWERREEKEEKN

SEQ ID NO: 24814 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIVKIKDNSWFKRGFEAKFTKGETKSKELAPLDTDAAFASTDTGVAARKPELVKPQNLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVGSQGQSL

SEQ ID NO: 24815 - protein, 335 aa, Xanthomonas campestris pv. campestris str. ATCC 33913
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQEVSADGEVAVSGARVTRKGSERIVRYAFDLARATGRKKVTAVHKANIIKSTSGLFLKVARDVATQYPEIEFQEMIVDNTCMQLVMRPEQFDIIVTTNLFGDIISDLCAGLVGGLGLAPGANIGVDAAIFEAVHGSAPDIAGQGKANPCALLLGAAQMLDHIGQPQNAERLREAIVATLEAKDSLTPDLGGTGNTMGFAKAIASRL

SEQ ID NO: 24816 - protein, 208 aa, Xanthomonas campestris pv. campestris str. ATCC 33913
MSIVTKALNLVPMVVEQTSRGERAYDIYSRLLKERLIFLVGPIDDHMANVIVAQLLFLEADNPEKDISIYINSPGGVVTAGMAIYDTMQYIKPDVSTICVGQAASMGALLLASGAAGKRYALPNSRVMIHQPLGGFQGQATDIDIHAREILTLRSRLNEILAKHTGQSLETIARDTERDNFKSAVDAQAYGLVDHVLERRPEESIQPS

SEQ ID NO: 24817 - protein, 468 aa, Acidovorax sp. JS42
MAQVQGKIVQCIGAVVDVEFPRDRMPKVYDALKLEGSPLTLEVQQQLGDGVVRTIALGSSDGLKRGLMVTNTGNPITVPVGKATLGRIMDVLGNPIDERGPVDQSLTASIHRKAPAYDELSPSQELLETGIKVIDLVCPFAKGGKVGLFGGAGVGKTVNMMELINNIAKAHSGLSVFAGVGERTREGNDFYHEMADSGVVNLENLGESKVAMVYGQMNEPPGNRLRVALTGLTIAESFRDEGRDVLFFVDNIYRYTLAGTEVSALLGRMPSAVGYQPTLAEEMGRLQERITSTKVGSITSIQAVYVPADDLTDPSPATTFAHLDSTVVLSRDIAALGIYPAVDPLDSTSRQLDPQVVGEEHYQVARQVQGTLQRYKELRDIIAILGMDELAPEDKLVVARARKIQRFLSQPFHVAEVFTGSPGKYVPLSETIRGFKMIVAGECDHLPEQAFYMVGTIDEAFEKAKKVA

SEQ ID NO: 24818 - protein, 301 aa, Sporisorium reilianum
SFGRIGRIVFRNSVAHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDSYDPKAQVVLTASCTTNCLAPLAKVIHDKFGIAEGLMTTVHATTATQKTVDGPSAKDWRGGRAAAANIIPSSTGAAKAVGKVIPSLNGKLTGMAFRVPTTNVSVVDLTARLEKGASYDEIKAELKRASENELKGILGYTEDAVVSQDFIGNSHSSIFDAAAGISLNNNFVKL

SEQ ID NO: 24819 - protein, 301 aa, Sporisorium sorghi
SFGRIGRIVFRNSVVHNTANVVAINDPFIDLEYMVYMLKYDSTHGVFNGDISTKDGKLVVNGKSIAVFAEKDPSNIPWGQAGAHYVVESTGVFTTIDKASAHIKGGAKKVVISAPSADAPMYVCGVNLDSYDPKAQVVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLDKGASYDEIKAEVKRASENELKGILGYTEDAVVSQDFIGNSHSSIFDAAAGISLNNNFVKV

SEQ ID NO: 24820 - protein, 308 aa, Arabidopsis thaliana
MGSLDLPYASSFKGGSETFLQNVFESILKTYLRKNPMAKTIWELVKSVDNEKISYDHFFFRTFKVDGYGIDSLASFFMDYGYKVGGRLDFPKKKVQVLWLSPPDVHFPDNGYGIGNGPLPRLVIAELLVEELSPESQEIIRKYLKPEGGKQAVLSSTLGSLIWEKPTSTDFNQLAKESEFAAWTLVYGYTMNHLAFAVHRLKHRFSDIKCVKEYFEENGFELNKDGGVLKVSEDSLLLQVSAMSEKLVVEFADGVTQIVPASYIEFVERLVLPQFKDMPCDEIKEFHRREGLEQASAYHIMESTRFTA

SEQ ID NO: 24821 - protein, 278 aa, Rhodopseudomonas palustris CGA009
MSLAIGSASGTLQPFIARVLMPVPAVRPLIAGNWKMNGLKDSVAELDAMLKGAAELPQGIDLLVCPPATLVASFAARVAEAQAGKALPFSIGGQDCHANASGAHTGDIAAEMLADAGAAAIIVGHSERRADHAENDAIVRAKAQAVWRAGLVAIVCVGETQGERDAGHTLDVVAGMLAGSLPDGATAANLVVAYEPVWAIGTGRTPTAADVEEVHGFIRKTLSDRFGAAGETMRILYGGSVKPSNARELLAVPHVNGALIGGASLKASDFLAIAAGCP

SEQ ID NO: 24822 - protein, 242 aa, Vibrio angustum S14
MFASKEGQAVPQVTFHTRKGDQWVDVTTEDLFANKTVVVFSLPGAFTPTCSSSHLPRYNELAPVFAENGVDDILCVSVNDTFVMNAWKADQDAENITFIPDGNGEFTKGMGMLVEKDDLGFGARSWRYSMLVKNGVVEKMFVENEEPGDPFKVSDADTMLKYIAPEQKLQESITVFSKPGCPFCVKAKQNLIDKGLQYEEIILGKDATTVSLRAITGRSTVPQVFIGGKHIGGSEELETYLG

SEQ ID NO: 24823 - protein, 222 aa, Arabidopsis thaliana
MEVKGKETASVLCLSKYVDLSSEESHRYYLARRNGLQILRDRGYEVSDEDINLSLHDFRTVYGERPDVDRLRISALHRSDSTKKVKIVFFGTSMVKVNAIRSVVADILSQETITGLILVLQNHVTNQALKAIELFSFKVEIFQITDLLVNITKHSLKPQHQVLNDEEKTTLLKKFSIEEKQLPRISKKDAIVRYYGLEKGQVVKVNYRGELTESHVAFRCVW

SEQ ID NO: 24824 - protein, 211 aa, Staphylococcus aureus
PSADMLFEPSFVNDIDVNENDVVHFCSVDLVDSPMRDAHYQLITKTLNAYGTVVFDPNVRLPLWDNAEDLRQTIHTFLPLAHIVKVSDEELEFITGIHDENKAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 24825 - protein, 500 aa, Pseudomonas syringae pv. tomato str. DC3000
MSESPVIGHYINGQANNGDGERYSDVFNPAIGTVQARVALASVKTVDEAVASAKAAFAGWADQSSLRRARVMFKFKELLDQHHDELAQIICREHGKVLSDARGEVVRGIEIVEFACGAPNLLKSDFSDNIGGGIDNWNLRQPLGVCAGVTPFNFPVMVPLWMIPMALVTGNCFILKPSERDPSASLLMARLLKEAGLPDGVFNVVQGDKVAVDALLQHPDIEAVSFVGSTPIAEYIYQQGTSRGKRVQALGGAKNHMIVMPDADLDQAADALIGAAYGSAGERCMAISIAVVVGDVGQRLIDKLLPRIDQLKVGNGMQADSDMGPLVTAVHKAKVEGFIDQGVKEGAKLIVDGRNFSVPGAEQGFFVGATLFDNVTPQMQIYKEEIFGPVLGIVHVADFASAVELINAHEFGNGVSCFTSDGGVARAFARTIKVGMVGINVPIPVPMAWHSFGGWKRSLFGDHHAYGEEGLRFYSRYKSVMQRWPDSIAKGPEFSMPTAK

SEQ ID NO: 24826 - protein, 228 aa, uncultured cyanobacterium
HEVVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTD

SEQ ID NO: 24827 - protein, 363 aa, Rhizomucor miehei
MVLKQRANYLGFLIVFFTAFLVEAVPIKRQSNSTVDSLPPLIPSRTSAPSSSPSTTDPEAPAMSRNGPLPSDVETKYGMALNATSYPDSVVQAMSIDGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALGLYQREEGLSSSNLFLYTQGQPRVGDPAFANYVVSTGIPYRRTVNERDIVPHLPPAAFGFLHAGEEYWITDNSPETVQVCTSDLETSDCSNSIVPFTSVLDHLSYFGINTGLCT

SEQ ID NO: 24828 - protein, 239 aa, Vibrio lentus
NLIVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAGVALT

SEQ ID NO: 24829 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLTSETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 24830 - protein, 428 aa, Arabidopsis thaliana
  misc_feature (350)..(350): Xaa can be any naturally occurring amino acid
MGKVPSSFRSMPANLLVRKTTPSPPAPPRDFRNRTAVGGDSAKLPQNTQAPREPSLRNPFKSPNLSDAKSLFNSIAATSRIPLDLKFHNSVLQSYGSIAVVNDTVKLFQHILKSQPNFRPGRSTFLILLSHACRAPDSSISNVHRVLNLMVNNGLEPDQVTTDIAVRSLCETGRVDEAKDLMKELTEKHSPPDTYTYNFLLKHLCKCKDLHVVYEFVDEMRDDFDVKPDLVSFTILIDNVCNSKNLREAMYLVSKLGNAGFKPDCFLYNTIMKGFCTLSKGSEAVGVYKKMKEEGVEPDQITYNTLIFGLSKAGRVEEARMYLKTMVDAGYEPDTATYTSLMNGMCRKGXMDKGMELYEMMKSSGVKLESNGYATLVRSLVKSGKVAEAYEVFDYAVDSKSLSDASAYSTLETTLKWLKKAKEQGLVP

SEQ ID NO: 24831 - protein, 319 aa, Aspergillus oryzae
MLSSSLRSLGRNGPSIASRAFSSSSSAYAAEVKSLGVIGAGQMGLGIALVAAQKAQVPVTLVDNSQASLDKGLKFADKLLDKDVSKERITREVADTVRSRITTSLKMDDLSSADFVIEAVPEIPDLKSSIFKQLAQIAPKHAILATNTSSISITKIAAATTTNPTDLQAPSRVISTHFMNPVPIQKGVEIISGLQTSQETIDTAIAFVQRMGKIASVSADSPGFLANRILMPYINEAIICLETGVGAREDIDNIMKNGTNVPMGPLTLADFIGLDTCLAIMNVLHQETGDSKYRPSGLLKRMVDAGWMGKKTGKGFYEY

SEQ ID NO: 24832 - protein, 228 aa, uncultured cyanobacterium
HEVVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTK

SEQ ID NO: 24833 - protein, 188 aa, Ehrlichia ruminantium str. Gardel
MFIMYYTKRLIMNLDNVTSGNNVPKEINVIIEISQNSYPVKYEFDKKKNLFCVDRFLPTSMYYPCNYGFIPHTCAGDGDPVDVLVASRFPITHGVLICARPVGVLVMHDEGGEDIKVLAVPVNKVDQYYSSIQNYTDFPVSFLNSISHFFTFYKKLEEDKFVSVEGWKDISAAETFISNALLTKQQTL

SEQ ID NO: 24834 - protein, 182 aa, Debaryomyces hansenii CBS767
MSSTNKEPAGSAPANPTDSINPANNQNNIVPRDVRLLHLIFATQGIQNYQDHVPLQLMDFAHRYTTSVLKDALIYNDHAKPLNSNTNINSSANSTVNTDDIRLAIAARTNYQFKPTPPKELLLELAHERNSKPLPPVIPKWGLNLPPEKYCLTARDWENLEDEFTEGEKETPEAANKKLRLR

SEQ ID NO: 24835 - protein, 414 aa, Chondrus crispus
MAFVAPVATVRATTKSSVCQVQGRSSFAQFSGMKKVNQSSRLQPAQSGSAFGGYSDANDAFYTRVSGIVAATFGPTMKVRVAINGFGRIGRNFIRCWAGRSDSNMEVVCINDTSGVKTASHLLKYDSILGTFDADVSAGEDTISVNGKTIKIVSNRNPLQLPWKEMNIDIVVEATGVFVDAPGAGKHIEAGAKKVLITAPGKGDGIGTFVVGVNEKDYSHDKYDIVSNASCTTNCMAPFMKVLDDEFGVVRGMMTTTHSYTGDQRLLDAGHRDLRRARSAALNIVPTTTGAAKAVALVVPSLKGKLNGIALRVPTPNVSVCDVVMQVNKKTFKEEVNGALLKASEGAMKGIIKYSDEPLVSCDHRGTDESTIIDSSLTMVMGDDMIKVVAWYDNEWGYSQRVVDLGEVMARQWK

SEQ ID NO: 24836 - protein, 464 aa, Debaryomyces hansenii CBS767
MTSARERLAMLHSHIKDNSNIKVLAEFPVLVKSERQKYLNSNFQSVPGSSNSSNFASTVMRPMSKPIMSISSTTSNTSISQCSLPQDYVEVCNSTSKFIPPTTKSFSNLEFDDICAKVDKKLRLLLGSNNPSDSYILSGGESLGWEILGQNIVQSLEDDILCISTGAYSKQFAKHLLNYVESEDRNITVLEANIGCTVPLELIKNELTKRCYGIVALTHTDNSTGVVTNIKEVSQLIKQISPNTLIAVDAVYSAGVEEIDVENWGIDFTLSTYKNTVLTTEVLSYILLSSRVLSKIPKGIMNGSNSSNNYKMQLAYSNANFQLLNALDSSLWRLFGMDEQQDISIDISNKIKSGLLSRFADYKSAAEKLRKSLINEETGISAISQDWSNCSNGMTAMYLPKTSEISELLKTLCEECDISLVNGIHSRFASEYISIEHAGFRFSGNDIDVDKVVEIIKKGLTNSK

SEQ ID NO: 24837 - protein, 286 aa, Vibrio cholerae
FRAAQERNDIEIVGINDLIDVDYMAYMLKYDSTHGRFNGTVEVKDGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTD

SEQ ID NO: 24838 - protein, 336 aa, Leifsonia xyli subsp. xyli str. CTCB07
MSVKIGINGFGRIGRNYLRAALAKGSGVEIVAVNDLTDNKTLAHLLTYDSTTGPLDTTVHLDGDSIVVNGKPIKVLEERDPANLGWGDLGVDIVVESTGRFTKAADARKHLEAGAKKVIISAPASGEDGTFVLGVNEESYDPANHHIISNASCTTNCLAPLAKVFNDAFGIERGFMMTAHAYTADQNLQDGPHSDLRRARAAAVNIVPASTGAAKAIGLVLPDLQGKLSGSSYRVPVPVGSIVDLTLITGRDDLTVQEINAAYAAAAAEGRLAGILQYTEDPIVSSDIQGNAHSSIFDSELTNVSGNLVKVSSWYDNEWGYSNRLVDLTEYVAERL

SEQ ID NO: 24839 - protein, 403 aa, Leifsonia xyli subsp. xyli str. CTCB07
MALRTLDSLGSLAGKRVVVRCDLNVPLKDGKITDDGRVRASIPTLHALIAQGAKVAIVSHLGRPEGAPDAQYSLAPVAQRLSELLGKPVTFASDTVGAGAAEAVSGLEDGDVALLENLRFNPGETSKDEGEREAFAAELAAFGDAFVSDGFGVVHRKQASVYELAKALPSAAGALIATELDVLDRLTENPERPYTVLLGGSKVSDKLGVIGHLLPRVDSLLIGGGMLFTFLAALGHRVGSSLLEADQIGTVKGYLEQAKQLGVEIVLPRDVVVASRFGVDAEHLVRPVDRIEDTGWGTSGLGLDIGPETAEVFSERIRAARTVFWNGPMGVFELAPFAAGTKAVAQALTEVDGLGVVGGGDSAAAVHALGFSDDQFGHISTGGGASLEFLEGKRLPGLEVLGW

SEQ ID NO: 24840 - protein, 512 aa, Fusobacterium nucleatum subsp. nucleatum ATCC 25586
MKKGGIVILDFGSQYNQLIARRVREMGVYAEVVPFHEDVDKILAREPKGIILSGGPASVYAEGAPSLDIKLFQNNIPILGLCYGMQLITHLHGGKVARADKQEFGKAELELDDKNHILYKNIPNKTTVWMSHGDHVTEMAPDFKIIAHTDSSIAAIENSDKNIYAFQYHPEVTHSQHGFDMLKNFIFGIAKAEKNWSMENYIESTVKQIKERVGNKQVILGLSGGVDSSVAAALINKAIGRQLTCIFVDTGLLRKDEAKQVMEVYAKNFDMNIKCINAEERFLTKLAGVTDPETKRKIIGKEFVEVFNEEAKKIEGAEFLAQGTIYPDVIESVSVKGPSVTIKSHHNVGGLPEDLKFELLEPLRELFKDEVRKVGRELGIPDYMVDRHPFPGPGLGIRILGEVTKEKADILREADAIFIEELRKADLYNKVSQAFVVLLPVKSVGVMGDERTYEYTAVLRSANTIDFMTATWSHLPYEFLEKVSNRILNEVKGINRLTYDISSKPPATIEWE

SEQ ID NO: 24841 - protein, 267 aa, Leifsonia xyli subsp. xyli str. CTCB07
MNEAGTSSVRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 24842 - protein, 632 aa, Blastopirellula marina DSM 3645
MPPVTPDYYPLYLAGVLGLGIAAQWLAWRLHLPSILLLLAFGFFAQLAGDPDEIIGKELLFPIVSLSVAVILFEGGMSLKLTELREAGGVVLRLVTIGAAVCWGLVGLCAYFVMGFPIEMSALIGAIMVVTGPTVIAPLLNYIRPTRKIGSIAKWEGIVIDPIGAVLAVLVYEAVVVTGVNHVFAVAGLAIVKTLVVGLVLGAASAVTLIFLLRRFWIPDFLHNASILAAILVVFAVSNAVQPESGLLTVTVLGIVLANQKRIPVRHIFEFKENLRVLLISCLFIVLAARISPAEIAKVGWQGLMFLAILIVIVRPVSVFLSTIGSGLSWQQKVFLCFMAPRGIVAAAVSSVFAFEIVEEFVHRGADAATIAQAELLAPLTLLVIVGTVTFYGLTAAPVARLLGLASPNPQGLLIAGADRWVRELGKVIQDAGFQVLVVDTNYRNISAAKMAGLPAHCASILSDYVTEEINIGGIGRLLAITANDEVNALACQEFIHLFGRKEVYQLAAWDSGSGRRASVSEHLRGRVLFSEGVDFYVLARRFAAGAQIKKTSLTAEFTYADFLKRYGDSALVLFVIDEGKKLDVRTAESTSTPKPGQSLISLVDPVKPVAEEADTDEEDESPSETESPSSS

SEQ ID NO: 24843 - protein, 453 aa, Persea americana
MDNKGGILMERFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQEMRPALTDIVWAWQGDQQQQQESLVCSQGQSL

SEQ ID NO: 24844 - protein, 241 aa, Brassica napus
NNPEFVTDYREAKLFIIKSYSEDNVHKSIKYNVWASTPNGNKKLDAAYREAKEEKEACPVFLLFSVNASSQFCGVAEMIGPVDFEKSVDYWQQDKWNGQFPVKWHIIKDVPNSQFRHIILENNDNKPVTNSRDTQEVKLEQGIEMLKIFKNYDAETSILDDFGFYEEREKIIQERKARRQPNLPSAGGGENEHKPASAALQTEFIKNMSKSFAQVVRLDEGSKASPDATTTTVAVSSGQSN

SEQ ID NO: 24845 - protein, 301 aa, Sporisorium scitamineum
SFGRIGRIVFRNSVVHNTANVVAINDPFIDLEYMVYMLKYDSTHGVFNGDISTKDGKLIVNGKTIAVYAEKDPSNIPWGQAGAHYVVESTGVFTTIDKASAHIKGGAKKVVISAPSADAPMYVCGVNLDSYDPKAQIVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLEKGASYDEIKAEVKRASENELKGILGYTEDAVVSQDFIGNSHSSIFDAAAGISLNNNFVKL

SEQ ID NO: 24846 - protein, 301 aa, Ustilago maydis
SFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLEKGASYDEIKAEVKRASENELKGILGYTEDAVVSQDFIGNSHSSIFDAAAGISLNNNFVKL

SEQ ID NO: 24847 - protein, 301 aa, Ustilago hordei
SFGRIGRIVFRNSVVHDNAHVVAINDPFIDLDYMVYMLKYDSTHGVFKGDVSSKNGKLIVNGKEIAVFAEKDPASIPWGQSGAHYVVESTGVFTTIDKASAHIKGGAKKVVISAPSADAPMYVCGVNLDSYDPKAQIVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLEKGASYDEIKAEIKRASENELKGILGYTEDAVVSQDFVGNPYSSIFDAAAGISLNNNFVKL

SEQ ID NO: 24848 - protein, 259 aa, Vibrio angustum S14
MSQVPLVIKLGGAVLSCTETLEKLFSAINHYQANSQRPLMLVHGGGYLVDDLMAKLQLPTVKKQGLRVTPSDQIAVIAGALAGTANKLLQGQAIKSGVKAVGLSLADGGLCEVSQLDPELGSVGKAEPGNGVLITQIMTSGYMPIISSIGLDAQGELMNVNADQAAVAVAAAVDGELVLLSDVSGVLDGKGQLIEALTEAEAELLIEQAVITDGMIVKVRAAFDAAKALGRPIEVASWRYPEKLTALFDGQSIGTKFTL

SEQ ID NO: 24849 - protein, 449 aa, Bacillus anthracis str. Sterne
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 24850 - protein, 446 aa, Oryza sativa Japonica Group
MGGGQSRSPRDGSGHGRYGHSPSFQQQWGGGGGGGGGGGGGYPYGQDAHGGGYYGAPARAGGASKPRLDRRYSRIADDYHSVDQVTDALAQAGLESSNLIVGIDFTKSNEWLGKFSFHGRSLHHISNAPNPYEQAISIIGQTLSKFDEDNLIPCFGFGDATTHDQDVFCFYPDLRPCNGFSEALSRYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNIPSRAFDNFQFVNFSEIMNKNMPQSRKEAAFALSALMEIPQQYKATVELGILGRRSFKSPERVPLPPPGGSHDAYSYGSKSFSKPSTYPQSSTSSSSYPHYETAQSSSPAVPSSTYDNQVCPICLVNPKDMAFGCGHQTCCDCGQSLESCPICRSPISTRIKLY

SEQ ID NO: 24851 - protein, 645 aa, Pseudomonas syringae pv. tomato str. DC3000
MGQTRFATGRQLDLICLGRLGVDLYAQQVGARLEDVSSFAKYLGGSSANIAFGTARLGLRSAMLSRVGDDHMGRFLLESLAREGCDVSAVKRDPERLTAMVLLGLKDRETFPLVFYRENCADMALRAEDIDEQHIASSKALLITGTHFSTDQVFKASSQALDYAEKHNVKRVLDIDYRPVLWGLAGKADGETRFVADQKVSQHVQRILPRFDLIVGTEEEFLIAGGSTDLLGALRTVRELTAATLVVKLGPQGCTVIHGAIPARLEDGAIYPGVRVEVLNVLGAGDAFMSGFLSGWLTEASDERCCQLANACGGLVVSRHACAPAMPTPAELDYLFNSPEPITRPDQDVILQRLHQVSVPRKQWKQLFIFAFDHRGQLVELAQQAGRDLNSISQLKQLFVQAVERVEADLHQRGIEADVGLLADQRFGQDSLNTATGRGWWLARPVEVQGSRPLAFEHGRSIGSNLINWPQEQIVKCLVQYHPDDEPMLRLEQEAQIKALYDASKVSGHELLLEIIPPKDHPSAHPDVMLRALKRLYNLGIYPAWWKIEAQSTEVWQQLDELIQQRDPYCRGVVLLGLNAPVEELAAGFAQARDSHVCKGFAVGRTIFREPSRAWMAGEIDDATLVSQVQSTFSGLIESWRESRA

SEQ ID NO: 24852 - protein, 415 aa, Vibrio angustum S14
MTEDFRQQALDYHSLPTPGKIAVALTKPANTVEDLALAYSPGVAEPVREIAQDPDNVYKYTAKGNMVAVITNGTAILGLGNLGPLASKPVMEGKSLLFKRFAGIDSIDIEVKHRTIDEFVDTVANIADTFGGINLEDIKAPDCFEIEQRLIERCNVPVFHDDQHGTAIVTAAGMLNALELQGKAIDEAVIVCLGAGAAAIACMELLIKCGAQREKIYMLDRKGVIHTRRDDINEYKQLFANNTDKRTLEDVIAGADIFVGVSGPDLLPPDALALMAENPIVFACSNPDPEIKPELAHQVRNDLIMGTGRSDYPNQVNNVLCFPFIFRGALDVRASQINDEMKLAAVHAIRELAKEPVPQSVLEASGVSHLEFGREYIIPKPMDPRLLPRVAKAVAQAAIDSGVARIEMPMGYMEV

SEQ ID NO: 24853 - protein, 211 aa, Staphylococcus aureus
PSADMLFEPSFVNDIDVNENDVVHFCSVDLVDSPMRDTHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 24854 - protein, 476 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTKAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKSYRFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 24855 - protein, 318 aa, Ehrlichia ruminantium str. Gardel
MLISAGIHSTDLAKRISELTCIKLVKSYTSNFADQELNVEVEEIQSNKNKHIIIIHTIGFPVHDNLIELLLLIDALKRALSPNRITLIVPYCCYTRQDRVMYRNLNNINIVSALSAKVIANILNTINVNNMIFIDLHSNQLAGFFDTEITNLNPNSIFIDAIIEKFTMENLVIVSPDHGALNRTRTFAYTLAKQYNLKHEIQVAVIDKYRTKPGVSEVMNIIGNVENKECIIIDDIVDSGGTLCNAASALKNNGALQVNAYITHGVLSNNAIAKITNSQLNTLTITDSVNHCSINTPKIKVLSIDKFLSDYILHNLTN

SEQ ID NO: 24856 - protein, 385 aa, Zea mays
MVSDQEIASCVESVLRGSAGGPGEVSLTAVLQQAEATLGVDLSHKAGFIRDQMDLFFGPRLQPQPLTTPQLAPPPPQAVVAPADAVPQHQVLPQAPPSAQQMQPQPQQLAPLQPHLMFQTIHQLPAISPVPAVSAPPAMAFYPPPPLAFRYTTGLAGAATGGTVSFQQPAPGAGGTASPNAAPQVAGDNKESSSKRKRGGPGGLNKVCAISPELQTIVGETAMSRTQIVKQLWAYIRQNNLQDPDDKRKIICNDELRVVFETDTTDMFKMNKLLAKHITPLDPKSQLHEVKRMKAPTMSPQPGRPIDQPSIVISDALAKFIGTDGTFPQDDALKYLWDYIKANQLEDVINESILCDSKLQELFGCESIPMSGLSEMLGHHFIKKT

SEQ ID NO: 24857 - protein, 590 aa, Frankia sp. EAN1pec
MNAAGEAPSGPPSRRPFARNTTAALWERLRAVLPDSATVRSVRRAPARDLLAGVTVAVVALPLALGFGISSGMGTEAGLATAIVAGVLAAVFGGSDFQVSGPTGAMTVVLVPVVHARGVDGVLMAGLMAGVILVGLGLGRVGGLARLVPMPVVVGFTVGIAAVIALQQVPAALGVPTPEGEKVVTVAARALARFADEPRWTSVAVSAAVAVVVLLGARLRPSVPMSLPAVALATVAVELVHVDGVARVGALPAGLQAPSWGFLDPGMVPELLPAAAAIAALAGLESLLSATVADEMRASSDPGRGSNGAGGWRRHDPDRELFGQGVANLAVPLFGGMPATAAIARTAVNVRSGAASRLSAVIHAVVIAAVVAAAAGLVRYIPLAALAGVLVATAIRMVETDAVRALARAGRGELAVMVLTGAVTLVVDLVVAVAVGLALAGALALRQVAGTAWVEHLPSDDDSRPHGLGSGTGPAPVTVLRIDGPLSFTAAHRLLPTLEHVHDDSVVLIRMSRVSAVDATGAAALSVALTDLEARGVVPLLSGVRPEHHQTLGAYGITAESGDRRRMFPDAPSALAYARALIPAQPHGPS

SEQ ID NO: 24858 - protein, 736 aa, Mycobacterium leprae
MLRKHTSSVQCARIDADCREVFGDVLGEHAMTIRLCGSWSVGDIEANYMMYSRIAGHCCRPVFVTHRRLTLPKRWLGYPFGAPTLALPEYNNGMLEQIRRPADLQHLSQQQLRDLAAEIRELLVHKVAATGGHLGPNLGVVELTLALHRVFDSPHDPIIFDTGHQAYVHKMLTGRCQDFDSLRKKAGLSGYPSRAESEHDWVESSHASTALSYADGLAKAFELAGNRNRHVVAVVGDGALTGGMCWEALNNIAATPRPVVIVVNDNGRSYAPTIGGVADHLATLRLQPAYERLLEKGRDALHSLPLIGQIAYRFMHSVKAGIKDSLSPQLLFTDLGLKYVGPVDGHDEHAVEVALRKARGFGGPVIVHVVTRKGMGYPPAEADQAEQMHTCGVMDPTTGQPTKIAAPDWTAIFSDALIGYAMKRRDIVAITAAMPGPTGLTAFGQCFPDRLFDVGIAEQHAMTSAAGLAMGRMHPVVAIYSTFLNRAFDQIMMDVALHKLPVTMVIDRAGITGSDGPSHNGMWDLSMLGIVPGMRVAAPRDAIRLREELGEALDVDDGPTAIRFPKGDVCEDIPALKRRSGVDVLAVPATGLAQDVLLVGVGVFASMALAVAKRLHNQGIGVTVIDPRWVLPVCDGVLELAHTHKLIVTLEDNGVNGGVGAAVSTALRQVEIDTPCRDVGLPQEFYDHASRSEVLADLGLTDQDVARRITGWVVAFGHCGSGDDAGQYGPRSSQTM

SEQ ID NO: 24859 - protein, 453 aa, Persea americana
MDNKGGILMQRFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKSAKGETKSKELAPLDTDAAFASSDTGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSQGQSL

SEQ ID NO: 24860 - protein, 513 aa, Leifsonia xyli subsp. xyli str. CTCB07
MPPVDITPEFNPLRLPSDRRLNRIAGPSSLIIFGVTGDLSRKKLMPAVYDLANRGLLPPGFSFVGFARRDWEDQDFEKVVHDAVKQYARTPFDDDVWKQLTQGIRFVPGEFDDAEAFRRLKETVESLDEERGTMGNHAFYLSIPPKAFPLVTEQLRTSGLADQSGTGWRRVVIEKPFGSDLTTARELNHVVESVFPPDSVFRIDHYLGKETVQNILALRFANELYEPIWNANYVDHVQITMAEDIGVGGRAGYYDGIGAARDVIQNHLLQLLALTAMEEPISFDATDLRTEKEKVLAAVRLPEDLGKATARGQYSSGWQGGEKVVGFLEEDGMNPRSATETYAAIKLDIGTRRWAGVPFYLRAGKRLGRRVTEIAVVFKRAPQQLFAESQTSALGQNALVIRVQPNEGVTIRFGSKVPGAGMQVRDVSMDFGYGHAFTEASPEAYERLILDVLLGDPPLFPRHEEVELSWKILDPIEEFWATQGQPEQYRPGTWGPKSADELLARDGRVWRRP

SEQ ID NO: 24861 - protein, 453 aa, Persea americana
MDNKGGILMQRFELGRLLGQGTFAKVYHARNLKSSQSVAIKVIDKDKVLKVGMIDQIKREIATMRLASHPNVVQLYEVMATKTKIYFVLEYVKGGELFNKVAKGKLKEDVARKYFQRLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASTIISKLEDIAKRLRLKVKKKDEGILKLEGSKEGRKGVVSIDAEIFVVNPSFHLVEVKKSSGDTLEYQKLWNQDMRPALTDIVWAWQGDQQQQQESLVCSQGQSL

SEQ ID NO: 24862 - protein, 389 aa, Campylobacter jejuni RM1221
MLTKRSQVLEESITLAITALANELKAKGEDIISFSAGEPDFDTPQTIKNAAISAIEKGCGKYTAVAGIPEVLKAIQTKFKKDNNLDYETNEIITNVGAKHSLFECIECLVEKDDEVIIPSPYWVSYPEMVKFAGGKPVFIEGLEENGFKITAEQLKKAITAKTKVLMLNSPSNPVGSIYSKEELTQIAKVLEGTQITVLSDEMYEKLRYDGFDFVAFASVSEDALKRTVTINGLSKCGAMPGWRFGYMASKNKALISAVKRLQGQSTSNICSITQHAAIPALNGKCDKDIEKMRQAFEKRRNLALDMLKQIPNISVYKPEGAFYLFVNIQKIEKDSMKFCQKLLEQEKVAVVPGIGFGTDGYFRLSYATSDELIEKGLERIANFIKNYK

SEQ ID NO: 24863 - protein, 671 aa, Coccidioides immitis RS
MRSQSPLGKQELRPSHIPSLIHSRSNNDLYDPPRTPQHHGFTSPLHTPHGSPSKSRLPPGATDLPSIFDNAMKLAPSSPTKSVFNLSNLSPGKGQISGGENLTTFNESVIHKTASVQGSPTRRGNQENAPPGGSRLGKEPVPNSNHAALSRQEAYQNNKERRDRRNPAQTRGLTAEELEKLQLPGVKRLANVAQLLLLPSHTFSDFLDHYFDLLSYVHNRQTRQSQFKAAYPPPPLTSQVEYEAALQKYLGRERAHLRKRRTRLRHADFQILTQVGQGGYGQVYLAQKKDTREVCALKVMSKKLLFKLDEIRHILTERDILTAAKSEWLVKLLYAFQDEEKIYLAMEYVPGGDFRTLLNNASVLHNRHARFYIAEMIQCVDALHALGYIHRDLKPENFLIDSTGHVKLTDFGLAAGMLSPGKIESMRIKLEEVGKTSVPFGRPMGQRTAAERREGYRTLRQREVNYAKSIVGSPDYMAPEVLKGEEYDFTVDYWSLGCMLFEALAGYPPFAGATVDETWQNLKQWEQVLQEPVYDDPNYFLSRRTWDLITRLVASKERRFKNIREIHMHEYFIDVNFNRLRDMQPPFVPELDSETDAGYFDDFGSESDMAKYKEVHDKQRALEEMAERGEKMSKSLFVGFTFRHRKPAIGGDGRTSPRKAIPTDGSFGTIF

SEQ ID NO: 24864 - protein, 212 aa, Campylobacter jejuni RM1221
MNFWGIIKEDFSQPKAQDPAFNSCIELFFNYPGVWAVVNYRFAHFFYIRNFKRIARMISGISQFLTGVDLHPGAELGRRIFIDHANGVVIGQTAIIEDDVLIYQGVTLGGTSLEKGTKRHPTIKKGVIIGSGAKVLGNITIGENAKIGSNAVVVKDVGANLTAVGIPAYIIEERKNKNIRAIDANCDDKLEKLEKKILELENLILKQPESQK

SEQ ID NO: 24865 - protein, 439 aa, Schizosaccharomyces pombe
MAIQKVFARQIYALGGNPTVEVDLTTETGIHRAIVPSGASTGIWEALEMRDGDKTKWGGKGVLKAVGNVNNIIAPAVVKANLDVTDQKAADEFLLKLDGTENKSKLGANAILGVSMAICRAGAAQKKLPLWKYIAENFGTKGPYVLPVPSFNVLNGGSHAGGDLAFQEFMILPTGAPSFSEAMRWGAETYQTLKSIAKKRYGSSAGNVGDEGGIAPDLQTPQEALDLIVEAINKAGYEGKIKIGLDVTSSEFYVDGKYDLDIKAAKPKPENKLTYQQLTDLYVELSKKYPIVSIEDPFDQDDWSAWTHMKAETDFQIVGDDLTVTNVKRLRTAIDKKCANALLLKVNQIGSVTESLNVVRMSYEAGWGVMVSHRSGGTADTFISHLTVGIGAGQLKSGAPCRSERLAKYNELLRIEEELGSRGVYAGAHAGKYIKAAKF

SEQ ID NO: 24866 - protein, 247 aa, Oryza sativa Japonica Group
MEGEEEEVESLVGISNALESLERQLASLQDLQHQQRYERETILSQIDRSRGCLLNKLKEYKGQDCEVIHEAASFAGEKIEHDDGLMLPPYSNHVTNSFVLDDLYPPSYLAKLKCMHNGLGSGGTNQDVTKTNRLENRNGSMPNGNSQGGIRSFVGWLAKTAVMVVGAVSIMKAAGYEPVIGRHSIKLDMAGLFSKEATSGKDQATVQCPPGKVMVLEDGRAHCVVKERVEIPFDTNLASPNASYGLG

SEQ ID NO: 24867 - protein, 224 aa, Physcomitrella patens subsp. patens
MGGAVDNDSGFSNDGIAVSGVDSVADGGSSDVAAPVAEEEQFETKLYVGNLPWTCDSAQLAEICSDHGTVDVVEVIYDKISGRSRGFAFVTMATPEDAQAVINALDGTDMGGRPLKVNYPQSQKDKPRVERSERPRDDANKLFVGNLSWGCDEAALYSFFSEYGTVVDAKVVFDRDSGRSRGFGFVTMESAAAANAAIENLDGAELDGRRLRVNLAGEKPPTRY

SEQ ID NO: 24868 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 24869 - protein, 128 aa, Glycine max
MTGETVNPKAYPLADAQLSITILDLVQQAANYKQLKKGANEATKTLNRGISEFVVMAADTEPLEILLHLPLLAEDKNVPYVFVPSKQALGRACGVTRPVIACSVTTNEGSQLKSQIQQLKDAIEKLLI

SEQ ID NO: 24870 - protein, 110 aa, Oryza sativa Indica Group
MDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILYSP

SEQ ID NO: 24871 - protein, 324 aa, Bradyrhizobium japonicum USDA 110
MTHAIRFHKTGGPEVLVWEEVSVGKPGPGEARIRHTAVGLNFVDIYNRSGLYPAQLPSGLGSEAAGIVEEIGPGVTDLKPGDRVAYGASPLGAYSEARLIPADRLLKLPDGVDDKTAAAMMLKGLTTQYLIRQTYRVKAGDTILLHAAAGGVGLILSQWAKHLGATVIGTVSNDEKAKLAKAHGCDHVIIYTREDFVKRVDEITGGKKVPVVYDSVGKDTFLKSLDCLAPLGVAALFGQSSGAVEPLNLGLLAQKGSLYVTRPTLFTYAAKRESLVAMAGELFDVVKSGAVKIEVHQTYPLKDAAKAHADLAARKTTGSTVLLV

SEQ ID NO: 24872 - protein, 342 aa, Mycobacterium smegmatis str. MC2 155
MEHIRTGELHEWMIGGVHAIEVAETGGPEVLNYIERPEPSPGPGEVLIKADAIGVNFIDTYFRSGLYPRELPFVVGTEVCGTVAAIGNDVAALKVGDRVVTANAVGAYADYCVAPADFVAYVPDGVAPEAVASALLKGMTAHYLLKSTYPVQPSDTVLVHAGAGGVGLILTQWATSLGTRVITTASTPEKAELSRQAGAVEVLDYPDPDDPQPFASRVRELTGGAGVAAVYDGVGATTFDASLASLAVRGTLALFGASSGPVPPFDPQRLNAAGSVFLTRPTLAHHTRTADEFSWRAGELINAIADGSIKITVGGTYPLAEASRAHTDLQGRKTVGSIVLIP

SEQ ID NO: 24873 - protein, 495 aa, Artemisia annua
MKSILKAMALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 24874 - protein, 485 aa, Chlamydomonas reinhardtii
MLGSSTSQLAPAMVRSIASSAAASTAAPVLAAKSGGLLASVFGMGGGRVEVPLSEKLPAVTEPPRTSTPATKPIVQTSSLRSGVKVASINTVSPISSLVLFVEGGAAAETPATAGASKVLEVAAFKATANRSTFRLTRELEKIGATSFARAGRDHVAFGVDATRLNQLEALEILADAVVNARYTYWEVRDSLDAVKEQLAAQLRNPLTAVNEVLHRTAFEGGLGHSLVVDPSVVDGFTNETLKEYVHSIMAPSRVVLAASGVDHAELTALATPLLNLHGNAHPAPQSRYVGGAMNIIAPTSSLTYVGLAFEAKGGAGDIKSSAAASVVKALLDEARPTMPYQRKEHEVFTSVNPFAFAYKGTGLVGVVASGAPGKAGKVVDALTAKVQSLAKGVTDVQLATAKNMALGELRASVATAPGLAAAVGSSVLATGKFSANEVAAALSGLTAADVTSYVNAMIKTAPTFVTYGNLSSLPRVDSIAKRFA

SEQ ID NO: 24875 - protein, 140 aa, Triticum aestivum
  misc_feature (54)..(54): Xaa can be any naturally occurring amino acid
  misc_feature (62)..(62): Xaa can be any naturally occurring amino acid
  misc_feature (75)..(75): Xaa can be any naturally occurring amino acid
  misc_feature (102)..(102): Xaa can be any naturally occurring amino acid
  misc_feature (110)..(110): Xaa can be any naturally occurring amino acid
  misc_feature (132)..(132): Xaa can be any naturally occurring amino acid
  misc_feature (136)..(136): Xaa can be any naturally occurring amino acid
MGRKFFVGGNWKCNGTVEQVESIVNTLNAGQIASTDVVEVVVSPPYVFLPTVKXAKLRPRDXKVAAQNCWVKKGXGAFTGEVSAEMLVKPPAFPGSILGHSXKRAGAFDXGETNEFVGEKGAYALAQGLEGXLQCXGEDS

SEQ ID NO: 24876 - protein, 161 aa, Porphyra tenera
MTSTVCPPAASFFGFMGAASALIFSNLGAAYGTAKSGVGVASMGVMRPELVMRCIIPVVMAGVLGIYGLIVAVIVSGQVVEENYPYFLGFAHLASGLSNGLSGLAAGICIGIVGDAGVRATGQNPKLYVIMILILIFAEALALYGLIVALILSGKTTTAGC

SEQ ID NO: 24877 - protein, 447 aa, Salmonella enterica subsp. enterica serovar Paratyphi A str.
MKKVKKLSLTDLVLYGLVFMVPIAPVSLYGVVYNLSHGMVALVYIIGAIAMFFTAYSYSTLSQHISSSGSAYAYAGVCINPAVGFLTGWILLLDYLLFPTLVAVLGGVAVHAILPQIPVWVWPLIYVAIGTGVNYLGIQQTAKFDKLLVFIQLGILAIFVLLIVRLMMQDSSQITLSFRPFFDSQWFTPGLIATAISVAALNFLGFDAISTLSEESEGGGRAVSKATLLALVLATVLFIIVVAFAAFATGNVDRFAEGNATNEAFFTIAGNVGGIWLKVAFSIIVAFVCAVGNIITAQTAVSRVLFSMGRDRMLPAFLAHVHTTRKTPNYAILFTGGVTLLLSYLFSGKIESISTLVNFGALFAFFVVNLCVFILFNFRMKAQRRIFAHVISPIMGMIVIGYVCLNMNIHALILGISWAAIGIAILCYRKAHNQNIAIDLEGKKLLD

SEQ ID NO: 24878 - protein, 470 aa, Salmonella enterica subsp. enterica serovar Paratyphi A str.
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGSVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 24879 - protein, 721 aa, Pseudomonas syringae pv. tomato str. DC3000
MIYEGKAITVKALESGIVELNFDLKGESVNKFNRLTLNELRQAVDAVKADASVKGVIVTSGKDVFIVGADITEFVDNFKLPEAELVAGNLEANRIFSDFEDLGVPTVVAINGIALGGGLEMCLAADYRVISSSARVGLPEVKLGLYPGFGGTVRLPRIIGADNAIEWIASGKENSAEDALKVGVVDAIVAPEKLQAAALDLIQRAISGEFDYKAKRQPKLDKLKLNAIEQMMAFETAKGFVAGQAGPNYPAPVEAIKTIQKAAIFGRDKALEIEAAGFVKMAKTSAAQSLIGLFLNDQELKKKAKGYDEVARDVKQAAVLGAGIMGGGIAYQSAVKGTPILMKDIREEAIQLGLNEASKLLGGRLEKGRLTAAKMAEALNAIRPTLSYGDFGNVDLVVEAVVENPKVKQAVLAEVEANVGENTILASNTSTISISLLAQALKRPENFVGMHFFNPVHMMPLVEVIRGEKSSEEAVATTVAYAKKMGKNPIVVNDCPGFLVNRVLFPYFGGFARLVSAGVDFVRIDKVMEKFGWPMGPAYLMDVVGIDTGHHGRDVMAEGFPDRMKDDRRSAVDALYEANRLGQKNGKGFYVYETDKKGKPKKVNDPAVLDVLKPIVYEQREVSDEDIINWMMIPLCLETVRCLEDGIVETAAEADMGLIYGIGFPPFRGGALRYIDSIGVAEFVALADRYAELGALYQPTAKLREMAANGQSFFGQASSEV

SEQ ID NO: 24880 - protein, 404 aa, Methanopyrus kandleri AV19
MEDLVCVGITHKEAEVEELEKARFESDEAVRDIVESFGLSGCVLLQTCNRVEVYASGARDRAEELGDLIHDDAWVKRGSEAVRHLFRVACGLESMMVGEQEILRQVKKAYDRAARLGTLDEALKIVFRRAINLGKRAREETRISEGAVSIGSAAVELAERELGSLHDKTVLVVGAGEMGKTVAKSLVDRGVRAVLVANRTYERAVELARDLGGEAVRFDELVDHLARSDVVVSATAAPHPVIHVDDVREALRKRDRRSPILIIDIANPRDVEEGVENIEDVEVRTIDDLRVIARENLERRRKEIPKVEKLIEEELSTVEEELEKLKERRLVADVAKSLHEIKDRELERALRRLKTGDPENVLQDFAEAYTKRLINVLTSAIMELPDEYRRAACRALRRASELNG

SEQ ID NO: 24881 - protein, 338 aa, Arabidopsis thaliana
  misc_feature (256)..(256): Xaa can be any naturally occurring amino acid
MVFKAAIELGVIDTLYLAARDDVTGSSSFLTPSDIAIRLPTKPSNPEAPALLDRILRLLASYSMVKCQIIDGNRVYKAEPICRYFLKDNVDEELGTLASQLIVTLDTVFLNTWGELKNVVLEGGVAFGRANGGLKLFDYISKDERLSKLFNRTGFSVAVLKKILQVYSGFEGVNVLVDVGGGVGDTLGFVTSKYPNIKGINFDLTCALTQAPSYPNVEHVAGDMFVDVPKGDAILLKRILHDWTDEDCEKILKNCXKALPENGKVIVMEVVTPDEADNRDVISNIAFDMDLLMLTQLSGGKERSRAEYVAMAANSGFPRCNFVCSAYHLWVIELTKQA

SEQ ID NO: 24882 - protein, 653 aa, Xanthomonas campestris pv. campestris str. ATCC 33913
MSYLVLARKWRPKRFAELVGQEHVVRALSNALDSGRVHHAFLFTGTRGVGKTTIARIFAKSLNCETGTSADPCGTCPACLDIDAGRYIDLLEIDAASNTGVDDVREVIENAQYMPSRGKFKVYLIDEVHMLSKAAFNALLKTLEEPPEHVKFLLATTDPQKLPVTVLSRCLQFNLKRLDEDQIQGQMTRILAAEEIESDPSAIVQLSKAADGSLRDGLSLLDQAIAYAGGALREDVVRTMLGTVDRTQVGAMLQALSDGDGAQLLKVVAALAEFSPDWSGVLEALAEALHRIQVQQLVPSVAFVGDGIDPTGFAAQLRPEVVQLWYQMALNGRRDLYLAPSPRAGFEMAVLRMLAFRPAAAVPAGSGDDGRGASAGGHTRGTATGVQAAPAAAAPARAATSAKAADVSPAPVVSAPPVAAAPSPVVVLPTAAAEPAPSAPPARTDDTPPWAVDDAPVRAQAAPQRATAEVPAAVPLMAPEAAMALPATVADDAAPAAMDAVVPVAPPSAPAPVTPPAATFDDGHIADAEQWLELVTRSGLNGPSRQLAANAAFIGHRDGVLRLALAPGFEYLNSERSIANLAQALAPELGNTPRIVIETGSADVETLHERANRQKGERQSAAETAFMNDPNVQQLIQQQGARVVPDSIRPYDE

SEQ ID NO: 24883 - protein, 532 aa, Leifsonia xyli subsp. xyli str. CTCB07
MLSVQGLELRVGARLLMEDVSFRVAAGDKIGLVGRNGAGKTTLTKVLAGDLLPTAGSVDRSGELGYLPQDPRSGNLDDLARTRILDARGLGSIVLGMQQATLDMASDDAAVFAAAMKTYGRLEERFHMLGGYAAEAEAASIASNLNLPDRILDQPLKTLSGGQRRRIELARILFSDARTMILDEPTNHLDADSIVWLREFLKGYSGGFIVISHDVDLVGETVNRVFYLDANRQVIDIYNMGWKNYQRQRAADEERRKKERANAEKKAGALQSQAARFGAKATKAAAAHQMVARAEKLLAGLDEVRQADRVAKLRFPTPAPCGKTPLQASDLSKSYGSLEIFTAVDLAIDRGSKVVVLGLNGAGKTTLLRMLAGVDKPDTGAIEPGHGLRIGYYAQEHETIDVERSVLQNMVSSSPALTETEARKVLGSFLFTGADAHKQAGVLSGGEKTRLALAMIVVSGANVLLLDEPTNNLDPASRDEILDALAHYEGAVILVSHDEGAVEALNPERVLILPDGVEDHWNRDYLELISLA

SEQ ID NO: 24884 - protein, 477 aa, Physcomitrella patens subsp. patens
MSPKKGRNENIREEARRQGAGSSPTTFSAKYVPFTPGVKSDEEYSLDEVIYRSKTGALLDVQHDMEALKKAGDGAYWRKLFDSRVGKTTWPYGSGVWSKKEWVLPEIDDDDIVSVFEGNSNLFWAERFGKEVMDMTDLWVKHCGISHTGSFKDLGMTVLVSQVNRLRRLGKPLLGVGCASTGDTSAALSAYCAAAGIPAIVFLPANKISIAQLVQPIANGALVLSMDTDFDGCMRLIREVTSELPIYLANSLNSLRLEGQKTAAIEILQQFDWEVPDWVIVPGGNLGNIYAFYKGFYMCKELGLVDRMPRLICAQAHNANPLYRAYKDGWENFKPVKALPTFASAIQIGDPVSIDRAIYALTQCDGIVEEATEQEIMDVCAQADKSGMFTCPHTGVALVALEKLRSRGVIGPNDRTVVVSTAHGLKFTQSKVEYHSSELPDIVSQFANPPVSVADDFGSIMDVLRQKLSLNNLKGSM

SEQ ID NO: 24885 - protein, 413 aa, Escherichia coli CFT073
MRHDRCIKPRSTMNVFNPAQFRAQFPALQDAGVYLDSAATALKPEAVVEATRQFYSLSAGNVHRSQFAEAQRLTARYEAAREKVAQLLNASDDKNIVWTRGTTESINMVAQCYARPRLQPGDEIIVSVAEHHANLVPWLMVAQQTGAKVVKLPLNAQRLPNVDLLPELITPRSRILALCQMSNVTGGCPDLARAITFAHSAGMVVMVDGAQGAVHFPADVQQLDIDFYAFSGHKLYGPTGIGVLYGKPELLEAMSPWLGGGKMVHEVSFEGFTTQSAPWKLEAGTPNVAGVIGLSAALEWLTDYDINQAESWSRSLATLAEEALAKRPGFRSFRCQDSSLLAFDFAGVHHSDMVTLLAEYGIALRAGQHCAQPLLAELGVTGTLRASFAPYNTKSDVDALVNAVDRALELLVD

SEQ ID NO: 24886 - protein, 256 aa, Thermococcus kodakarensis KOD1
MEFNWSEIALNTAKELEEKIMPLFGTKKAGENVGTNVSGDVTKYVDKVAEDIILKRLVPLGVNVVSEEVGTVDSGSDYTVVVDPLDGSYNFSAGIPIFAFSLGIFKGKKPVYGAIYEFLPENFYEAKPGKGAYLNGERIRVNEPEPGKEALSFYTRGRCLGLVKKVKRVRVLGAIAVELAYVARGSLDGVFDIRNYVRPTDVAAGVLLVREAGGIVTDERGREFEVKLSATEKTNIIAVANERLLNTILEAMKDEP

SEQ ID NO: 24887 - protein, 221 aa, Guillardia theta
MRKTLVLASVAAASAYVSSPVGLAGGRTSNKPAISSSTFTPRLRSAAPIHGVEVARAGRMASSITMSAKKKSVKDLTPAELKGKKVLIRCDLNVPLDGKKITDDTRIRASVPTIKYLLDNGARVAISSHLGRPKNGPEDKFSLSPCATRLSELLGKDVKMAKDCIGPEVKSLVDGLKDGEACVLENVRFYKEEEKNEKSFSEKLAAPLTCMSTMPSVPRTG

SEQ ID NO: 24888 - protein, 586 aa, Prochlorococcus marinus subsp. pastoris str. CCMP1986
MALLIKKFGGTSVEDITKIKAIAQSIIQSKEAGNDIVVVVSAMGHSTDHLNKLAESISKNPNSRELDMLLSTGEQVTMALLSMSLNEYGIPAISLTGSQVGIVTESIHGKARILDIKTERIQNYINQGYVVVVAGFQGSTLSHTGSMEITTLGRGGSDTSAVALSTALGAETCEIYTDVPGVLTTDPRIVPNAKLLDIISCEEMLELASVGASVLHPRAVEIARNYGIKLYVKSSQALSNGTLLHSKIKPLALKRGGLELTKTVNSLEVLEKQTVFSISKLPDRPGIAAQIFETLSKANINVDLIIQATHDGKSNDIAFTVNDFELTKTIDQCKLITKQLGGEYDFKKNMTKLSIQGAGIMGRPSVSADLFDTLFQANINVRLIATSEIKVSCVIDIENISKAIRFVSEKFKLSDKQIFINPVIESEDQPEVRGIALDKNQVQVSIRNLPDKPGVAASICLALAENNLIFDTIVQSERLTSLKTKDISFTMSKQDRERANTIFHSLTKKLAGSFIEDGPAIAKVSTVGAGMAFKVGTAGKIFRALANKNINIEMIATSEIRTSCIVLEQDCDQAVNAIHSYFQLDK

SEQ ID NO: 24889 - protein, 245 aa, Oryza sativa Indica Group
MLCGTASFKHVVDDDDPAARGTGGGSPRQPRRKHGGGGGGKINPYAERGLDKFSTVLSELEARRDKILRRVGSGGGLVMVRFVQSNGALEPIIVKLPDEQRRPKDDAAAKKPRPSSPSTAAAQQQGAAAARATRSPPPAPAASRASSFSWGRMRRPACYWPAVMVLMLVCLAVFGRVFAICCTSIWWYLAPTLLSNGGAGGEDAARRPLGSPRKSPPPASGKKLAGRRGTREVGSSPRGHTKKGT

SEQ ID NO: 24890 - protein, 268 aa, Escherichia coli CFT073
MSVVISDAWRQRFGGTARLYGEKALQLFADAHICVVGIGGVGSWAAEALARTGIGAITLIDMDDVCVTNTNRQIHALRDNVGLAKAEVMAERIRQINPECRVMVVDDFVTPDNVAQYMNAGYSYVIDAIDSVRPKAALIAYCRRNKIPLVTTGGAGGQIDPTQIQVTDLAKTIQDPLAAKLRERLKSDFGVVKNSKGKLGVDCVFSTEALVYPQSDGTVCAMKATAEGPKRMDCASGFGAATMVTATFGFVAVSHALKKMMAKAARQG

SEQ ID NO: 24891 - protein, 451 aa, Thermosynechococcus elongatus BP-1
MLVQPSQPQRWLRGLKETLLFGQEPSGELLAILLVYFVQGVLGLARLAISFFFKDELGLSPAEVAALMGVAALPWVIKPVFGLVSDSLPLLGFRRRSYLVLSGLLGCGAWLSLGTWVATPWQATAAILGASIAIALSDVIVDSLVVERARQESATEMGTLQSLSWAATAVGGILTAYFSGQLLQWFSPRTVFQITAVFPLLVSAVAGAIAEERVMARPQLSQTWEHINHVRQAMMQKRIWLPVAFLFLWQATPGSESAFFFFTTNELGFEAEFLGRVRLVTSIASLLGVWIFQRYLKTLPLRTIFFWSTILSAFLGLSSLILVTHLNRQWGISDQWFSLGDSLILAVMGQIAFMPVLVLAARLCPPGIEATLFALLMSISNLANLVSHELGALLTHWLGITEHNFDRLWLLVLMTNLSTLLPLPLLNWLPQQLPAPASQSAVTVELEPSVS

SEQ ID NO: 24892 - protein, 887 aa, Oryza sativa Indica Group
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESQSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 24893 - protein, 583 aa, Fusobacterium nucleatum subsp. nucleatum ATCC 25586
MYLEKINSPEDVKKLNIEEMKVLAQEIREAIIKRDAIHGGHFGPNLGIVEATIALHYVFESPKDKFVFDVSHQTYPHKILTGRREAFTDEAHYDDVTGYSNQNESEHDHFILGHTSTSISLALGLAKARDVKGETGNVGAIVGDGSLSGGEALEGLDFAGGELKSNFIIVVNDNEMSIAENHGGLYKNLKLLRETEGKAECNLFKAIGLEYIFIKDGNNLEELIETLKKVKDINHPIVVHIYTQKGKGYKLAEEDKESWHYTMPFNIENGKPLNEDIEDYCNITKEYLIKKMKEDKTVVTITAGTPGDFGFSKKERDELGSQFVDVGIAEQTAVAMSSGMASKGAKPVFTVVSSFIQRTYDQLSQDLCINNNPATIVVFYGGAIGMTDVTHLGWFDIAMMSNIPNLVYLAPTTKEEHLAMLEWSIGQQEHPVAIRIPGGKVVSNGKKVTKDFSKLNTYEVNQKGEKVAIIGLGTFYQLGEKAAKLYEEKIGVKVTVINPMYITGVDEKLLEELKKDHSIVITLEDGVLDGGFGEKIARFYGNSDMKVLNYGLKKEFLDRYNIGKVLTKNRLKADLIVEDLLKF

SEQ ID NO: 24894 - protein, 164 aa, Escherichia coli
AAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYK

SEQ ID NO: 24895 - protein, 476 aa, Thermosynechococcus elongatus BP-1
MDCIPVILSGGVGSRLWPLSRQAHPKQFIRLTPEGKSLLQQTWQRVQGLPQLQPPLVVANEAHRFLVAEQFQELGVTPTRILLEPVGRNTAPAITVAALYVTEVLASDALLLVLPADHFIQDVAHFQWGLQRGFSAAAKDWLVTFGIAPTSPHTGYGYIRRGESLSDPDTYRVAEFVEKPDLATAEAYLAAGNYLWNSGMFLFRAQSFLAELAQQQPQILDYCRLALRQGREDLDFIRLGKEAFDQCPNLSVDYGLMEKTQKAAVVPLDCGWSDVGSWSSLWEILPKDEWGNSCRGDVLVYNSKDCFAQSQHRLVALVGVDNLMVVETADAILIAHREAAQQVKQVVEQLQARNRSEAYNHRLVYRPWGYYDAIDAGHRFQVKRITVKPGASLSLQQHHHRAEHWIVVSGTAEVTCNGKTFLLTENESTYIPVGAVHRLANPGKIPLEMIEVQSGSYLGEDDIVRFEDCYGRKTEE

SEQ ID NO: 24896 - protein, 147 aa, Picea sitchensis
MSTNGLPSSLPVSPASASAPASTSTTKKSKKPDPAELLALYEAKGLNPTEASHQAIHDLQGVISNLLYSRARSSERDRSSQQGFSSKIDYISTRVSLLEMKVDSKPGMAQTLALGVSASALVQATPHVFRAVCNIWSSFRNSSKGNP

SEQ ID NO: 24897 - protein, 307 aa, Thermosynechococcus elongatus BP-1
MISADPPQVHPAGTFDLKAYLKERQALVEAALEASIPVAYPEKIYDAMRYSLMAGGKRLRPILCLATCELMGGTVEMAMPTACALEMIHTMSLIHDDLPAMDNDDYRRGKPTNHKVYGEDIAILAGDGLLAYAFEYVVEQTKNVPAEYLLKIVARLGHAVAATGLVGGQVVDLECEGQPDIGLETLHFIHSHKTGALLEASVVSGALLTGAHESDVARLSRYAANIGLAFQIVDDILDITSTRDVLGKTVGKDVAAQKMTYPRLWGLEKSRQEAERLVAEAKAELAVYGAAAVPLQAIADYITSRSH

SEQ ID NO: 24898 - protein, 1012 aa, Cryptococcus neoformans var. neoformans JEC21
MQGTPNTMDYNDLDSANGRGLPTGGLTWSNEGPVLQMEDAVVETVVTHTTRTTTSFQPITLPRVPSPEHLKLPNHLPGEKYPLADQPAPSDMRLFTMTLGGRRVIVQDENASGESGIEMSGPGWTRTLLNGSMTEAENGVDVADESLTFLQALNRSKGKEKKREYEERSDAPASPVANDISARRSPPRKKIRGLDEINIPTGVNRALLSPLPSPEHESMSLSSIAPTAQAPNMGSGVELSALFSLPSLVSHFDTLPDRLQQHFLMHLLRRSRMPTLQRISNFVSTALRRDFITQLPHEVAIQILKSVDGKSLASASRVCKKWKRIIDMERSVWKARLLDDKLWSGFGTEEQEESLVLERYEALDLHDQLEGRRTSYQAVSGEDEQMFSPTLGHDLPERPTPLKHVYRRRYQDQKNWIHTRPEHSSFTGQGTNVVTCLQFDEDKIVSASDDHSINIYNTNDGQLRKRLDGHEGGVWTLQYKGHTLVSGSTDRTVRIWDLEDLRMTYVFAGHTSTVRCLQIVEPVWEEETQSYQPPVPMIVTGSRDATLRVWKLPQKDDPLYDGIVEEEQTELIGPDVNPFHMHLLEGHSLAVRAIATHGRICVSGSYDMSVRVWDIVKGTSLHVLTGHEDKGKNHTLDKSITEVDKALVYSIVYDPYRKRCASGSLDSTVKVWDIVSGQCLHTLQGHTSLVGLLGLSPNYLVSAAADSSLRIWDPNTCQLKNVLASHSGAITCFQHDETKVISGSDGTLKLWDVKTGTFVRDLVVGISAVWQVSFNKNLLVAASNRNGATVFDVFRFGQSSTQDVDDPSLDNLQPPRWERWAAEKRRRLEMEEKKKRKSRSRKARTESAWDDRLEKVRDPRMASWKTTLPYAPTGHLGYSVEGEEPDERVGLQPPPAFGFRTGSHAGSSKGNSPYQLSSAQSGSNNVVRRSLHDLSGSPTPTGVARRRAGLMISKVPRAEGSNGASAALPPGSVVGPLDIGESSASTAVVEDNYQDDEGEEDEEMENADEHSY

SEQ ID NO: 24899 - protein, 866 aa, Oryza sativa Japonica Group
MGVKEEEEEEEREKGIGEVQATNALGAGGGVLESCSGEELRTWHASPPTYACDVKQYYNPRCLIPAVSLLLLVVILTVSNTYFPFPTTKSRTLSYSSFSSSHGGQKAADEACNIFRGEWVPDPDAPYYTNDTCSVIHEHYDCMKYGKPDLGFVQWRWHPDSCDLPRLDPARFLSSMRGKTLAFIGDSLARNHMNSLICLLTRVAEPTTSWPSSEHTVYHYGGGYNFTVLSFWAPFLVRNELIDTDRPAHTGLWNLYLDEPDAVWASHVPAFDYAVVSASSWFYRPSMLYEAGRLVGCHHCLLPNVTDLTLRYALRMATRAALRAVVGGGGGVTAVLRTVSPSQYEGGEWNKDGNCVRTRPYRRGEKTLQGVELDFHTLQVEEFEAAKRAVTASGGSGGAVRMMLMDTTEAMIVRADAHPSRYRGWTRRKGWMKEYFTISNDCVHWSMMKFHEVIKLPSIAHYGLRYVLPAAAVAACVLVLAAVSLPGRVPLPPLLAPEVTKNTADGVGGDRSGCDIFKGEWVPDMSGEPPPYTGESCPVIHGHYDCMRYGRPDLGYVRWRWRPDGGCEMRRFDAARFLAAMRGRSVAFVGDSLARNQMHSLVCLLSRAERPAPWTNGSYAYRFERHGLTVAAFWSPFLVRAVETDPDGPTGSGAGLWSLHLDEPDAGWAAHVGAFDHVVVSAGSWFYRPSMFYDRRGRLVGCNTCLSPNVTDLTLRYSLRMAFRSALRAAATGGARRRGGRAARRTVIVRTISPSHYENGTWNGHGDCVRTRPARRGEWELNAMEKDMHRIQVEEFAAAARKRGKGAARMMLMDATEAMAQRPDAHPSKYRLWQPDKFKVSRDCVHWCLPGAMDACNDMLFHMLIG

SEQ ID NO: 24900 - protein, 678 aa, Oryza sativa
MAIHGVFHCSTTAILRVISVLCLLAVLVPDAGGRHHRHGCPPFTCGNLSSVSSPFRRRGDPSECGVLSYELNCADDKATIQIDNGTYYVTGINYTDSTFLIVDADISDSPSSCPLPRWNSLREPRFQVLWTRIASFVNCSQEIKNSSWIMYMPVACLSTSRSFVYVLTGQKSALIQSLEPSCGYLAMTPLGGRDSVAPVNESLSLSYADVVKSMRKGFRVQFPFRYRTGSFKQCPMDSIPASTSTGKTNWFGTILSADTNFLLCIPVHQIPSRYRMPLGIMLYVIAYALQIWKMIAATCRFLLTPLAVLVFLAHKYWKTRVTIDAVEKFLRMQQMLGPTRYAYTDITAITGHFREKLGQGGYGSVYKGVLLPGDLHVAVKMLNGNSNCNGEEFISEVATIGMIHHVNVVRLVGFCSEEMRRALVYEHMPRGSLDKYIYLSERSFSWDKINEIALGIARGINYLHQGCDMWILHFDIKPHNILLDDNFVPKVADFGLAKLYPRDKSFVPDRALRGTVGYMAPEMVSRSFGVISSKSDVYSFGMLLLEMAGGRRNVDPNADSSKSKAYYPSWVYDQLIADQQFDEISNVANMHELERKLCLVGLWCIQMKSHDRPTMSEAIEMLEGGVDALQVPPRPFFCDGDGIGNGMPPPQVMDSYFHSSKLTAISEEGDGIAKLASS

SEQ ID NO: 24901 - protein, 373 aa, Cryptococcus neoformans var. neoformans JEC21
MTQLKRVLVTGGLGYIGSHVVVSLLLTGKYQPIVIDNCHNSYPEALNRCAEIARDELGADAPQPILHDLDLRDAPAIEQVFEQYAADGGIWAVIHLAALKAVGESADFPLSYYRVNVAGSISLFETMAKYSCNNLVFSSSATVYGTPATIPIPETSPLIPESCYGRTKAMVEEIIHDLTKVGAEEGKPSLRAVSVRYFNPAGAHPSGKLGEEPRGKPGNLLPLLAQMAVGREKSQLKVFGTDFPTPDGTCVRDYLHIMDLAHGHVLALDALTVPSSQHNIFSEIDPKDGYFRAFNLGRGQGMSVLNMIEAMRKATGFDYQYEIVGRRKGDVPDLTADPSLARKELGFVAKEDLESMCRDLWNFQTRHPNGYSS

SEQ ID NO: 24902 - protein, 333 aa, Triticum aestivum
RPRVRVRISIADESGREKCPPSFYYMPTNAVSQNALVSMFLAKIGSEDCCPECFDNCLSSPAPCACARETGGEYAYTLDGLVRPAFIDECVSMNRFPEEHHRVYCKTCPLERSRNKASPEPCRGHLVRKFIKECWSKCGCNMQCGNRVVQRGIRCNLQVFFTEEGRGWGLRTLDDLPKGTFVCEYAGEILTHTELHERAIQNMQNARYTHPILLDAGWCSGGEPKDEEALCLDGTFYGNVGRFINHRCCDANLAMIPIEVETPDHQYYHVAFFTSKKVEAFEELTWDYGIDFDDERQPVKAFECLCGSRYCRGGRRHLLRKERRRSRVTGTAG

SEQ ID NO: 24903 - protein, 256 aa, Vibrio angustum S14
MRHPVVMGNWKLNGSKEMVSGLIKGLDAALNGVEGVDVAIAPPVMYLDLAEQLLSKANSKIILGSQNVDLHNNGAFTGDISPAMLKEFGASHIIIGHSERREYHNESDEFVAQKFAFLKENGLTPVLCIGESEAQNEAGETVAVCARQLDAVINTQGVEALNGAIIAYEPIWAIGTGKAATADDAQRIHAAIRAHIAEKSEEVAKNVVIQYGGSVKPENAAAYFAQPDIDGALVGGAALVAESFAAIAKAAAEAKN

SEQ ID NO: 24904 - protein, 598 aa, Oryza sativa Japonica Group
MLRRSRHFLPPRPRRRPRPRREAPAAEPPTPTYTRDVVRRVDAILRGHPWSAARPLLLSLPGLAWDSHTVARVLKAHPPLHKAFLFFRLAAGRRAAGFRHDRFTYTSMLHLLGEAGRVPAMMRLLAEMLRAGVEPPTPPPSPTVMHWLAHAGDVEAPIRVWEEMRARKGKCRPTLVSYTACVKILFDAGRPAEAREVFQEMVAEGLRPSCKTYTVLIEHLANVGEVFDQMPTMLFVTSTFCTALSLCTQYLSEVLHSLSHLCSTSCEEKIEQLLAFWNTLYIGKFEATMEIMDKMQEAGVEPDKALCNILVQKCSRAGETSVMTRILQYMKENFIVLRRPIFLEALEALKANGESDNLLREVNPHLAFEGIECDPAFTDLGYITVRSTILYLLASRNWSAVEHMINEMTPKNIKVESHILSDIIQASCANCRPSCGLAVLRYSLRIGNELDRSAYGSLLGHYIRNGSFDLVFEIVEILIKSGCNLGTYLSSILIIKLACAGHSSTAVRIFGLLTTDKNVVTYTALMSAYFQDGKVDKALQLFLQMSANGVSACPAESFQHLLLPEHDDIDTQMSLNYGVHLGSPLCNTNALSEIAYTE

SEQ ID NO: 24905 - protein, 211 aa, Staphylococcus aureus
PSADMLFEPRFVNDIDVNENDVVHFCSVDLVDSPMRVAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYNVKPVDTTGAGDAFIGAVISRILATDVLNLTQLFENEGEEILAFSNRVAAIVTTKYGAINSLPTLQEVEQAF

SEQ ID NO: 24906 - protein, 343 aa, Desulfitobacterium hafniense Y51
MWLGFDYFFRGGAMKKILISGGAGYIGSHTVQALAEAGYGPVVLDSLISGHRKAVGESIPFYQGDIADAGLVTDIIKKEEVRAVIHFAARSLVGESVQKPDLYFEENTAKTNRFVSTLLQCGVNTIVFSSTAATYGNPEEIPIPEESHTEPINPYGASKLMIEQSFYWLEQAYGLKWMALRYFNAAGAAWDGSLGEDHTTETHLIPLVLKTVLEQREAISIFGTDYKTPDGTCVRDYIHVLDLAEAHIRALEALEQGIPCGAYNVGTGTGYSVREVIAMAGKVTGLDIPVLEAPRREGDPDRLVAKVEKIQRRLGWQARYSDLETIIKTAWQWHQKHPHGYGD

SEQ ID NO: 24907 - protein, 273 aa, Vibrio angustum S14
MKQCQQHQLWPAIKQEAREQSEHEPMLASFYHATIIKHDDLAAALSYILANKLATPSMPAMAVREVIEEAYASDCSIVESAARDICAVVERDPAIDMYSIPLLYLKGCHALQGYRVANWLWKQDRKALAVYLQNQISVACQVDVHPAAKIGQGIMFDHATGIVIGETAVIENDVSILQDVTLGGTGKESGDRHPKIREGVMIGAGAKVLGNIEVGEGAKIGSCSVVLNPVPPHTTVAGIPAKVVGRPNSDKPSMDMDQQFNGNSQTFIEGDGI

SEQ ID NO: 24908 - protein, 338 aa, Vibrio angustum S14
MTKNANNTISMAVLGAGSYGTALAIALSRNGANVILWGHNPEHIAQLEIDRANEAFLPGVHFPESLIVTSNLQDAVEGSRDLLVVVPSHVFGQVLLQVKPFLRSDSRVCWATKGLEPETGRLLKDVAVDALGSDIPLAVLSGPTFAQELAAGLPTAISVASPDAEFVADLQEKIHCDKTFRVYSNNDFTGMQLGGAVKNVIAIGAGMSDGIGFGANARTALITRGLAEMCRLGEALGAQPETFMGMAGLGDLVLTCTDNQSRNRRFGLALGAGKSVEQAQQEIGQVVEGYRNTKEVWQLAKRYGVEMPISEQIYQVLYQGKDAREAAKELLAREKKYE

SEQ ID NO: 24909 - protein, 269 aa, Pseudomonas syringae pv. tomato str. DC3000
MLRLSSLYRFPLKSCKAEALQHASFDRLGLAGDRRWMLVDESNGRFFTQRALPQMSRLSVLWNADGGVTLSAPGFEPLDVAEPLDTDANLRGVTIWSDSLRVPDAGDAAAEWVSRFIGKPTRMVYLPVERARCMPSGYGSIDDRVNFADGFPLLLIGQGSLDDLSARLGRPMDMLRFRPNLVIEGAEAFAEDGWKRIRIGAIEFRLLKPCARCILTTIDPATGERSPDREPFATLKTYREVEGNVLFGQNMVNDGPGELEVGMPVHVLE

SEQ ID NO: 24910 - protein, 468 aa, Burkholderia mallei ATCC 23344
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGTINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKATGLERRYGRG

SEQ ID NO: 24911 - protein, 227 aa, Brassica napus
  misc_feature (11)..(12): Xaa can be any naturally occurring amino acid
  misc_feature (144)..(144): Xaa can be any naturally occurring amino acid
  misc_feature (146)..(146): Xaa can be any naturally occurring amino acid
  misc_feature (151)..(151): Xaa can be any naturally occurring amino acid
  misc_feature (159)..(160): Xaa can be any naturally occurring amino acid
  misc_feature (177)..(177): Xaa can be any naturally occurring amino acid
  misc_feature (197)..(197): Xaa can be any naturally occurring amino acid
  misc_feature (201)..(201): Xaa can be any naturally occurring amino acid
  misc_feature (207)..(207): Xaa can be any naturally occurring amino acid
  misc_feature (215)..(215): Xaa can be any naturally occurring amino acid
  misc_feature (218)..(218): Xaa can be any naturally occurring amino acid
  misc_feature (220)..(220): Xaa can be any naturally occurring amino acid
MAVVGQWTLCXXSPRLTPAICSSTSSPTTVNLRAELAAFRPQFRLFSRTSPSRRRLRASTSSAESGIFLPHLVASMEQVEETYIMVKPDGIQRGLVGEIISRFEKKGFKLIGLKMFQCPRELAEEHYKDLSSKSFFSSLIEYIXSXPVVCXPWEGVGVXXSARKLIGKTDPLQAEPXTIRGDLAVQTGRNIVHGSDXPENXKREIAXWLKEGELXGWXSXLAKWLRE

SEQ ID NO: 24912 - protein, 559 aa, Legionella pneumophila str. Lens
MCSIGEYLAKRLEELNISEYFAIPGDYNLILLDEVLKNEKLKMINCCNELNAGYAADGYARVKGVSALFVTYSVGGLSVVNAVAGAYAENLPILVISGGPNTNSIQDAEILHHTLATEDNLYVRDIFSRITAHVVCIRKPEQAAMQIDEAIAIAIAKKKPVYIEIACNIANYPISKPTQRAFNTYKISDSSSLAAAVEHAAEKLNSALKPSLIVGSKVRHCNAINSVSELAKCTGYAMAAMPDAKGFISEQHPNFIGIYWGPVSSSGCAEIIDSSDAYLLIGPNENDYTTVGYVWGINPHKSIKTTKGGVIIGETVYTNIFMNDFLRELSKKLKFNDASYKAYKRIAEETVVYPELDQPDAPLSSRYLFGQIQKMLSDKKALLAETGDSWFNCMRLSLPEGCPFEIQMQYGSIGWSVGALLGMQAALHNQKRVIACIGDGSFQMTAQEISTMIRYGYKPIIFLMNNACYTIEVQIHDGPYNVINNWRYAELVNVFRGEQSNAKSFIVKTNKELLTAIKQAEKTEALCFIEVFLDKDDCNKNLLEWGSRVANYNSRPPRR

SEQ ID NO: 24913 - protein, 414 aa, Leifsonia xyli subsp. xyli str. CTCB07
MGAGKKIFGIVLAGGEGKRLMPLTTDRAKPAVPFGGQYRLIDFALSNLINSQLRQIVVLTQYKSHSLDRHISQTWRPDGMLNSYIASVPAQQRLGKRWFSGSADAILQSINLLRDEKPDIVVVVGADHVYRMDFGQMIRSHLDSGSSVTVAAIRQPVSLADQFGVIEVDPASPERIAAFREKPSDPVALPESPGEVLASMGNYVFTADALIAAVRRDADRPDSNHDMGGDIIPDFVARGEAGVYDFTNNEVPGSTDRDRYYWRDVGTIDSFFEAHQDLISALPVFNLYNRQWPIFSQVLNSPPAKIVRDGRGALGTTIDSIVSLGSVISGAHLERSVLGPWATVDSGAKVIDSVVFERALIEPNAFVGRAILDKDVVVAAGASIGVDPDRDRARGFTVTESGITVVGKGVHVVP

SEQ ID NO: 24914 - protein, 498 aa, Corynebacterium diphtheriae NCTC 13129
MTTPATIVEATSAKSHSVRIWTLIGLIIGSTVGSGIFSLPQNIASVAAPGAMFIGWLIAGIGMLAVAFVFQILAHRKPHLDSGVYSYVRAGLGDYIGFTSGWGYWLGSVIAQVGYATLFFSTLGHYVPLFNSDNRVASVIGVSLLTWVIFGILSMGVKQAAFMNAITTVAKLLPIFAFIILVAFLGFSWDKLTLDFWGESTGSSVFEQIQGIMLFTVWVFIGVEGASVYSKQARTRRDVGRATVIGFFTVLVLLVSVSTLSYGVLTQAELAALPDNSMANVLEAVIGTWGAALVSIGLCLSVLGAYVSWQMLCAEPVAMMAFDGLLPRKLGTINATGSPVIAQLISTIVIQLWVFVFFLNETTYISMVQLATVLYLLPYVFSSLYLILLATRGKGISHPAAGTRFDDSGPDVSAADNRRHLFVGAVAFVYSLWLFYAADLKYVLFGALAVLPGLIPYVWTRLYTKERVFNAFEWFVVALIIIAAGYGLSGIMTGSMSL

SEQ ID NO: 24915 - protein, 453 aa, Persea americana
MDNKGGILMQRFELGRLLGQGTFAKVYHARNLKSSQSVAIKVIDKEKVLKVGMIDQIKREIATMRLASHPNVVQLYEVMATKTKIYFVLEYVKGGELFNKVAKGKLKEDVARKYFQQLVSAVDFCHSRGVYHRDLKPENLLVDENENLKVTDFGLSALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFTKGETKSKELAPLDTDAAFASSDTGVAARKPELVKPQHLNAFDIISLSAGFDLSGLFEDTNCRKEARFASKQPASTIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSQGQSL

SEQ ID NO: 24916 - protein, 425 aa, Corynebacterium diphtheriae NCTC 13129
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 24917 - protein, 294 aa, Aspergillus oryzae
MSPSIPSRAFKFIEDLSTSVQGTDSMDYHRGKLLNYVAFQWSHIVTNYSPESIELLGTFAVHFIFYWFGSLVFALADLYAPSSILKKYKIQSISKQPSRQVMLQCIPSALQNQLITSALHALKLLALRSITGRFAGYRIERTLPSLLEIITDAPLCFIGRDFVCYYDHRILHLPWFYRRFHKEHHKFTAPVAVAAEHTHPVDHILINVLPVVIPATLFRVHLVTFWLLMSSTILQGSLGHSGWHVRSIFDRKTTSHDAHHELFDVEYGTLGLMDWLHGTNYMGKHKSKGKGKVH

SEQ ID NO: 24918 - protein, 331 aa, Prochlorococcus marinus str. MIT 9211
MTSFITAANTKQKNISHDTRRLRLISGTSNPALSKEIAQYIGIPCVPLVSKRFADGELYIQIQQSIRGCDVFLIQPTCAPVNDSLMELMIMVDACKRASARQITAVIPYYGYARADRKTAGRESITAKLTANLLVSSGVDRVLAMDLHSAQIQGYFDIPCDHIYGSPVLVDYLATKQLDEVVVVSPDVGGVARARAFAKQMKDAPLAIIDKRRSAHNVAESLTVIGEVANKTAILIDDMIDTGGTICAGAELLRKEGAKRVFACASHAVFSPPAYSRLSIPNLFEQVIVTNSIPVPNDLNFEQLQVLSVANMLGEAILRIHEESSVSSMFR

SEQ ID NO: 24919 - protein, 101 aa, Triticum aestivum
  misc_feature (55)..(55): Xaa can be any naturally occurring amino acid
  misc_feature (68)..(68): Xaa can be any naturally occurring amino acid
  misc_feature (83)..(83): Xaa can be any naturally occurring amino acid
SPAQIEESGFESSTVADILKSKGKSADGSWLWCTTDDSVYDAVKSMTQHNVGALXVLLNPGKDKSIAXGIVTERDYLRKIIVXGRFSKSTKVGDIMTEENN

SEQ ID NO: 24920 - protein, 579 aa, Prochlorococcus marinus subsp. pastoris str. CCMP1986
MLNIHKPFHQKYRPLNLDELVGQEFISITLKQALISQKIAPAYLFNGPRGTGKTSSARIFAKSLNCLSSKQPTPNPCEKCELCIQIAEGNALDIIEIDAASNTGVENIREIIDRARFAPTQARWKVYVIDECHMLSTAASNALLKTIEEPPERVVFILATTNPERVINTIQSRCQKFDFKRISANTIFNNLSAIANKESIKFEDQALKLIAKRSNGGMRDAQSLLDQLSLLPNGVTTKNVQSLLGEVSENDLTDLINALINNQPESLLISCNNLYDAGNEPNEILVGLLNITRDLLLKTLNNNYSEMYYTSIEFQNELNKFSYNVSKNRIIDWHNKLKNVDYQIKTSDNPRLWLEIHLTSLLEKNINQTIINKKELINKQVISEDNKNQNESGDFNKKELINKQVISEDNKNQNESGDFNKKELINNQDINQNSKNDNQTDYLKEKWELILSKLELPSTKMLLSQQAELASIDSNEVLIALSPNWENMIKSRKVIIENAIKKVFGDKVKLNFSSKKINITKTANLQDKVIKKLNDNYEKQSTNFHDSPSPTNKPKPESYNNSPENLANFFNGEIVDLDE

SEQ ID NO: 24921 - protein, 133 aa, Leifsonia xyli subsp. xyli str. CTCB07
MTLISLVRHGQTDWNLAKRIQGASDIPLNETSRVQADATGRALAAGRFDALYASPLSRAYETGRIIAGHLGLGDPLPLPAVVERNYGEAESLTGEQALERWPGDTPVPGQETREEVVARALPALLQLGERHPP

SEQ ID NO: 24922 - protein, 186 aa, Zea mays
QCGNRVIQRGITCKLQVFFTREGKGWGVRTVEDLPRGAFVCEYVGEILTSAELHERAIENARNGKHMHQVLLDAGWGSGVVLRDEDACSLDGSFYGNVGRFINHRCYNANLVQIPVEVETPDHHYHHLAFFTNKKVEAFEELTWDYGIDFDDMEGPSKPFRCMCGSRYCRDPNNPRRMGRAAAKRK

SEQ ID NO: 24923 - protein, 507 aa, Prochlorococcus marinus str. MIT 9211
MRTQPTNPLRIGLRQERVVSPQCLIIFGASGDLTHRKLIPALFELFKQRRLPSEFAILGCARRPWTDEEFREKMAFALESKVKQSTKEWEQFSANLFYEPVDLQRSEDVLKLSTRLEEIDRLKATHGNRTFYLSVAPKFYAMACKSLAGVGLLSDPKRNRIVIEKPFGRDYASAQTLNQIVQSCALESQIFRIDHYLGKETVQNILVLRFANTIFEPIWNRNYISNIQITSAETVGVEDRAGFYESAGALRDMVQNHLTQMLAITAMEPPGHFDPEAIRNEKAKVLQAAHLANEKEPWKCCVRGQYSQGGNKNSPILGYRQEPGVDPNSTTETYVAMKLFVDNWRWQGVPFYVRTGKRLAKRTSEVVLTFREAPVHLFDAAGGSPTSNQLVLRIQPNEGAEFRFEVKSPGSGMRSRPVEMEFSYDESFGEPSDEGYVRLLADVMLGDPTLFTRSDEVEAAWRLYTPLLELIEDSPWQLPVYQYEARTWGPAESDALLAKDQLLWRRP

SEQ ID NO: 24924 - protein, 286 aa, Oryza sativa Indica Group
MPERAITYAVVDAFTDEPFKGNTAAVCLLEESWEEQLDEQWMQSVAAEFNTSITAFLVRADADAANPQFHIRWFTPVRESELCGHGTLAAAHYLISSGLVKCNAIDFLAKSGFLTAKKVVGLKQSSTLISPLQEACTKFLIELDFPLIPVVKCSPLEMPSIPETLNGASVELNSSEEVVNVRPNISELVQSAGRGVAVTGPAPVGSSYDFFSRFFCPKYGLNEDPVCGSVHCALAPYWGKKLGKQCMTASMASPRSGTLYLQWDEAAQRVRIRGEAVTVMVGNILV

SEQ ID NO: 24925 - protein, 79 aa, Xanthomonas campestris pv. campestris str. ATCC 33913
MSTIEERVKKIVVEQLGVKEEEVTTSASFVDDLGADSLDTVELVMALEEEFECEIPDEEAEKITSVQQAIDYVKAHVKS

SEQ ID NO: 24926 - protein, 354 aa, Glycine max
MKRFHSDSKFFTFSILIFLVVLPTLVVAECTCDREDEERDKSKALRYKIAALVSILVAGAIGVCIPLLGKVISALSPEKDTFFIIKAFAAGVILSTGFIHVLPDAFENLTSPCLKEHPWGEFPFTGFVAMCTAMGTLMVDTYATAYFKKHHHSQDEATDVEKESGHEGHVHLHTHATHGHAHGHVPTDDDQSSELLRHRVISQVLEVGIIVHSIIIGISLGASESPKTIRPLMAALIFHQFFEGMGLGSCITQANFKKLSITLMGLVFALTTPMGIGIGIGITKVYDENSPTALIVEGIFNAASAGILIYMALVDLLAADFMNPRMQKSGSLRLGANLSLLLGAGCMSLLAKWA

SEQ ID NO: 24927 - protein, 539 aa, Oryza sativa Indica Group
MAPSRPWWRSSSRPRRRWTICAAPPWSSRLLGRHSPDNRLRIVDGGALATLVALLSRPDPLLQEHGVTALLNLSLREDNRGAVVDAGAVGPLVRALRSAASPAARENAACTLLRLAQLDGSAAAAIGRAGAVPVLVSLLESGGARGKKDAATALYALCSGAPEENGPRAVEAGAVRALLELMGEPERGMVEKAAYVLHALVGTAEGRAAAVAEGGVPVLVEMVEGGTPRHKEMATLCLLHVCEDSAAYRTMVAREGAIPPLVALSHSSDARPKLRAKAEVLVGLLRQPRSGSLLRARPSVAASRLPAGAPFVDAGAVGPLVRALRSAASPAARENAACALLRLAQLDGSAAAAIGRAGAVPVLVSLLESGGARGKKDAATALYALCSGAPEENGPRAVEAGAVRALLELMGEPERGMVEKAAYVLHALVGTAEGRAAAVAEGGVPVLVEMVEGGTPRHKEMATLCLLHVCEDSAAYRTMVAREGAIPPLVALSHSSDARPKLRAKAEVLVGLLRQPRSGSLLRARPSVAASRLPAGLCN

SEQ ID NO: 24928 - protein, 186 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKPEDAGITPEDKSSDEELSDDDDDDNDSGDEAILGNPDP

SEQ ID NO: 24929 - protein, 792 aa, Salmonella enterica subsp. enterica serovar Paratyphi A str.
MSNNGSSPLVLWYNQLGMNDVDRVGGKNASLGEMITNLSGMGVSVPNGFATTADAFNQFLDQSGVNQRIYELLDKTDIDDVSQLAKAGAQIRQWIIDTPFQPALENAIRDAYAQLSSDDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAAGRPAIVRRTMGSKKIRMVYAATQEHGKQVKIEDVPQEQRDIFSLTNEEVQELAKQAVQIEQHYGRPMDIEWAKDGHTGKLFIVQARPETVRSRGQVMERYTLHAQGKIIAEGRAIGHRIGAGTVKVIHDIGEMNRIEPGDVLVTDMTDPDWEPIMKKAAAIVTNRGGRTCHAAIIARELGIPAVVGCGDATERMKDGEKVTVSCAEGDTGYVYADMLDFSVKSSSVDTMPELPLKVMMNVGNPDRAFDFACLPNEGVGLARLEFIINRMIGVHPRALLEFADQDAALQNDIREMMKGFDSPREFYVGRLTEGIATLGAAFYPKRVIVRLSDFKSNEYANLVGGERYEPHEENPMLGFRGAGRYVAESFRDCFALECEAVKRVRNAMGLTNVEIMIPFVRTVDQAKAVIEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 24930 - protein, 763 aa, Zea mays
  misc_feature (742)..(742): Xaa can be any naturally occurring amino acid
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTVLMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAXVESLVFAPFFATHGGLLFKYL

SEQ ID NO: 24931 - protein, 485 aa, Pseudomonas syringae pv. tomato str. DC3000
MSILIPCIIAGGSGTRLWPVSREAMPKPFMRLPDGESLLQKTFLRAAGLPGVDRLLTVTNREVYFRTVDDYRLLNKSHARLDFILEPFGRNTAAAIAAAALHVSTLYGDDAQLLVLPADHLITDVAAFSRAVAAAQTLAAEGWLVTFGIVPTAPETGFGYIEKGQALNAEACQVARFVEKPDAAVAQGYLQSGLHLWNAGMFCMRADAVLRELQTHAPDVLSVVSTCMAVSQRKEGGRELQIELDSESFALTPDISIDYALMERSDKVAVVPCQLGWSDIGSWQAVRELSPVDAQGNHCNGETVLHDVSNCYIDSPKRLVGAVGLDNLIIIDTPDALLIADGRRSQDVKIIAQELKRQGHDAYRLHRTVTRPWGTYTVLEEGKRFKIKRIVVRPQASLSLQMHHHRSEHWIVVSGMATVTNGEREFMLDTNESTFIKPGFTHRLVNPGVIDLVMIEVQSGEYLGEDDIVRFTDIYGRVPEKAVKS

SEQ ID NO: 24932 - protein, 480 aa, Salmonella enterica subsp. enterica serovar Paratyphi A str.
MTLSFTARWRDELPATYTALLPTPLKNARLIWYNDELAQQLAIPASLFDATNGAGVWGGETLLPGMSPVAQVYSGHQFGVWAGQLGDGRGILLGEQLLADGSTLDWHLKGAGLTPYSRMGDGRAVLRSTIRESLASEAMHYLGIPTTRALSIVTSDTPVQRETQETGAMLMRLAQSHMRFGHFEHFYYRREPEKVQQLADFAIRHYWPQWQDVAEKYALWFEEVAARTGRLIAEWQTVGFAHGVMNTDNMSILGLTIDYGPFGFLDDYDPGFIGNHSDHQGRYRFDNQPSVALWNLQRLAQTLTPFIEIDALNRALDRYQDALLTHYGQRMRQKLGFFTEQKDDNVLLNELFSLMAREGSDYTRTFRMLSHTEQQSASSPLRDTFIDRAAFDAWFDRYRARLRTEAVDDALRQQQMQRVNPAIVLRNWLAQRAIDAAEQGDMAELHRLHEVLRQPFTDRDDDYASRPPEWGKRLEVSCSS

SEQ ID NO: 24933 - protein, 270 aa, Vitis vinifera
MKKQSNPTFSFGLLLFLLLFVHSTRIIAQEVEDEREFEYIEGSEKGPKHWGELKEEWAACNNGDLQSPIDLSNQRVKVIPKLGDLKRNYKLCNATVKNRGHDISLQWVGDAGSIRINGTEYKLQQGHWHAPSEHSINGRRYDLELHMVHVSPDNNIAVVGLIYKTGQPDKFLSKMMSNITSMADKMEQRKMGVIHPGDIKMGGRKYYKYMGSLTVPPCTEGVTWIINKKIRTVSREQVKQLRLAVHDYAEMNARPVQPLNLREVQLYGPK

SEQ ID NO: 24934 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKSVDTTGAGDAFIGAVISRILATDVLNLTQLFENEGEEILAFSNRVAAIVTTKYGAINSLPTLQEVEQAF

SEQ ID NO: 24935 - protein, 266 aa, Ehrlichia ruminantium str. Gardel
MSNFNSDITIYSKEDFQYMHNAGRLAAKVLDFIIPYVQPGVSTNKLNDLCHDFIINSGAIPAPLGYRGYPKSICTSKNFVVCHGIPDDLPLKDGDILNIDVTVILDGWYGDTSRMYWVGEPSIKAKRLCEATYNALNVAIAQVFPGQKLNQIGLAIEREIKKYGYSIVRDYCGHGLGRVFHDKPSVVHYYDENDPVVIREGMFFTIEPMINLGKHHTVLSKEDGWTVRTRDFSLSAQFEHSLGVTENGVEIFTLSPKNLHYPPYVC

SEQ ID NO: 24936 - protein, 224 aa, Arabidopsis thaliana
MNSIFGKRKTPAELLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVVQAEATGAEDSGGIDSDLQARLDNLRKM

SEQ ID NO: 24937 - protein, 61 aa, Ehrlichia ruminantium str. Gardel
MGYRGYPKSICTSKNFVVCHGIPDDLPLKDGDILNIDVTVISDGWYGDTSKCVGSVNHQLK

SEQ ID NO: 24938 - protein, 78 aa, Pseudomonas aeruginosa
MSTIEERVKKIVAEQLGVKEEEVTNSASFVEDLGADSLDTVELVMALEEEFETEIPDEKAEKITTVQEAIDYIVAPQQ

SEQ ID NO: 24939 - protein, 402 aa, Ehrlichia ruminantium str. Gardel
MSEVQIRAENLGGESILEAPIRVSVKIGDSIKQGDVLFIIETDKTSLEIVSPVDGTVSKVFIADEEIIERDQLLCTINVGELSHIVQSQTQDPKTDNGNIINDDIQAFIQKKDAPSAVKIMAENSIDKNQINGSGIGGRITKSDVLDHINVVSKDHSVLSEQCSITSHEKREERVKMSKIRQVIAARLKESQNTAAILTTFNEVDMKNVMDLRVQYRETFEKKYGVKLGFMSFFIKAVVLALKELPVINAEISGNEIIYKHYYDIGIAVGTDKGLVVPVMRDADKMSCAELELTLASLGKKAREGKLEVSDMAGATFTITNGGVYGSLLSTPIINPPQSGILGMHSIQKRPVVVNDNSIEIRPMMYIALSYDHRIVDGQGAVTFLVRVKQYIEDPSRMFLEI

SEQ ID NO: 24940 - protein, 172 aa, Ehrlichia ruminantium str. Gardel
MNIFNYMQIMPNISVDAFVAPTAVIIGDVCVNDKCSIWYNSVLRGDVGQIVIGVGTNIQDGTIIHVDRKYGNTNIGKKVTIGHGCILHACEIQDYVLVGMGSIIMDNVVVEKNAMVAAGSLVVRGKVVKTGELWAGRPAQLLRMLSSDEIEEISKSADNYIELASDYITSKL

SEQ ID NO: 24941 - protein, 543 aa, Corynebacterium glutamicum ATCC 13032; identical to SEQ ID NO: 1589

SEQ ID NO: 24942 - protein, 160 aa, Thiobacillus denitrificans ATCC 25259
MREMRVGHGYDVHVLVENRRLIIGGVEIPYERGLAGHSDADVLLHAICDALLGAVGLGDIGRHFPDTDAAFAGIDSRILLRRVAQQLKERAWQVGNVDATIIAQAPKMAPHIARMTAHIADDLGVAIDRVNVKATTTERLGFAGRGEGIAAEAVCLIERG

SEQ ID NO: 24943 - protein, 410 aa, Yersinia pestis CO92
MNTIRRKMRPEFQGLQGGLFSSVKKADVGTAVLDLMANGVDMLCWADPFFPDPVLPEHISQAVIKSMENGSASHYTMPIGNPELKEKIALKLQRYNNLTVEAQRNILITPGSDSGLLFAMMPFINNDDEVLIHSPSYPSNFLNVELLGGKPISVELKAENNFQIDIKDFENKITEKTKMVILTNPNNPTGTVLRRESLQAIADFIIAHDLILVVDQAFEDAIFDEIEFISIASLPGMWERTVSVFSFSKGMGLSGFRVGYLVADAQIVDVLFGCTVNVVGATNTSSQAGMIAALDEPSFMGEYTQIFERRRKVVFEMMNAIPGVCMVMPESGFLSWIDISKLGTSTFICDYLLQHAHVMVNSGVPYGQGGEGYIRLVHGCYKDDEKLYAVLTRIQQALMQLAKEKGICHG

SEQ ID NO: 24944 - protein, 422 aa, Campylobacter jejuni RM1221
MQISDLKKELILKKGILHFDFTASALALKCVEKEISKILPTYANTHSDSSLNSFKTQQIYEQARKDIKKSLSLDENFALIACGTGSSSAIKKFQELIGIYIPPLVKERYFTQIDKNTLPLVIVGPYEHHSNELSFREGLCECIRIPLDKNGEIDFDFLEKTLQKNKKRKIIASFSLASNVTGILSDYKRISEMVRKFKGIVAFDASSFIPYKNISCQYYDALFISSHKLIGGIGGSGLLAIKKDLCGNKPSFAAGGTVGYVSRTSQCYLCNEEALEEGGTPGILQLIRASLAFKIKDSIGIKNIEKKEEILKDYFFEKLKTIPNLILYAKNLKTRLPIFAFNIKGISPFDIAYELSKKYHIETRAGCACAGPYGHDLLGLKDNQKLKTKPGWLRISLHYTHEKEDIDYFFNALNKTIIKLSH

SEQ ID NO: 24945 - protein, 300 aa, Prochlorococcus marinus str. MIT 9211
MSEAVISSFDFAAYLAKEKIRVEAALDASLGPERPKQLREAMRYSLLAGGKRLRPILCLAACELIAGESETALPTAVAIEMIHTMSLIHDDLPSMDNDDLRRGRPTNHKVYGDALAILAGDALLTRAFEMVSLRSPGISAERLIKVVGELSLVAGAPGLVGGQVADLECEGKDVDIDTLEYIHIHKTGALLKASVVCGALIGGAKDDLLDALRTYAEAIGLAFQIIDDILDVTSSSEVLGKTAGKDLIADKTTYPKLLGVDESRQRAKVLIEKAKSVLEPWEDDATPLLALADYIISRDR

SEQ ID NO: 24946 - protein, 266 aa, Leptospira interrogans serovar Copenhageni str. Fiocruz L1-130
MQRASLHNLKIIGSEKETIVFSHGFGCDQSTWNKLIPNLKDHYRLVLFDTIGSGKTDPSLFSADRYSNLYSYAEDLILLMDELKIRNSLYVGHSVSGMIGLITSIRRPELFSKLAFISASPRYLNDTNYKGGFEQTDLDQLFAAMETNFFSWAGGFAPLAMGNPDRPELAQSFAESLREIRPDIGLTVSRTIFQSDHRKDLNQCKQPVLILQPSSDIAVPIEVGKYLSANIPQAIFKSIPATGHLPHFSSPESVLQEIKLFFKSLN

SEQ ID NO: 24947 - protein, 393 aa, Bradyrhizobium sp. ORS278
MTTSQRTAAILVAAGRGLRAGAGGPKQYRTIGGRTVIHRALAAFAEHPEVAVVQPVVNPDDIDVFNAAVAGLRHEAPARGGATRQASVLAGLEALVPHKPEIVLIHDAARPFVTPAVISRAIIAANKTGAAIPVAPVTDTIKEVGASGDITATPERAKLRIAQTPQTFRFDTILEAHRRAAREGLTEFTDDAAIAEWAGLTVATFEGDVANMKLTTPEDFVREEARLAASLGDIRTGTGYDVHAFGEGDHVWLCGLRVPHTKGFLAHSDGDVGLHALVDAILGALADGDIGSHFPPSDMKWKGASSDQFLKYAIERVAARGGRVANLEVTMICERPKIGPLRDQMRARIAEISGVDISRIAVKATTSERLGFTGREEGIAATASATIRLPWGA

SEQ ID NO: 24948 - protein, 450 aa, Leifsonia xyli subsp. xyli str. CTCB07
MTPVLSTLLDDVLRRNAGEPEFHQATREVFGSLGPVIAAQPRYTQAAVLERLTEPERQLIFRVPWTDDEGNVRVNRGFRVEFNSALGPFKGGLRFHPSVTLGTVKFLGFEQIFKNALTGLPIGGGKGGSDFDPKGRSDAEVMRFCQSFMTELYRHLGEYTDVPAGDIGVGGREIGYLFGQYKRITNRYESGVLTSKGIGWGGSLVRTEATGYGSVFFAERMLATRGRDFTGVRVLVSGSGNVALYAIEKVHQLGGTVVACSDSSGVVYDRGGLDLDLLRQIKENERGRLSDYAARRAAGSEYRANGDIWAIAAQTPIDVALLAATQNELDATAAATLAQNGVIAVVEGANMPCTPEAVHLLRTAGVLFAPGKAANAGGVATSALEMQQNASRDAWSFEYAEGRLADIMANIHDSCAETAEKYGAPGDYVLGANIAGFVRVADAMLALGVI

SEQ ID NO: 24949 - protein, 827 aa, Blastopirellula marina DSM 3645
MQVLIWFLVLLAALAALAQAYVFFMQMLRSDPGNERMQEIAGFVREGANAYLTQQYRIVAYFFIVIFALLSLLSYVFQAQSVWVPFAFVTGGFFSGLAGWIGMKTATAASSRTSAGARISLNQGLQVAFRSGAVMGLTVVGLGLLDITIWFAVLRWVFQLNLVDVTVTMLCFGMGASCQALFARVGGGIFTKAADVGADLVGKVEQGIPEDDPRNPASIADNVGDNVGDVAGMGADLYESYCGSLLATAALGVAAFSSPTLAAAAHLDVPTAQFYALFLPLALAAAGIVLSIAGVYMVRTEEGATQKNLLAALGRGINFSTGMVALAAILLSMWLMPKVDGAVYWYVPGVALSIFTGLAAGWLIGKWTEYSTSDEFEPTKKLADQALTGPATIIIGGIADGMMSVWAPVLVIAVATLVAFGAANGWRFSDPDYFSLGLYGVGIAAVGMLSTLGITLATDAYGPIADNAGGNAEMSGLEAIVRERTDALDSLGNTTAATGKGFAIGSAALTALALLAAYVEEVRIGFERWGDNLAHVIDSDQPYRVSSGFIIYKTVEDEQEHVHGFLSLPGDRRDKRVVEAWDKLDFSRGPVKIPVDMIQAETTDGHLHLNMVGRDIELLPIHTATLIDFTNYYEANLMNPKVLGGLFVGAMATFVFCALTMKAVGRAAKGMVEEVRRQFREKPGIMDGSELPDYASPVEISTKAAQWEMVLPSVLGLATPIVIGFLLGVGGVLGLLVGTLTTGFCLAIFMANSGGAWDNAKKYIEAGAHGGKGSDAHKAAVVGDTVGDPFKDTSGPSLNILIKLMSMVSVVGAGFVVRYSLLALGVF

SEQ ID NO: 24950 - protein, 289 aa, Blastopirellula marina DSM 3645
MKVQLVQRLAMTLALIASLTFSVRAIAADDATGRFADAEEVNMFQGIKDGVLDVKFIPMNAEKGTFIITNKTAKKLKVEMPSAFAGVPLAQFGGGGGGFGGGQGGGGGGGFGGGQGGGGGNQGAGGGGGGFGGGQGGGGGGFGGGQGGGGGGGFFNLMPEKTQKVKYEGVCLDHGLEDPNPKIPYEVVPIEQYTTKPGVGTLLHMLGSGKIDQRVAQATAWHLNNDMSWEELAAKSIKHLDGRVEPYFSRKEIVTAMQATQFVEKYEAEMKQKAKTAPSSGESFSTSVE

SEQ ID NO: 24951 - protein, 340 aa, Thermosynechococcus elongatus BP-1
MTLRVGINGFGRIGRLVLRAGLACDNLQFVGINDLVPADNLAYLFKYDSTHGMYPGTVKATAEGIEIDGQFIPCTAVRNPAELPWGAVGADYVVESTGLFTSYEGAAQHLQAGAKRVVISAPTKDADKVKTIVVGVNHDTFDPSSDRIVSNASCTTNCLAPVAKVLHASFGLAEGLMTTVHAVTATQPTVDGPSKKDWRGGRGAGQNIIPASTGAAKAVTLVLPELKGKLTGMAFRVPTPDVSVVDLTFKTEKATTYGDICAAMKAAAEGELKGILGYTEEAVVSSDFIGDGRSSIFDATAGIQLNANFFKVVAWYDNEWGYSCRVVDLLKLMAAKEGLL

SEQ ID NO: 24952 - protein, 226 aa, Acidovorax sp. JS42
MSRTYRIAPSILSADFARLGEEVRNVIAAGADWIHFDVMDNHYVPNLTFGPMVCQALKPHAVTPAGHAVPIDVHLMVQPVDELATAFAKAGADLISFHPDASAHVHRSIQNIRAQGCKAGLTFNPAMPLDVLDWVIEDIDLILLMSVNPGFGGQSFIDSTLRKIEAARRRIEASGKDIRLEVDGGIKADNIRRVADAGADTFVAGSAIFGKSDYKAVIDAMRAELA

SEQ ID NO: 24953 - protein, 549 aa, Physcomitrella patens
MADQTTSAVGHGGRTVPGMSMHGVTGKEPVYAFSVIQGTVEDPDAEKFALPVDSEHKAKTIRVYSFAKPHMRAFHLAWVSFFTCFLATFASPPLMPIIRDNLNLTKTDVGHAAIASVSGSILSRLLMGTVCDVVGPRYGCAFLIMIISPAVYSMALVSDAASFIIVRFFTGFALATFVSCQFWMSSMFNSKIVGTANGLAAGWGNLGGGATQLIMPLVFALIRDSFNSTPFVAWRLAFFLPGAMQTIMGLLVLFLGQDLPDGNYSQLQKQGVKVKDSFLKVLMYAITNYRTWVFFLLYGFTFGVELTVNNNIAEYFYDRFDLNLSTAGIIASLFGLMNFFARPSGGIISDTVARRFGMKGRLCTLWICHSLGAVFCIVLGRMDSLTAAIAVLIVFAVFIQASSGAVFGIIPFISRRSLGVISGFTGAGGNVGSVVLQTVFFTSGSYRTEEGIQFMGVMVICVAALTVFIYFPQWGGIFFPPSKSTEEDYYASEWSAEEQEQGKHATSMKFASNARSERGKRGLNSPDLTIHPVTDSKATPVSDVELNKV

SEQ ID NO: 24954 - protein, 347 aa, Pyrococcus horikoshii
  misc_feature (4)..(4): Xaa can be any naturally occurring amino acid
  misc_feature (8)..(8): Xaa can be any naturally occurring amino acid
  misc_feature (64)..(64): Xaa can be any naturally occurring amino acid
  misc_feature (228)..(228): Xaa can be any naturally occurring amino acid
  misc_feature (334)..(334): Xaa can be any naturally occurring amino acid
  misc_feature (345)..(345): Xaa can be any naturally occurring amino acid
SEKXVAIXKTKPGYGAELVEVDVPKPGPGEVLIKVLATSICGTDLHIYEWNEWAQSRIKPPQIXGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVXDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELXRAGKTGKVVFXLK

SEQ ID NO: 24955 - protein, 340 aa, Desulfitobacterium hafniense Y51
MPKVVTFGELMLRLSPPGYLRFVQTDSFSATFGGSEANVAVTLAQFGLDVSFITKLPSHEIGQLAVNSMRRYGVDTSHILRDGSRIGVFYLEKGASQRGSKVIYDRENSAIALAKADEFNWEEIFMDAEWFHFSGISPALGDNMANLCRIACKKANSLGIPISCDLNYRKKLWTREQAHKVMTELMEYVDVCIANEEDAEDVFGIKPKHGLASAGVIDKESYQEVARMLVDRFGLKLAAITLRRSFSATHNQWSSILYNGKEFIHSKSYDIHLVDRVGGGDSFSGALLYGILEKFELSKALDFATAASCLQQTIEGDFNLISFDEVLSLVEGNTFGRVNR

SEQ ID NO: 24956 - protein, 210 aa, Triticum aestivum
EAAADADVVFTSTASESLLFTKEHAEALPPISLAMGGVRLFVDISVPRNVGACLSEVEHARVYNVDDLKEVVEANKEDRVRKAMEAQAIITQELKRFEAWRDSLETVPTIKKLRSYADRIRASELEKCMQKIGEDNLNKKMRRSIEELSTGIVNKLLHGPLQHLRCDGSDSRTLEETLENMHALNRMFNLDTEKAVLEQKIKAKVEKTQS

SEQ ID NO: 24957 - protein, 102 aa, Arabidopsis thaliana
ELKACNALLLKVNQIGTLTESIQAAKESYADGWGVMVSHRSGETEDVTIAEIVVGIRAGEIKTGAPCRSERLAKLNQILRIEEELGDQAIYAGAKFRDSVNL

SEQ ID NO: 24958 - protein, 211 aa, Staphylococcus aureus
PSADMLFESSFVNDIDVNENDIVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 24959 - protein, 377 aa, Pseudoalteromonas tunicata D2
MTISALLVLEDGTVFRGTAIGAEGISVGEVVFNTSMTGYQEIITDPSYAEQIVTLTYPHIGNTGTNSEDEEANKIWAKGLVIRDLPLLASNFRNEQSLDEYLKARNILGIADIDTRKLTRILRDKGAQNGCIIAGEIDEAKALEAAKAFPGLKGMDLAKVVSTTEQYQWNEGSWQLGQGFKTLADADAKFHVVAYDFGVKRNILRMLVDRGCKLTVVPAQTSAADVLALNPDGIFLSNGPGDPAPCTYAIEAIKAFLETDTPIFGICLGHQLLALASGAQTVKMKFGHHGGNHPVKDLDRGVVMITAQNHGFAAEESTLPDTLRATHKSLFDGTLQGIHRTDKPAFSFQGHPEASPGPHDAAPLFDHFIDLMQERKH

SEQ ID NO: 24960 - protein, 429 aa, Pseudomonas aeruginosa UCBPP-PA14
MRAELNQGLIDFLKASPTPFHATASLARRLEAAGYRRLDERDAWHTEAGGRYYVTRNDSSLIAIRLGRRSPLESGFRLVGAHTDSPCLRVKPNPEIARNGFLQLGVEVYGGALFAPWFDRDLSLAGRVTFRANGKLESRLVDFRKAIAVIPNLAIHLNRAANEGWPINAQNELPPIIAQLAPGEAADFRLLLDEQLLREHGITADVVLDYELSFYDTQSAAVVGLNDEFIAGARLDNLLSCHAGLEALLNAEGDENCILVCTDHEEVGSCSHCGADGPFLEQVLRRLLPEGDAFSRAIQRSLLVSADNAHGVHPNYADKHDANHGPALNGGPVIKINSNQRYATNSETAGFFRHLCQDSEVPVQSFVTRSDMGCGSTIGPITASQVGVRTVDIGLPTFAMHSIRELAGSHDLAHLVKVLGAFYASSELP

SEQ ID NO: 24961 - protein, 968 aa, Aspergillus nidulans FGSC A4
MAAAAQPSGLMDIASSLTQDEIPFKLRCAICNKLALNAFRLPCCDQAICENCQASLPDTCPVCAHTPISSDLCKPNKALRTTLKAFLRTEEKKREKERQERQEAQPAPSGTAAPADEALVRQESQQDSNVVEETPANGPLPNAGEDSSAAQPVDTASAAAEADAAGEEQIGTNGVSQVDEHSETVAPDAADQALDVAQKNADGDNIESSESTEQPDQDSQNAMPGSGFPNPMGFNMNPGMFPNMAWGTNPMAQFMGGGMMGFPNPMGMAAMGMDPMAASQGMFGGYGMNMNGMSNGMNMGMNFNAGQGMYGGWDGSQNNMWNGSQDKFNPNAFANGMGAQIGDPSGFGGYNMSQPNGVHPQMQQQQFSNQELQNGYYGPGNYRGRGRGYFPGGRGRGGYVGHMQPNFPHNVNSAALQDNTSSADQPMPSQTEEGATDSTATGDNVPSDGKKAEDGPNTADASSGNQALNQVETNGGNVESVPGADGHPDQAMNAENQLQGIPTVDSLNEPYNVGATAAPTYMYQGFGRGGGYMRGGFHGRGGSFGGQQQFMPAPNMQPRGPGVEGAPAAPRAMRQGLPNTSVFRQRNFHLVGRVPNQPSKGPEVSQTPHAEPTSEDQRPQSSSRSISRARSRSRSKPRSRSRSRSRVPSRSSSRRRYRPRSRSVEDDATDYDRPRERRRRPHHDERDRTAEDERRSRSPSIDSHRSSLRDKERDRRRARRSRRSHRRRSRSRSASGDRNGDSRDTDRFAEERSSSKPRSRNADTLDTHRSGKDRSSRREEDRERDRDSRRRDRERDRDRDRDRDRDRDRDRIREKERERDRDRERPRERDRDRERDRKRSRRDRSESAADSDYHSRKAKRGREDDARTSTSNRDRPKDTREKTLLTNPPEPEKDPHTLEREARNRERLLKEQQRREAMQADRDAGKSSRRRDSRQERAGRRLNYKYDDETDAARAARVEREREAGRWE

SEQ ID NO: 24962 - protein, 240 aa, Burkholderia xenovorans LB400
MTLQTGTLVVLRHGQSIWNRANRFTGWSDVGLSVQGVADAQRVGERLREAGFRFDLAVTSALLRATDTLAHVLRTLEQPPPRTVRSWRLNDRHYGMLTGMEKDEAALAYGAERVRQWRRGFDLAPPALDADLHAALVRALHDDAMPHADALPRTESLRDTLRRVLPLWDECVAPALTRGQSVLMVGHGNSLRALFKQLDNIGDDAIASVEVAHAEPLVMKFDATLSVISRTPLAALAASR

SEQ ID NO: 24963 - protein, 537 aa, Azoarcus sp. BH72
MTTELTFASLGLAEPLLRAISDTGYTTPTPIQAKAIPLVLAGGDLLAAAQTGTGKTAGFTLPVLHKLAATHVHPHPAGKPRCLILTPTRELAAQVEESVQTYGKHLALTSMVMFGGVNINPQISALKKRVDILVATPGRLLDHVGQKTLDLSGVEILVLDEADRMLDMGFIRDIRKVLALLPKQRQNLLFSATFSDEIRDLANGLLHNPGCVEVAPRNTASERVEQTVYMIGQKQKRELLAWLIKEKQWFQALVFTRTKHGANKLAEYLTKHDIPAAAIHGNKSQSARTRALSQFKDGSLPVLVATDIAARGLDIDQLPQVVNFELPNVPEDYVHRIGRTGRAGADGNAISLVDGEEVKLLTAIERLIRRKIDRATAEGFVPSAVPDTSADDDRDERRGQDRGRGRQGQGRDGNRSQGQPQGQARRGGEGGNGGGRGQGGRPGAPARQGNGGQRRDQPRGEVNGNRAQTTQQREVDGNRMPAPRPDVDGNRMPAPSRRGEVNGNRAQPAPRQGQNNRGGRPAQQRAALFSAKPGGNR

SEQ ID NO: 24964 - protein, 470 aa, Leifsonia xyli subsp. xyli str. CTCB07
MTTAETSGEPALSGEAVLQAKAKDHLWMHFARQSVMEDGHGVPIITRGEGHHIWDSRGKRYIDALSGLFVVNAGHGRKRLAEVAAKQAEQLAFFPIWSYAHPNAIELADRLASYAPGDLNRVFFSTSGGEAVETAFKLAKHYWKLQGRPAKHKVLSRAVAYHGTPQGALAITGIPAMKEMFEPLTPGGFRVPNTNFYRAGEMGAPADDIEEFAVWAANRIEEMIQFEGPETVAAIFLEPVQNSGGCFPPPPSYFQRVREICDKYDVLMVSDEVICAFGRIGHMFACDEYGYVPDMITCAKGMTSGYSPIGATIISDKIYEPFKHGNTSFYHGYTFGGHPVSSAVALENLDIFEEERLNERVRENSPLFRAELEKLLALPLVGDVRGDGYFFGIELVKDKAAKETFDDDESERLLRGFLSKALFDAGLYCRADDRGDPVVQLAPPLTIGTDEFVEIRQILESVLTEAGNRL

SEQ ID NO: 24965 - protein, 478 aa, Leifsonia xyli subsp. xyli str. CTCB07
MSTHALRNFVGGEYVDSTATERLDITDPATEEVFATAPISTERDVALACRAAAGAFETWGETTPGERQRALLRFADALEARAEELADVEVKDTGKPRAGIVADEVEVMIDQVRFFAAAARNLEGRSAGEYLKDHTSFIRREPIGVIGQVTPWNYPMMMAIWKLAPALAAGNAVVLKPSDSTPSSSLLLAEIASEFLPAGTVNVVTGNRETGRALIADRTPQMVSITGSVRAGVEVAGSAALDLKRVHLELGGKAPVVVFDDADIEQAVEGISAAGFYNAGQDCTAATRLLVQEGIHDEFVAALVEYSRDNAKTGAPLEEGILFGALSSADQLACVQGFIERLPDHAQLVLGGKRQGDRGYFHQATIVSGLRQEDEAVQNEIFGPVITAQTFSDESDALRRANGVPYGLASSVWTQNHGTAMRMAKRLDFGCVWINTHLPLVAEMPHGGFKHSGYGKDLSAYGFEDYTRIKHVMSYIGE

SEQ ID NO: 24966 - protein, 234 aa, Zea mays
  misc_feature (124)..(124): Xaa can be any naturally occurring amino acid
TPGAPTHPPIRHARRLLSVPAAEAQLRPAIHHLPPDALHNVLLRLQLRDAVACRLVSRLFHETLSPQLLALLPTLRLLLLRHPRPDGGGCLHAFDPARRTWLRLPFAHFLPYQSFCPVASSTSXLLYLWVETSSSTSPLALQSTTTSSSAASPAHPLKSLAVCNPFAGTYRLLPQLGSAWARHGTVLAGPGGMVLVLTELAALSYTPSESGKWMKHPLSLPSKPRSPILGLAAV

SEQ ID NO: 24967 - protein, 488 aa, Thiobacillus denitrificans ATCC 25259
MATLESLTFDNGFARLPETYYARVCPTPVPDPYLVCYSPEALSLLDLDATELKRPETIETLAGNRLLPGMDAIAALYAGHQFGHYVPQLGDGRAILLGEVRNRAGEGWEIQLKGAGRTPYSRGGDGRAVLRSSIREFLCSEAMHALDIPTTRALAVVGSDHPVYREDEETAALVTRLAPSFVRFGSFEVFYYRNQVEPIRHLADYVIARYYPELKTLADPYPEFLRQVSLRTAELMAQWQAVGFSHGVMNTDNMSILGLTLDYGPFGFLDAFDPGFVCNHSDTGGRYAFDQQPDVAAWNLTKLAQALVPLMSVETASQAISEYPQAFGRAYLARMAAKFGLAPGDDTVPLITDALQLLAGNRVDYTIFLRKLCAFDSQADAGNAPLRDLFLDRAAFDAWAVRYGAALRQHGQPDAERAATMRTRNPKYILRNYLAENAIRRAADLRDYSEVERLHRLLARPFDEQPAFEAYAAEPPDWAKRIEVSCSS

SEQ ID NO: 24968 - protein, 338 aa, Thermococcus kodakarensis KOD1
MGGIKIEPKTAIFAGGCFWCMEEAFERLPGVIEAISGYTGGWVENPTYELVSTGETGHREAVKVIYDPSKISYERLLDVFWRNIDPTDPGGQFADRGEQYKTAIFYLDEEQRELAEESKRRLELSGIFDEPIATEILPAKEFYPAEDYHQGYYFRFEANYKGYKLYSGRLGFIKSVWEKNRHFRLFPEREGYWLGYVKPSDAELKRQLTPLQYRVTQLGDTEEPFHNEYWNNHEEGIYVDVVSGEPLFSLLDKYDSGTGWPSFTKPLEEWAVVEAGECEGFLCGREVRSRFAGSHLGHVFDEPTPTGKRYCINSAALRFIPRDELRRYGYTAYEGIFK

SEQ ID NO: 24969 - protein, 354 aa, Sporothrix schenckii
MCFGGRSKADEDVARSRELDKAIRADEKRMSREVKLLLLGAGESGKSTVLKQMKLIYAKGFSKNERLEWKPVVFNNIVQSFRLIYDAMAELDISFSDPENEKNIKQILVEFELGANDPLPTDYLEPIKTLWKDDGVRRAIAKGNEFALHDNLDYFCEDLDRIWDRTYVPNDQDLLRSRLRTTGITETVFDLGQLTYRMFDVGGQRSERKKWIHCFENVNCLLFLVAISGYDQCLVEDKDGNQMSEALMLWESIANSHWFTKSSLILFLNKMDLFKEKLPNSPIAEHGFTDYSGPAADPKQVSKYFMDKFRALNRNPEKEIYGHFTNATDTNLLKITMGSVQDMIIQRNLKQLIL

SEQ ID NO: 24970 - protein, 316 aa, Xanthomonas campestris pv. campestris str. ATCC 33913
MLVCSGVQAAAAQAQTVPAIAAAERVVVSTDIGDDIDDAFALGLLLRSPQLQVLGIASAWGDTTLRAQLLQRLLQLAGRSEIPLAVGERTTSTIPFSQARWAAKGQLPGKLPDAAAMILQQARLHPGELTLLVLGPMTDAARAQQRDPAGFAKLKRIVAMGGSVRVGYGKSAYRPASAPAPEYNLLADVPAAQRVFAAGVPIVLLPLDATQITLEESERVALFAQGDGLTDALTQLYYQWRNTDQPWASATPTLFDVVPVAWLLQPQLCPTTPLHLEVDAQGYTREGTGTPNVQACLRADKPALIDMYMRTLLQSH

SEQ ID NO: 24971 - protein, 320 aa, Picea sitchensis
MELLLQNFPKWPLYSSFNYKRRTSRPENLTMACTRIETATSAVNISVPSTKSHLVLMRHGESMWNDLKLFTGDVDIPLTENGVMEALASGRAVSEIDFDIIFTSRLVRAKQTALIAMTQSRFKRVPVIVRGGFHGRGKTGDANRLRLRDAAAKALKHASCHMVPVYADPALNERCYGDLQGLSKEAAIKEFGEETVMKWRRSYDTRPPHGESLKDTAARSVRFFKTTIIPRLEEHRNVLIVAHGNVLRCIIAHLAGFSDMEMLKLQIVTAMPYAYTYDGGTFAECCALPPLNPNRNDEDHQGVPLGISSVFKTGDVNSLI

SEQ ID NO: 24972 - protein, 313 aa, Mycobacterium tuberculosis
  misc_feature (47)..(47): Xaa can be any naturally occurring amino acid
GSHMSIAEDITQLIGRTPLVRLRRVTDGAVADIVAKLEFFNPANSVXDRIGVAMLQAAEQAGLIKPDTIILEPTSGNTGIALAMVCAARGYRCVLTMPETMSLERRMLLRAYGAELILTPGADGMSGAIAKAEELAKTDQRYFVPQQFENPANPAIHRVTTAEEVWRDTDGKVDIVVAGVGTGGTITGVAQVIKERKPSARFVAVEPAASPVLSGGQKGPHPIQGIGAGFVPPVLDQDLVDEIITVGNEDALNVARRLAREEGLLVGISSGAATVAALQVARRPENAGKLIVVVLPDFGERYLSTPLFADVAD

SEQ ID NO: 24973 - protein, 260 aa, Triticum aestivum
  misc_feature (65)..(65): Xaa can be any naturally occurring amino acid
  misc_feature (111)..(111): Xaa can be any naturally occurring amino acid
MRPAGAASASTAGEDGNERALSYGDVVLLRSDLSILRGPHFLNDRIIAFYLAHLSAAFEGDDDGXLLLLPPSIPYLLSNLPDPDSVAAVAEPLRLASRSLVLLPVNDNPDXSVAEGGSHWTLLVLDATNGASRPRFVHHDSLGVLNFDAARQLAAVLRPLLPGAANGALLVEGPTPMQANGHDCAGVYVIALARAICNWWRDRRGQQQEGGADWFDTVRKEVDAESVKAMRAELLHLIARLIQDKEDEKKNKAGEGRKED

SEQ ID NO: 24974 - protein, 306 aa, Aspergillus parasiticus
MRFLSGFVSVLSSVALLGYAYPTAIDVRDIPTTQLEDFKFWVQYAAATYCPNNYVAKDGEKLNCSVGNCPDVEAADSTVKLSFSDDTITDTAGFVAVDNTNKAIVVAFRGSYSIRNWVTDATFPQTDPGLCDGCKAELGFWTAWKVVRDRIIKTLDELKPEHSDYKIVVVGHSLGAAIASLAAADLRTKNYDAILYAYAAPRVANKPLAEFITNQGNNYRFTHNDDPVPKLPLLTMGYVHISPEYYITAPDNTTVTDNQVTVLGGYVNFEGNTGTSGGLPDLLAFHSHVWYFIHADACKGHGLPFR

SEQ ID NO: 24975 - protein, 912 aa, Thermosynechococcus elongatus BP-1
MTLGLTPKFVKIFLFVGLMLLSTSLAVIFPLNSVEGLGSGVTKTVLDNGLTVLIKEIPTAPVVSLQVWYRVGSRHEPKGENGIAHQLEHLMFKGTQSRPVQFGQLFYALGSSSNAFTSYDMTAYHHTVRADQLEPLLILEADRLRHTLITPDALESEKRVVISELQGYENSPEYRLSRAVMAALYPKHPYGLPVGGTASDVEQLTLAAVKSFYQQYYRPDNAVVVIAGNVRAARALELVKSTFGAIPQPPEPLISPPLPPPGAVSGQRIRLREPGSAPLLQILVPIPGITHPDQAALDVLDMLLSGGRSSYFYQELMETGQASSAYSYVAALQEGGWFEMGAIASPDQSLETIEQSIGKMLQQLAERPLSLAELQRAKQQLKANFILRNRDIDAQASQLANDETLTGDYRFSDRHLAAIEKVTAADVQRVVQTYFGRDRWIVGEFIPSEFADVELSGRPAVQTTAHNLIGEPVDPQTIAAYLPQGSAQAAPAVKNNGVETFTLENGLRVLLLVDRSTPTVTLAGRIDAGTAYDLLTQPGVANLTAANLLNGTRTKTALTLAQTLEDRGISLEFSAFRDGVDVEGYALASELPTLLATLGEVLQEATFPEAEFKLSQQRYLTALGLEADDPVRWGRRVLQETLYPAHHPLHPFATPESVQAIQRQDLLNFYRAAYRPDRTILTLVGDFDPLAVRSRLKDIFGPWQPPTAPLSLTFPAVSPPPQTLFRNAVIAGKSQAITYLGTPGIDRRHPRFYAAMLMNHILGGDTLASRLGTEIRDRQGLTYGIYSFFTASRQAGPFMIQLQTAPEDTAKAIQATLQLLREARRQGFTAAELEAAKRSLSNTYLVELANVDVVARTLLANASVDLPPQELQQFSDRLQQVSLAEVNQALRELIDPERLVIVTAGPAVSFSP

SEQ ID NO: 24976 - protein, 306 aa, Aspergillus flavus
MRFLSGFVSVLSSVALLGYAYPTAIDVRDIPTTQLEDFKFWVQYAAATYCPNNYVAKDGEKLNCSVGNCPDVEAAGSTVKLSFSDDTITDTAGFVAVDNTNKAIVVAFRGSYSIRNWVTDATFPQTDPGLCDGCKAELGFWTAWKVVRDRIIKTLDELKPEHSDYKIVVVGHSLGAAIASLAAADLRTKNYDAILYAYAAPRVANKPLAEFITNQGNNYRFTHNDDPVPKLPLLTMGYVHISPEYYITAPDNTTVTDNQVTVLDGYVNFKGNTGTSGGLPDLLAFHSHVWYFIHADACKGPGLPLR

SEQ ID NO: 24977 - protein, 414 aa, Triticum aestivum
MAAPALAKRPCSSPSSSASCREAKRLRPAAAPVAMERHDAAAAAEVSTTTSQSQSQPLLPGLPDHLAQLCLSTLPPSLMHAVCRPWRRLLYAPSFPPFLSLYALLEDAGDGGASFAAYDPIAARWDCLPAPPMPSPPPTLCHPSFLSRRLPLQSVAAAGQLVLVAGSTQSLHPALCRPLVFDPTAAPAPRWQVGPRVPLAPRRWCAAGAARGRVFVAGGVGAGYDLAVARSGATWDPATPSAPWEPLPPLRDGRFSRDAAEAVCSGGKVCMVNLRGSGAKEGAVFDLVAGRWEDMPPGMLAGWKGPAAASPDSGDTIFVVDEERGALNTYDWGSDRWTTVTEAERLKGAAEMAAGGGRVCVVSHGGAKVVVVDVTPKARTRGSTTAPPRMWEVEAPAGRWVVSLHVLPRMTRPE

SEQ ID NO: 24978 - protein, 642 aa, Coprinopsis cinerea okayama7#130
MTDCFESPDVAAKTYTYSADGRLYAYALPTLVRIFQAEGAQLLQELPLPNIIEMSFSPRGTYLSTWERPVKLEDGAQHKNLRVFSVSTGEELISFSQKSIEGWQIQYTISESHAVRLVSSEIQVYRPSEWSKGIADKLKVEGATNIALSPGLNPSVAVFVAEKKGAPASIKVYGLLSLNAPPTCQKTFFKADRAQMKWNVLGTQVLLLTQTEVDNTNKSYYGETGLYLLSAAGNFDCRVTLDKEGPIHDFAWSPNSKEFGVVYGYMPAKTMLFDHRVRSVHDFGLAPYNFISFNPQGRLIALAGFGNLAGKMDIFDRRTVKKLCTIDAPNTSHCEWSPDGRFILTATLSPRLRVDNGVKIWHCTGPLVHIQATEELYQASWRPTPVEGVPPFPQAIPPAPAPAPSVKAYNESNEGKKSATPAKPAGAYRPPGARGLATPAIFKREDEGGIRLDGTSTPPRYGRGPVPGAPGYGSQSNGYGNGNGQRRVVPGAPPPGSGPSEEKKGGRRKKGKKDGEGQDGGAGTPPAVDVGAANGQQGGGGGKKGKNRAQPGSGNGSAAPTPPAPSTPAALEPQTPVTPGGDGLDAVAKKIRNLNKKLKAIDELKEKQKRGERLEATQLKKIEGEADIRKELAGLNAQAGSS

SEQ ID NO: 24979 - protein, 380 aa, Zea mays
LRGKGSYSLAFEKEHHPQPNAQQSGPTSLPIPQSVQAMVAAGRHAPVPPRYLRPDLAADVVVADDATTIPIIDFQRLLLVDPEESARLHAACQDWGFFQLINHGVPDDVMEAMKASIQSFFALPAEAKQQYRQQAGQLEGYGQLFVVSEDQKLDWADVLYLNTQPPEHRNLSFWPAGESFRQTLDTYSAAVKHVADRLLGAMYMNLGLQLSIMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 24980 - protein, 399 aa, Streptomyces coelicolor
MLGIVLAGGEGKRLMPLTADRAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSFGVITPGSDGQTVTGFLEKPADPPGLADDPGCVFASMGNYVFTTKALVEALHRDAEDPDSVHDMGGSILPQLTDRGEAALYDFSANHVPGETTRDQGYWRDVGTLDAYYDAHMDLIAERPAFNLYNRDWPVYTHSTQLSPARFNAGGIASESIISAGCLIRGQVTRSVLSPGVVVDPGAVVQGSVLHDNVHIGRGAVVRGAVLDKNVQVPPGATIGVNPQRDGELYTVSKGGVIALGKGQRVP

SEQ ID NO: 24981 - protein, 472 aa, Pseudoalteromonas tunicata D2
MAQNVYQFIDVQRVDPRKKPISTRKKQFVEIYEPFSAKQVDSQADRCLDCGNPYCEWKCPVHNYIPQWLKLIKDGKIFEAAELSHRTNSLPEVCGRVCPQDRLCEGSCTLNDEFGAVTIGNIEKYITDTAFAMGWKPDTSYVVWSDKKVAIIGAGPAGLGCADILARNGVKPVVFDRHPEIGGLLTFGIPSFKLEKSVMEKRREIFTGMGVEFRLNTEVGKDVQLADLIAQYDAVFVGVGTYQNMRGGLENEEAQGVFDALPFLIANTNKVMGFDNEAYPYQDMANKRVVVLGGGDTAMDCVRTSIRQGAKEVICAYRRDEQNMPGSKREVKNAKEEGVKFKFNVQPKGIQLDVEGKVIGVNMVKTALGEPDEKGRRRAEEVAGSEHLLPADAVIMAFGFQPHAMPWLEPFGVECDQWGRIKAPEQGLGHTHQTTNPKIFAGGDIVRGSDLVVTAIFEGRNAAEGILDYLAV

SEQ ID NO: 24982 - protein, 292 aa, Aspergillus oryzae
MGIHTQLTIAVIGCGTLGTAIAAGILSPKERTDLEVHHLTATVGTESSKRRVENALSQHSSRLTVLTQERNVRAVWEADVVLLAMNPVKRADVFAALGFRDILQGKLVLSIMAGITTKALNILALGEDSAPDNESALQCVRAMPNMAAKIREAVTLYTAGSGTTKENLEIASWVFSQVGEAHRIPESSFDICAVSVGCAGSLLLLAIDGLLDAAVAEGVKRPDVQNLVVNSAIGMMKLVPAGDHVSVLREKIASPGGCSIRALLELEKLGVRAAFTTAIMAAAEKSKHMSLS

SEQ ID NO: 24983 - protein, 498 aa, Helianthus annuus
MRMNPTTSSSGVATLDKKNLGRIAQIIGPVLDVAFPPGKMPNIYNALVVKGRDTVGQPINVTCEVQQLLGNNRVRAVAMSATDGLTRGMDVIDTGAPLSVPVGGATLGRIFNVLGEPIDNLGPVDNSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFVDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYETAQQVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNSKK

SEQ ID NO: 24984 - protein, 311 aa, Pseudomonas aeruginosa UCBPP-PA14
MRALTALSRFVSASFPFWVLLFAILAFFRPAWFLPLTVAIAPLLGLVMFGMGLTLKGEDFREVARHPIRVLIGVLAQFVIMPGLAWLLCRLLQLPAEIAVGVILVGCCPGGTASNVMTWLSRGDVALSVAITSVTTLLAPLVTPALVWLLASAWLPVSFAAMFLSILQVVLMPIALGLLAQRLLGERTRQVAEVLPLVSVFSIVVIIAAVVAASQARIAESGLLIMAVVMLHNGFGLSLGYLTGKLTGMPLAQRKALAIEVGMQNSGLGAALANAHFSPLAAVPSALFSVWHNLSGSLLAALFRRMEDTPR

SEQ ID NO: 24985 - protein, 177 aa, Oryza sativa Japonica Group
MESKEVHGRDVLVDLEKGNCLLMREGGDNGTDVNMISSQAKTPWNDLIAMKDDHHIPCCSSRSQDFAVKSGEDRTSDGEMKVGLLDKSMGEKEKKKRSKKPPRPPRPPSASPLDAADQKLISELSELASLKRARIERMKALKKMKNTKPASSIGNLVALIITIIFCLVILWQGLPMK

SEQ ID NO: 24986 - protein, 440 aa, Leifsonia xyli subsp. xyli str. CTCB07
MAQERRIVTAIPGPKSQELHQRRLAVVPSGVSSALPVYIARANGAVLVDVDGNQFVDFGAGIGVTTIGHTDSAVVAAATEQVQDVIHTLFTITPYEEYVRVAELLAEHTPGDHAKKTVLVNSGAEAVENGVKIARKHTGRRAVATLDHAYHGRTNLTMAMNYKAMPYASGFGPLAGDVYHAPGSYPYRDGLSGAEAASRTIAYLEKVVGASDLACLVAEPIQGEGGFIVPADDYLPALQTWCTANGVVFIADEIQSGMARTGAYYASEHFGFVPDLVLSAKGIAGGLPLAAVTGRAEIMDSAQPGGLGGTFGGNPVAAAAAIAVFDQIEKNDLLAEGKRIENALKPALLALQEKYDIIGEVRGIGAMIAIELVKPGTAQTSKEPNPEAVSAVVAYAAQHGILFLTAGTWGNVLRFLPSLAVSDELIADAVSVIDDALETL

SEQ ID NO: 24987 - protein, 372 aa, Coccidioides immitis RS
MSQERKDDRPAASSEQDKHHEPGTPVAPSGFQGLLSLATPLTRFVLYPMDQLKLVGSNLRQMVSKKFDPEKDIIDQDGKVILITGGNAGLGKETVLQLAKHNPLRIYLAARNSSKAQAAIDDIQKQLPQHADIRHLPLDLSSFTSIRAAAREFTSSNERLDTLILNAGVMDPLPNRTEDGFEVDFGTNHLGHFLFTKLLLPTLTKTAQETKSAGKPADVRIIVVASMAWQMSPPLSTMLSTDSLLALNPPTRYGASKAANIAFASELARRYPELSCVSLHPGVIITGLYDSLMATNPVARVGLRIAKSITVDEKQGSLNHLWTAGSERGALRSGEYYTPVGVGGWKNKWAEDRELGRTLWEWSEEAIRDQKK

SEQ ID NO: 24988 - protein, 361 aa, Corynebacterium diphtheriae NCTC 13129
MSLTLGIVGLPNVGKSTLFNALTRNDVLAANYPFATIEPNVGLVELPDARLNRLAEIFQSERILPATVSFVDIAGIVKGASEGEGMGNAFLANIREADAICQVVRAFADDNVIHVDGRVDPSSDISVINTELILADLQTVEKALPRLEKEARKNKDLAETVEATKKAQAILEDDRTLFAASKNGEIDLALVRELHLMTAKPFLYVFNSDEEVLTDDARKQQLRDLVAPAEAVFLDAKTETELLELDEDEALELLESVGQTEPGLATLAKAGFATLGLQTYLTAGPKESRAWTIKQGSLAPQAAGVIHTDFEKKFIKAEIVSFDDLDAAGSIAEAKAQGKMRMEGKDYVMHDGDVCDFKIGG

SEQ ID NO: 24989 - protein, 369 aa, Kluyveromyces lactis NRRL Y-1140
MSSELRQRHSSGSAAPSLTEHRFDEKKQARSRSRTGSSSKHHFKPVSKVDRYSVLLSSILLSLLFVGNSFYPEYTKKFVNLQYEYPDNPGKYDIGIDDGYVILTFIVVFCLVRSFLLEFVLKPVGRNRFHMRSVKSLQRFGEQGWSMIYYLFSWIFGFYLYYHSPYYFNIDHIYSGWPHDQLSGLFKTYYLFQIASWFHQIIVLNVEERRKDFWQMFAHHIITVALTTGSYYYYFTRIGNVILILMDIVDVLLSFAKMLKYCGYSTLCDYMFVVFLFWWVMLRHVVYNYLTYQTWLRAKNLMADGECIAGLAQKRCWTPTVVNIFLALLGGLQVITCIWMYLILKVLVKVIKGIGAEDVRSDEEDENSD

SEQ ID NO: 24990 - protein, 496 aa, Oryza sativa Japonica Group
MHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSACLPITLDVGTNNEALLNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGAGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 24991 - protein, 385 aa, Oryza sativa Japonica Group
MGMEEEGVARGGGGKKLALASIGFADVRVGAVAGGGGAGAGGGYKEDLLVVGLPKDDDFDVAKVVGDVAVGLPDVGAAVRNFLRNREVGEFVSGALAGAMTKAVLAPLETIRTRMVVGVGSKHIFGSFVEIVEQNGWQGLWAGNTINMLRIIPTQALELGTFECVKRSMTEAQEKWKEDGCPNIQIGNLKIELPLHLLSPIAVGGAAAGIVSTLVCHPLEVLKDRLTVNREAYPSIGLAFNKIYQTDGIGGLYAGLCPTLVGMLPYSTCYYFMYETIKTSYCRAHKKKSLSRPELLIIGALSGLTASTISFPLEVARKRLMVGTLQGKCPPHMIAALAEVFQEEGIKGLYRGWAASSLKVMPTSGITWMFYEAWKDILLAPELHT

SEQ ID NO: 24992 - protein, 245 aa, Leifsonia xyli subsp. xyli str. CTCB07
MTQNELRRPGFLYFAGRWIVAPLAKIVYRPRVVGRRNVPRHGKVILASNHLSFIDSIVIPMTSPRRVQFLAKSHYFEGAGFRGRVSRSFFTAIGAIGVERGAGQAAQEALEQSRRIIDTGAAFAVYPEGTRSLDGRLYKGRTGIGWLALTTGATVVPVGLSGTEKMQPVGAKFPRVHRVTVSFGEPIDVSRYGSAGSGRARRQATDEIMAAIHALTGQELAGVYNESPPATTMERIKRALRPERL

SEQ ID NO: 24993 - protein, 388 aa, Oryza sativa Japonica Group
MGIPVGKLALYTALGGVRPSACLPITLDVGTNNEALLNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGAGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 24994 - protein, 313 aa, Mycobacterium tuberculosis
GSHMSIAEDITQLIGRTPLVRLRRVTDGAVADIVAKLEFFNPANSVKDRIGVAMLQAAEQAGLIKPDTIILEPTSGNTGIALAMVCAARGYRCVLTMPETMSLERRMLLRAYGAELILTPGADGMSGAIAKAEELAKTDQRYFVPQQFENPANPAIHRVTTAEEVWRDTDGKVDIVVAGVGTGGTITGVAQVIKERKPSARFVAVEPAASPVLSGGQKGPHPIQGIGAGFVPPVLDQDLVDEIITVGNEDALNVARRLAREEGLLVGISSGAATVAALQVARRPENAGKLIVVVLPDFGERYLSTPLFADVAD

SEQ ID NO: 24995 - protein, 304 aa, Kluyveromyces lactis NRRL Y-1140
MSASYWDSSQRHKWKYTRESLAKEKQKLWLLECQLFPQGLNVTIHDSKANKQVTTNIPVTQRDLHYDRDYNLRIYCYFLIMKLGRRLNIRQCALVTAHVYLSRFLLRASVREVNLYLLITTCIYLACKVEECPQHIRTLVNEARSLWPEFIPPDVTKVTEFEFYLIEELQSYLIVHHPYRSLEQIEKALSSEKYNYKLSDDELQKIWSLINDSYTTDVHLLYSPHVIAISCLFAVSCIIHKPEDSTKRANINMFIAETQVNLEQVMFILQELISLYDHWDKYNELRIRALLHELYLRQQTPAIQ

SEQ ID NO: 24996 - protein, 445 aa, Leifsonia xyli subsp. xyli str. CTCB07
MTREFSVPQSRRIVTELPGPRSVELQRRREASVSRGAGTLANIYMESGSGAILVDVDGNRLIDLGCGIGVTTIGHAHPAVAAAAAEQAAKLTHTLFTVTPYENYVRVAEKLAEITPGDVEKRSILVNSGAEAVENAVKIARKHTGRRAIATLDHAFHGRTNLTMAMTYRPWPERAGMGPFPGEIYSLPLSYPFRDPEGMIGEEAAERAIDYINTHIGATELAALFVEPIQGDGGIVIPAPGYFKRLSEFCSENGIVFVADEIQAGIGRTGTWYAIEHHGVVPDLITTAKGIAGGFPLAAVTGRAEIMDAVQPGGIGGTFGGNPVSTAAALAVFEVVERENLLDEAKRVERALWARIGDWAERFPVVGEVRGKGAMFGIELVVPGTKKPNPEALRAVLAHATGNGVIPLDAGSWDSVLRLLPSVVISEELIDDAATVIEAALERLG

SEQ ID NO: 24997 - protein, 325 aa, Oryza sativa Japonica Group
MAAPDMSPKAGKPLVQNDAGSYLAWSGKDQPTLAGEKLGCGLLVLKPLGFALPHYADSGKFGYVLGGSAVVGVLPVGVDARERVVRLEAADVIAMRAGEVTWCPGDFSYFILAGPMSVLGGLDAGLLATASGLTSPEQAATAFRSQPAALLTRLSRKLHGVRPREHDRHGIVVNAARVPPDSTGGKTVTAAHLPALAQLGLSVGLALLDAGAAVRGPWVLRDAAAQAVYVARGSGRVQVASAGGASTLLDAEVAAGSLLVVPRYAVALVAADDAGGMELVSLIKSSRPAMEHFTGKGSVIGGLTPEIVQAALNVSPELVEQLRTK

SEQ ID NO: 24998 - protein, 130 aa, Blastopirellula marina DSM 3645
MSITLFPEVSRTAEEELSLTLAHPLAQAPIEDEEDDDVEDEEYEEDDEEWEEEEDDDEEYEEVEDDEEEDDDEEYEDDDEETEWEEVEDDDADEDDEEEEYEDDEYEDEDEYEDDEDDEEEGEEWDDSEE

SEQ ID NO: 24999 - protein, 748 aa, Escherichia coli CFT073
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDFAEAENLAQRSLEAQLATEVRHQVAAFMERRGMGGLIRGGL

SEQ ID NO: 25000 - protein, 174 aa, Arabidopsis thaliana
MEMLLLSHNSHCLLHSPINSNYLNHLMRHGFGQNMCLDNITNNNNFQHPGVSNTQEYSPFLSVQASAVNNYGLNNHLMQRQDQLHGFDQNMCMMSEIINKNNVLQYPNLSNTVPHEFSSGFNQNTYGNAVGNTSFSQDMFSSYDPSSLLHTSSLPPLHNNSNSYCFSDNSRLLC

SEQ ID NO: 25001 - protein, 192 aa, Leptospira interrogans serovar Copenhageni str. Fiocruz L1-130
MFLLIDNYDSFTYNLYQYFSQIGNEIEVYRNDKITLDEIKHLSPKAIILSPGPGRPEDSKVCLDVIRELGGKLPILGVCLGHQAIGLVHGGKIVSAPSIMHGKISLVEHDGKDIYKGISSPFVATRYHSLVIQPESLPKELEIASKTPDGVIMGVRHKTKKHLYGVQFHPESIMTGAGLDLIRNFSSIVQEL

SEQ ID NO: 25002 - protein, 119 aa, Triticum aestivum
PCVLHLATLIGTEIDRVKCPFYFKSGACRHGDRGYRLHNRPTTSATIVLANMNQRPDMRTPGVDAQGVAIAPEKKQEHYEDYYEDIYAELNKNGEVETMNVCDNHADHMTGNDSVQCTE

SEQ ID NO: 25003 - protein, 429 aa, Halobacillus dabanensis
MTISNQKTDMSVFENYESEVRSYSRSFPTIFEKAKGYQLWDKQGKDYIDFFAGAGALNYGHNDDAMQQRLIEYIQSDGLLHSLDMATNARAAFLQKFNEVILKPREMDYKIMFPGPTGTNTVESALKIARKVTGREKVVTFTNAFHGMTIGALSVTGNAFKRHGAGIPLTYSMAMPFDDYMDGIDSLDYLEKMIEDGGSGIDLPAAVILETVQGEGGINAASFEWLKRVEELCHRLDILLIVDDVQAGCGRTGTFFSFEQAGISPDVICMSKSISGSGLPMAITLIKPEYDIWGPGEHNGTFRGNNLAFVTAAEALNHWKTDAFSESILSKSELFKKRLNQFVDEYPELQGEVRGRGLMLGIASAKAGLSGQLAEAAFERGLIVETSGPDDEVLKMLPPPMIDEEGIEKGLDIIEESIKAVLGKEEVTV

SEQ ID NO: 25004 - protein, 245 aa, Triticum aestivum
  misc_feature (73)..(74): Xaa can be any naturally occurring amino acid
  misc_feature (76)..(76): Xaa can be any naturally occurring amino acid
  misc_feature (78)..(78): Xaa can be any naturally occurring amino acid
IEQVCTKKQAGTGPEFPGYRRPTRPGGAKGGIGCSPGDLSISELERLTRVFTQKIHDLIGIHTDVPAPDMGTXXAXQXGIWILDEYSKFHGYSPAVVTGKPVDLGGSLGRDAATGKGVLFATEALLAEHGKGIAGQRFVIQGFGNVGSWAAQLITEAGGKVIAISDVTGAVKNSNGIDIAKLMKHSAENRGIKGFDGGDAVDPTSLLTEECDVLIPAALGGVINKDNADAHQAKYIIEAANHPTD

SEQ ID NO: 25005 - protein, 364 aa, Chlamydophila caviae GPIC
MGHTECGIVGLPNVGKSGLFNALTGAQVASCNYPFCTIDPNVGIVPVIDNRLDVLAKMSQSQKVIYADMKFVDIAGLVKGAADGAGLGNRFLSHIRETHAIAHVVRCFDNDDVTHVSGKIDPADDISVINLELIFADFSSATSIHSKLEKQAKGKKDLGVVLPLLDRVIKHLESGQPVRTLDLSPEEQIQLKPYPFLTAKPMLYIANIGEDSIATMHNDYVAIVQEVAKKENAQVVPICVQLEEEVISLPVEERQDFLNSLGLQESGLNRLVRAAYHTLGLISYFTTGPQETRAWTIPIGSTAAEAAGQIHTDIQKGFIRAEVVTLEDMIAYEGRSGVREAGRLRAEGRDYIVQDGDIMLFLHN

SEQ ID NO: 25006 - protein, 199 aa, delta proteobacterium MLMS-1
MATELNCHRVHFVDSVFDLAKLPAGELPEIAFAGRSNVGKSSLINCLLGRKNLVKVSAKPGKTRSLNFYLVDERLHLVDLPGYGYAKVDKRMQEQWRQLVGGYLEKRDNLRCVVVIIDLRHELKELDRLLAQWLRDIGVAFLLVYTKMDKLSRNQQQRQARLLDGGLGISPEQRLLFSAKSGEGRPELLAKLAAFVDQP

SEQ ID NO: 25007 - protein, 124 aa, Arabidopsis thaliana
  misc_feature (53)..(53): Xaa can be any naturally occurring amino acid
MQMLRNLSTRTRSRRGGYERVSDDSTFSLLGAKLRRSTSVPYYAPSIRLGGDXPVILEKLPRQKPTKTVVTSKLSHPIFSLFDGYRRHNKKKATAKPEFSRYHEYLKESGMWDLRSNSPVIYFK

SEQ ID NO: 25008 - protein, 36 aa, Glycine max
MVRLATYFAMTFGAFLFWQSMDRVHVWIAFYLDVMK

SEQ ID NO: 25009 - protein, 161 aa, Oryza sativa
MARIKPQALLQQSKRKKGPSRISAETVIFYFLILALVGFFLFASYRHWSSRSRLQSEDHLSVSEGENTFVDSKKSELPGYAVLNTSKGSIIIELYKESAPEVVDEFIDLCQKGHFKGMLFHKVIKHYVIQAGDNQGSGATEDWNLRGKAHTITSMKHEAFM

SEQ ID NO: 25010 - protein, 535 aa, Burkholderia xenovorans LB400
MPIIESKLNPRSDDFRANAAALEALVADLRAKIEKLALGGGQAARDKHTGRGKLLPRDRIAQLLDPGTPFLEFSQLAAYGMYHNDAPGAGVITGIGRIAGQECVIVCNDATVKGGTYYPVTVKKHVRAQEIAAENHLPCVYLVDSGGANLPNQDDVFPDRDHFGRIFYNQANLSAAGIPQIAVVMGSCTAGGAYVPAMSDESIIVRNQGTIFLGGPPLVKAATGEVVSAEDLGGGDVHTRLSGVVDHLAQNDAHALGIARSIVGNLNRRKQVPVALQEPKPPRYDVKSMYGVIPVDTRKPFDIREVIARIVDDSAFDEFKARYGTTLVTGFAHIWGHPVGIIANNGILFSESALKGAHFIELCCQRKIPLVFLQNITGFMVGRKYENEGIARNGAKMVTAVATARVPKFTVIIGGSFGAGNYGMCGRAYSPRFLWMWPNARISVMGGEQAASVLATVKRDGIEGKGGTWSAEEEEAFKQPIREQYEHQGHPYYASARLWDDGVIDPAQTRDVLGLGLSAAMNAPIEDTRFGVFRM

SEQ ID NO: 25011 - protein, 525 aa, Oryza sativa
  misc_feature (80)..(80): Xaa can be any naturally occurring amino acid
  misc_feature (98)..(98): Xaa can be any naturally occurring amino acid
MAPPRAQRTMLVVAGDAPPTAGGGTKFPAPPPERDHTQDLPDEILSLVFASLTPTDRNACSLTCARWKEVDASTRHRPLXLDARPRRSGYAAQGIFAXRFTAVSKLALRCARGSGTDSLSDDGARQVAAALPSARLARLKLRGLRQLSDDGLASLAGATPVIRKLSVASCSFGPKAFVAVLRSCPLLEDLSVKRLRGLPDTAGATTAITEEILFPPASSLRSVCLKDLYSALCFVPLVASSPNLRSLKILRCSGSWDLPLEVIAARVPGLVELHLEKLQVGDRGLSAVSACANLEVLFLVKTPECTDAGIISVAEKCHKLRKLHIDGWRTNRIGDHGLMAVARGCPDLQELVLIGVNPTVQSLRMLGEHCRSLERLALCGCETVGDPEIICLAERCAALKKLCIKGCPVSDRGMWALNGGCPSLVKVKLKRCRGVSYECIENLKVVRGGSFSISLDIVLERDAGGAIENGGQEAGQVQITELTDQMAAMDLPTNASNAQSSAQASSRMRSVMSALRRRFGNPPAL

SEQ ID NO: 25012 - protein, 770 aa, Methanopyrus kandleri AV19
MKYVRWFEEISKDDVDVAGGKGANLGEMTQAGLPVPPGFVVLSTAYDEFLERTGLKEKIKEILSSHDLSDNDELQEAAEEIQRLIVEVEMPEEIREEIVKAYRELCEKVGKEEEFVAVRSSATAEDLPEASFAGQQETFLNVQGEEDVVKYVQKCWASLFTPRAVAYREEQGFEHLDVSIAVVVQKMVDSEKSGVMFTVHPYTGERDKMVIEAVWGLGEAVVSGEVTPDTYIVDKNTFEVIEEQISEQEWMYTKDPETGETVKAEVPEDKRDARKLTDEEIKELAEIGVAVEEHYGFPQDIEWAIEDDEVYVLQSRPVTTIPEEKGGEEEIEAEELEGKILVRGLGASPGIGTGEVKIVMDVDEIDKVEEGDVLVTKMTTPDMVPAMRKASAIVTDEGGITCHAAIVSRELGIPCVVGTGNATEVLEEGQVVTVDGERGVVYEGDVRKALRAEEEEEEREEKEIVVERPAAEPVTATEIKVNVSMPEAAERAAKTGADGVGLLRIEHMILGVGVHPRKLIEEGEREKLVQVLMDGIRKVADAFYPKPVWVRTLDAPTDEFRELEGGEREPEETNPMLGWRGIRRDLEERETLECQFEAIRRLHQEGYDNIGVMIPLVQHPEELRRAKRIAKEVGLKPHRQVEFGMMVETPAAAVLIDEFIEVGLDFVSLGTNDLTQYTLAVDRNNDKVAYLYDEKHPAVLRLIKHVINECKEAGVKTSICGQAGSDPKMAEILVKAGIDSISANIDAVPQIRRIVARVERKILLDKMREF

SEQ ID NO: 25013 - protein, 227 aa, Zea mays
  misc_feature (219)..(219): Xaa can be any naturally occurring amino acid
MSSPWSPMSLEEEEEIQELDAEEQQDGEQPQQGDGLQQGSTAEARAQQTGKKRARSVANSSTKSEAKIKVEESAPGAATGVILSLRERNNILLLCSLQDCKQSLASCQVELEAAKSEIEKWHSAFQSIPAVPSGTSPDPVSVVSYLSNLKSSEESLKEQLEKAKKREAAFIVTFAKREQEIAELKSAVRDLKTQLRPPSMQTRRLLLDPAIHEEFTRFXNLVEEKEK

SEQ ID NO: 25014 - protein, 175 aa, Brassica napus
MRGLVKKLVSRSLSVAGKWQNQQLRRLNIHEYQGAELMGKYGVNVPKGVAVSSLDQVKKAIDQVFPNESELVVKSQILAGGRGLGTFKSGLQGGVHIVNRDHAQDIAGKMLGQVLVTKQTGPLGKVVTKVYLCEKLSLVNEMYFSIILDRKSAGPLIIACKKGGTSIEDLADKFP

SEQ ID NO: 25015 - protein, 705 aa, Bordetella parapertussis 12822
MTNPDFEHIKPVVSVARHRNVAVLSVDNPPVNALSDTVRAGLCSALREAEADPAVRAVVLACEGNTFVAGADIREFARAKGAAEAIDVPAVIESCRKPVVAALHGQALGGGLELALACHGRVALAGCRLGLPEITLGLIPGGGGTQRLPRLIGLEAAAELILSGATIDAETARESGLLDAVWPDRLRERAIEFAASLADSSAGVRRASTLAHPPMSPQTGQDLRKIAESRPAALRAPQAGAPAVEALSAAAQPDFARGRALERELFARLRDGEESRALRALFFAERSARRVGLDDATSAPPMAHDAAVVGAGTMGRGIAIALADAGLRVRLIDVEQASLDRALEAIRAHYRSLAARGRMTEAAARDAVARISPASDMQAAAEADVVVEAAFEDLAIKQAIFRQLDSIVRPGAVLATNTSTLDVDAIAAATRRPQDVVGTHFFSLANVMRLLEVVRGARTAPRTLGAVLALGRRMGKVCVTVGVCDGFVANRMSAHRARQIELLLQHGALPQDIDQAAREFGFSMGPCAATDLAGLDISWRIRRGKGARSPIADALCELGRFGQKVGRGYFSYAPGSRVAVPDPEVEALIRRMAEQLGIRRQSFDLATITDRLILPVINEGARVLQDGVARRASDIDLIWVHGFGWPARRGGPMFHAERVGLASVCDRLARLADALEDASLQPAPLLRDLATRGAGFASLHAARQA

SEQ ID NO: 25016 - protein, 273 aa, Arabidopsis thaliana
MPTRNIAIGGVQEEVYHPNALRAALAEFISTLIFVFAGSGSGIAFNKITDNGATTPSGLVAAALAHAFGLFVAVSVGANIAAALAHAFGLFVAVSVGANISGGHVNPAVTFGVLLGGNITLLRGILYWIAQLLGSVAACFLLSFATGGEPIPAFGLSAGVGSLNALVFEIVMTFGLVYTVYATAVDPKNGSLGTIAPIAIGFIVGANILAGGAFSGASMNPAVAFGPAVVSWTWTNHWVYWAGPLIGGGLAGIIYDFVFIDENAHEQLPTTDY

SEQ ID NO: 25017 - protein, 479 aa, Novosphingobium aromaticivorans
MTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQSATEGGH

SEQ ID NO: 25018 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGGAKKVIISAPSADAPMFVCGVNLDAYDSKYKVISNASCTTNCLAPLAKVIHDKFGIVEGLMTTVHATTATQKTVDGPSNKDWRGGRSVGNNIIPSSTGAAKAVGKVIPSLNGKLTGLAFRVPTVDVSVVDLVVRLEKPASYDEIKQAIKEASETTHKGILGYTEEKVVSTDFTGNDNSSIFDADAGIALNKNFVKLISWYDNEWGYSRRVCDLLAYAAKVDGAL

SEQ ID NO: 25019 - protein, 203 aa, Aspergillus oryzae
MASEMQNSNPTILNAADLPKRLRPAPSRKPGIFGNGLFASALPFVYASKLPPEGFTSSSESESDDDDLLEEPIDEQEIYDLVSTISDPEHPISLGALAVVSLPDISITPTLPYVPASPLRTVTVLITPTITHCSLATVIGLGVRVRLEQSLPPRFRVDVRIKEGTHSTADEVNKQLADKERVAAALENGTLMGVIAKMLETCQ

SEQ ID NO: 25020 - protein, 275 aa, Candida glabrata CBS 138
MAENQARRNSYGNIDFTEEVSKQCLKQVEFYFSESNFPYDKFLRTTAEKNDGWVPITTIATFNRMKKFRPVDKVVEVLRTSEILEVSENGENVKRRVPLVWNRNDEKFKEAKLEQNKRTLVVMNFPHDEEAGQAQEKKEGEEEKEDKDLQVEIEEFFRKLAQVNQVRLRRDHKKNFRGTVFVEFKNYDECKKFEDEYSAGSKDDKEGGEILSFKGKRLNILTKKQYDMQREATRSKNFSGSGQRSRSFTGHRKNMPKPSKKKDQDSENSSAIAEE

SEQ ID NO: 25021 - protein, 403 aa, Campylobacter jejuni RM1221
MLELNKIYKAKQQISGFVNKTPFIYSSFLSDICQSEIYLKNENLQITGAYKIRGAYNKIANLSAEQKQHGVIAASAGNHAQGVAISAKKFGIKAVIVMPESTPLLKVSATKALGAEVILKGDNFDEAYVFATSYAKENNLSFIHPFEDEFVMAGQGTLMLEMLDEISDLDMIIAPVGGGGLISGIASAAKQINPNIKIIGVGAKGAPAMYESFHAKKIKNAKSVRTIADGIAVRDANPINFNIILECVDDFIQVDDEEIANAVLFLLEKHKIIVEGAGAASVATLLHQKINTQNHKKIGVVLSGGNIDAQMLNIIIEKGLFKSYRKMQIHVTLVDKPGALLHLTDSLKIANANIVKIDYDRFSTKLDYGDAMISITLETKGKEHQEEIRKILTQKAFNFYESF

SEQ ID NO: 25022 - protein, 183 aa, Prochlorococcus marinus str. MIT 9211
MIKYRLLLRLVAFLLGGFLLITPYSSAHAVLQEGDEVPNYVRSQITGIDLHGQDLSKSSIAGATARDANLSDVDLHGTVVTLADLKGSNLNGIDLTDTLSDRVNFQKTDLRNAVLVNMIASGSSFAGALIAGADFSDSVLDRDDQRNLCEIAEGVNPKTGIATRDSLECSDNLGGYKPAMPGS

SEQ ID NO: 25023 - protein, 419 aa, Zea mays
MASFSGHLHRPLSAMAVAAFAAISSHELPDKLSHHRFPDASTGTDALASLPLTRSDVPAAPSASALSGAQLLPRDLHSLRLLKAPFASVPVMQTVYQYANFAKTSGQADAMPAIPSSPSDVLYRWHLPDPRVYADFPDKSQTVVVLLGWLGSRQKHLKRYADWYTSRGFHVVTFTLPMSDILSYNLGGKAEKNVEMLSEHIADWVREESGKKIIFHTFSNTGWLCYGVILENLQQHDPSAVDKIKACVVDSAPVAAPDPQVWALGFSAALMKKRSVTTKGLGSDDSRSDVLVVESNKELKLGATEAVILSALESFFDVVLNYPKINRRLCDVMELLSWKQPKCPQLYIYSSADRVIPAKSVEAFIDGQRKAGHEVRACDFVSSPHVDHYRSNPGLYSSQLANFLEDCVLAKRCEGACTS

SEQ ID NO: 25024 - protein, 610 aa, Rhodospirillum rubrum ATCC 11170
MEMDTMFLAILIGAGLIGISVVTSLISFRVGAPLLLVFLGVGLLAGQDGIGGIVFNDSGTAYFIGSLALAVILFDSGFSTRLQTFRLAAAPSIVLATLGVALTTALVAIPSHSLLGLSWEESALMGAVVGSTDAAAVFFLLRVGGILIRDRVRATLEVESSTNDPMAIFLTITLVELASAGGFSGEALSWGLGLAFVRQMGLGLLCGWIGGHLLVVGINRLRLEPALYPILGLALALFLFAAVSMVDGSGFLAIYVAGMVMGNRKMRGGPALRRFQEALTWLAQMTMFLTLGLFASPSTFIDVALPSVLIGLFLVFVARPVAVWLCLLPFGYDRNETAFVAWVGLRGAVSILLAILPIAAGLEHAQEMFNAAFIVVVTSLLLQGWTIRPMARWLGLVVPPRLGPVDKVELQLPYGGDHELLVYRIAKGSPVAEGERIPRWARPSLVVRDGRSMKVLDSGRPQPGDHVYIFSAPRHGALLDRLFARPTALSPADEAYFGDFSLDASRTMGELATLYGIKVPEGAQDTAVGEWLTQRLGGAPARGDRVVLPPIEIIVREMDNSTDVIRTIGLSLDPGEGRPRRVPMFHNARDIIGSVRDWRAARRRFAAKNS

SEQ ID NO: 25025 - protein, 320 aa, Blastopirellula marina DSM 3645
MADKFWLFRFEASTVMRNLLSLFDLSTAEMESIFSIAADLKAKLAKGIREPLLQGQVMGLLFEKQSLRTRVSFETGMAQLGGSSLFLGEDVGWGKREAPQDFGRVISQYLDVIVCRAKSHEKVVELATHCTCSIINGLTDLFHPCQALADLMTVQESFGKLKGLKIAYIGDGNNVSRSLALACAKMGAEFMIASPKGYELDQPFLVRVDQACPDAVVQQTNDPFEAVDGAVAVYTDVWASMGQEAEQAKREVDFADFQVNKKLMDAAAQEAIFLHCLPAKRGQEVTDEVMDCPTSRIVEQAGNRMHAQKGVLVWLANQNG

SEQ ID NO: 25026 - protein, 369 aa, Kluyveromyces lactis NRRL Y-1140
MMRTRFIQLSRRAYASNAKNLTIGLIPGDGIGKEVIPAGKKILESLNPKYGLSFKFIDLQAGWETFQNTGKALPDETIDILKNQCEGALFGAVQSPTTKVEGYSSPIVALRKNLGLFANVRPVKSVDGTKDRKVDLVIVRENTEDLYIKLEKSYIDEATGTRVADATKRITEIATKNIATIALQIAQQRLEQNGHATLTVTHKSNVLSQSDGLFREVCRETYEANKDKYGGVQYNEQIVDSMVYRMFREPECFDVVVAPNLYGDILSDGAAALVGSLGVVPSANVGPNIVIGEPCHGSAPDIAGKGISNPIATIRSTALMLEFLGYPEPAKDIHKAVDANIREGKYLTPDLGGNSTTQQVLEDVLSKLD

SEQ ID NO: 25027 - protein, 408 aa, Blastopirellula marina DSM 3645
MSTTQDRSNVGQLSSADTAELFKQYVVPNYGRYPVSLVRGEGSRVWDAEGKEYLDFFPGWGCNLLGHCPDTIVAAVQEQIATLIHVPNSWLIEAQGQWAKLLSERSFGGQAFFCNSGTEANEAAIKLARLHTPPQRYKIITFQGGFHGRTFGATSATAQPKYHEGIGPLLAGFSYAPFGDLEAVAQLIDDQTAAIMVEPIQGEGGVRIPPEGFLAGLRKLADEHELLLIFDEVQTGCGRTGHWFGYQHFDVTPDILTLAKSLCGGVAGGALLTTKEIAPSLRPGMHAATFGGNPIAARAGIAAIEMIERDNLLENVAVLSEIFRERMTALQAECDLIQEVRVIGMMIGVELAIEGAPAVKACLEKGLLINCTQGNVIRLLPAMNLTPEEVHQGCDILVDVIKNMAPAS

SEQ ID NO: 25028 - protein, 472 aa, Idiomarina loihiensis L2TR
MTAIKPETETEFDVVVIGTGPGGEGAAMQLAKSGYNVAIVEKHKALGGGCTHWGTIPSKALRHSVSRLIEYNNNPLFSGPGWQSGMTFSHILHYAESVIRKQVKLRSSFYDRNDVTVVHGTASFLDKNRIRVTKLDGSVDDLITKHVVIATGSRPYNPKDVDFSHPRIYDSDKVLSLSHEPKTILIYGAGVVGSEYASIFRGMGVKVDLINQRERLLSFLDAEISDALSYHLRNSGVVIRHNEEYESITGHDDKVVLKTKSGKTMAADCLLFANGRSGNIEQLDCQAVGLEPNYRGQLEVNENYQTSVDNIYAVGDIIGYPSLASAAYDQGRICASAIINGNCDKALISDIPTGIYTIPEISSVGKTEEELTEMKVPYEVGRAQFKHLARAQISGADVGCLKLLFHRETRELLGLHCFGERASEIIHIGQAIMEQKNGGNTIDYFVNTTFNYPTMAEAYRVAALNGINRLLL

SEQ ID NO: 25029 - protein, 531 aa, Triticum aestivum
  misc_feature (105)..(105): Xaa can be any naturally occurring amino acid
MGACLSSSKQEADAERRRRQRPRGGKAEEKGAAAEAPAVEFGYERDFEGRYEVGRLLGHGQFGYTFAAVDRLSGDRVAVKRIDKAKPLRIIWCRCSFRIAYLFAXMTRPVAVEDVKREVKILKALKGHENIVHFDNAFEDDSYVYIVMELCEGGELLDRILTKKKKKYSEKDAAVVVRQMLKVAAECHLRGLVHRDMKPENFLFKSTKEDSPLKATDFGLSDFIKPGKKFRDIVGSAYYVAPEVLKRRSGPESDVWSIGVITYILLCGRRPFWDKTEDGIFKEVLRNKPDFRKRPWPSISSSAKDFVKKLLVKNPRARLTAAQALSHPWVREGGDASEIPVDISVLYNMRQFVKYSRFKQFALRALASTVNEEELADLKDQFDAIDVDKSGSISIEEMRHALAKDLPWRLKGPRVLEIIQAIDSNTDGLVDFKEFVAATLHIHQMAELDSERWGLRCQAAFSKFDLDGDGYITPDELRMHTGLKGSIEPLLEEADIDKDGRISLSEFRKLLRTASMSNLPSPSGVPNPQAL

SEQ ID NO: 25030 - protein, 292 aa, Blastopirellula marina DSM 3645
MEEAIQKADVLIEALGWIRRFRDKITVIKLGGSVMENPDALRHVLIDIVFMETVGMWPVVVHGGGASISRAMAAAMIEPRFIHGRRYTDDATLKIVEEVLAGEINEDIARKIEEIGGRAMNLNFKTTNVLFGEKMQLEGPAGESLDLGHVGAVTRVDRTTIENLCYAGQVPIIPSMAIDEATGQKLNVNADTAANAVAEALGAEKLVFLSDVNGVRTDKDNPTTLVHSLDGEKARSMMADGRIDAGMIPKVEACLQTLDRGVKKIHIIDGRLRHSLLLEIYTNMGVGTEIVH

SEQ ID NO: 25031 - protein, 480 aa, Glycine max
MVKICCIGAGYVGGPTMAVIALKCPSIEVAVVDISKSRIAAWNSDQLPIYEPGLDGVVKQCRGKNLFFSTDVEKHVFEADIVFVSVNTPTKTQGLGAGKAADLTYWESAARMIADVSKSDKIVVEKSTVPVKTAEAIEKILTHNSKGIKFQILSNPEFLAEGTAIKDLFNPDRVLIGGRETPEGQKAIQTLKDVYAQWVPEERILTTNLWSAELSKLAANAFLAQRISSVNAMSALCEATGANVQQVSYSVGTDSRIGPKFLNASVGFGGSCFQKDILNLVYICECNGLPEVAEYWKQVIKINDYQKSRFVNRVVASMFNTVSNKKIAILGFAFKKDTGDTRETPAIDVCQGLLGDKANLSIYDPQVTEDQIQRDLSMNKFDWDHPIHLQPTSPTTVKKVSVVWDAYEATKDAHGLCILTEWDEFKTLDYQKIFDNMQKPAFVFDGRNIVDADKLREIGFIVYSIGKPLDPWLKDMPAVA

SEQ ID NO: 25032 - protein, 637 aa, Idiomarina loihiensis L2TR
MIRAEAITLLRGGDVLFEDSDLQVFPGHRVGLVGRNGCGKSSLFAMLRGELSADSGNIHLPAEWRIASVAQDTPALDKSAIDYVMDGDAEFRQLEAQLAQAESDNNGEAIAHCHDKLASIGAYDIQPRTASLMAGLGFTQEQLQQPVKAFSGGWRMRLNLAQVLIARADLMLLDEPTNHLDVDAIFWLESWLKQYDGTLLLISHDRDFLDSVTTDITHIEHKKLNSYRGNYSLFERQRAEHMAQQQSEYEKAQVMRQHLQAYVDRFRYKASKAKQAQSRLKAIEKLPNQAPLRAESGIDFHFLTPEKLPNPLLTLRDAKAGYGDTTILEQIKLNLVPGTRLGLLGRNGAGKSTLIKLLAGELEPMAGERLVNPGLSIGYFAQHQLETLDLAASALLHLQRIDKQATEQKLRDFLGNFGFSGDQATRSVEPMSGGEKARLALALIIYQRPNLLLLDEPTNHLDLGLRDALVAALQEYEGALIVVSHDRHLLRTTVDEFCLVADGKAETFDGDLDAYHDWLQQQAANDKRSEQPATRQRDDRKQQKRKEAEARQKTKPLRQQIEKAEKNIHSLELTLADIHEQLSDSTLYDDANKAKLQKLLDQQAQAQKDLQQQENLWMTAEEELAELTEELQQAEDK

SEQ ID NO: 25033 - protein, 636 aa, Sorghum bicolor
MISARAATVAAASPASPWKRGGGRSEGAGSCDGCSTYRKTVRRRAAAAKVRALPPKRVEAVAIGSAAETETEEVVVEVAAANEELPVMPWATSVASGYTLLRDPRHNKGLAFTEKERDAHYLRGLLPPAVVSQELQIKKFMNNLRQYQLPIQCYMAMMNLQETDERLFYKLLIENVVELLPYVYTPTVGEACQKYGSIFGRPQGLYVSLKDKGRVLEVLRNWPHRNVQVICVTDGERILGLGDLGCQGMGIPVGKLALYTALGGVDPSACLPITIDVGTNNEKLLNDEFYIGLRQKRARGEEYDELMEEFMAAVKTFYGEKVLIQFEDFANHNAFDLLEKYSKTHLVFNDDIQGTASVVLAGLLAALKMVGGTLAEQTYLFLGAGEAGTGIAELIALEMSKQTKAPIEECRKKVWLVDSKGLIVDSRKSSLAPFKKPWAHEHEPLTTLYDAVQSIKPTVLIGTSGVGRTFTKEIVEAMASINERPIIFSLSNPTSHSECTAEQAYTWTQGRAVFASGSPFAPVEYDGKTFVPGQSNNAYIFPGLGLGLVISGAVRVHEDMLLAASAALADQATEENFVTGSIFPPFTNIRKISAYIAAAVAAKAYELGLATRLPPPKDLVAYAESCMYSPVYRNYQ

SEQ ID NO: 25034 - protein, 570 aa, Fusarium oxysporum f. sp. lycopersici
MSNSNLQKPIDVAEYLFKRLYEVGVRSVHGVPGDYNLVALDYLPQCNLKWVGSVNELNAAYAADGYARVTKMAALITTFGVGELSAVNGVAGSYSEHIPVVHIVGCPSTISQRDQMLLHHTLGNGDFDVFANMSAQISCNVAKLNKPSEIAEQIDTALRTCWLRSRPVYIMVPTDMVQEKVEGARLDTSIDLSEPQNDPGNEDFVVDEILKAMYAAQRPVILVDSCAIRHRVVKEVHQLIDKLDLPVFVTPMGKGAVNEDHPNYGGVFAGDGSHPARAQSIVEGSDLLLTIGALKSDFNTTGFSYRTSQINSVDFHSTHCKVRYSTYPGVAMRGVLRKIIDRVDPKSMPAPSIPEVRNEVEKNTDDSEIITQAWLWPRVGEYLIPNDIVVTETGTANFGIWDTRFPRNVTALSQVLWGSIGWSVGACQGAALAAKDAGKEGRTILFVGDGSFQLTAQELSTMIRHHLKPTIFVICNDGFTIERFIHGMDAVYNDINNWKYKDLVSVFGGEKTCKTFQIKTKTELNELLTNKEFNAAECLQFVELYMPREDAPRALIMTAEASARNNAKKH

SEQ ID NO: 25035 - protein, 360 aa, Synechococcus sp. RS9917
MDCKPRLGQDLSASPSTNDPLATVPSDRLWLRSELMGTQVITRDTGRRLGVVGEVIVDIDGREVVALGLRDNPLTRFLPGLPRWMLLDRIRQVGDVILVDSVDSLSESFNPERYSRVINCQVITESGQQLGRVLGFSFDIETGELTTLVMGALGVPLLGEGVLSTWEIPVDEIVSSGADRIIVYEGAEEKLKQLNSGFLEKLGVGGPSWEEQERERYRVNVVPVENQLSSGQPSEQEQRRLQASTAEPLAMEEELDYVELEERRVERAPRQRYLDELPEPFPEPAAARFDDRPDPYDDRRWNQDEPLRSLEREPERRPEPEPDRFSARPRPAARRPVEPVGDPLDVEPLDDTREILDDPW

SEQ ID NO: 25036 - protein, 428 aa, Chlamydophila caviae GPIC
MISLLKMPKLSPTMEVGTIVKWHKSNGDKIEFGDVLIEISTDKAVLEHTASEEGWFRECLIKEGTKVQIGTPIAVISSEKDESFNLEELLPKSPISQPSIENVEQGDVAASDVSHQNASMMVAFGFRPEPPLSEPLSLKQDSSKVPVSPLAKRLAKEKNLDISGIKGSGPGGRIVEKDLEKAPAKGIAGFGYPEAPEVHPGAYHEEALSPVREIIAQRLQAAKTFVPHFYVRQKVYTSPLLALLKELQAQGIKLSINDCIVRACALALKEFPEVNSGFNSIDNKIVRFETIDISIAVAIPDGVITPIVRCADRKNVGMISAEIKSLASKARSQSLKEEEYKGGSFCVSNLGMTGITEFTAIINPPQAAILAVGSVQEEPVVMNGEIVAGSTCILTLSIDHRVIDGYPAAMFMKRLQKILEAPSVLLLN

SEQ ID NO: 25037 - protein, 820 aa, Pseudoalteromonas tunicata D2
MSYQVLARKWRPQNFHQLVGQEHVKQALVNALTQQRLHHAYLFTGTRGVGKTTIARIFAKSLNCELGITATPCGQCSACLDIEAGRYIDLLEIDAASRTKVEDTREILDNVQYAPTRGRYKVYLIDEVHMLSKHSFNALLKTLEEPPEHVKFLLATTDPQKLPVTILSRCLQFNLSALSRPQIEQQLSFVLTEEQIHFEVASLALLAKAADGSMRDALSLTDQAIAQTNGQVNESQVKSMLGLMDASWAKRLLVSIVDKDGAELLSLVADLVKQNANAKSVLDDLLSLTHLLLLTQLVPSAAAFNEDEADFIDAMSKSLSPEQVQVYYQLLLGGKKDLQWAPDEKLGLEMVLLRLLAFEPHFSASNTISTVMPSALPSSNKAMSNIRQMLAGQASGDKLTAQTAQTAQTAQTAQTAQTTQTTQNNSPVPTASVESVVEHPAVAADKVQTPELAVVENASEPLISQSAVSAVPLDAVALNNSLESTEPEQSQDAWHQQYDEILTQAQEYREYSDLAHQANTVPDNSALMQQINQPEDHLVTDTVSLESQADLPTSAQLVEQQLSGAQSAIAAILRNRNISSHGLVKPESSSLPLSSINTPGDTEKKTEPQQRGNLVAQSQQQIRPNDEREDKAMVAYAAVEKPQSPRSSHVMDPAHLAPELLVQISEQPKVEEVAETQVIEIPEGFVSPLTDIRFAHQQDAWANLIEQMQLGGRIRQFALHGLFSQQDQNVTLQVDAQQQHLDSAVMREKLTESLSLALARDITLSIEFVNAVTGTPYQIQQQLDSNRWYHAKEVIENDAVTQQFMRRFAAVIDENSIRAL

SEQ ID NO: 25038 - protein, 181 aa, Pseudoalteromonas tunicata D2
MTQSTLDYIKASIATVPNYPKAGIMFRDVTSLIADPVAFKAVIDAFVAAYQAQGFDKIIGTESRGFIFGAPLAIALGIPFIPVRKPGKLPREVISQAYQLEYGEDVLEIHTDAISQGDKVLLVDDLLATGGTIEATIKLVERLGGHASDAAFVVSLPELGGEQRLEKLGINILKLVEFEGE

SEQ ID NO: 25039 - protein, 362 aa, Corynebacterium glutamicum ATCC 13032
MTLTDNSKNVDAVILVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 25040 - protein, 464 aa, Roseovarius nubinhibens ISM
MNMITNHMPTAELQALDAAHHMHPFTSGTELAAKGARVITRASGVTLTDSEGNEMLDAMAGLWCVNLGYGRDELAEAAARQMKELPYYNTFFQTTHVPAIALSSKLAELTPHDLNNVFFAGSGSEANDTNIRLVRTYWAEKGQPEKKIIISRKNAYHGSSVGSASLGGMQPMHAHGGLPIEDIHHIDEPNWYAQGGDMSPAEFGLERARQLEAAIEEYGAHRVAAFIGEPIQGAGGVIIPPETYWPEIQRICDKHNILLIADEVITGFGRTGKWFGCETLGIRPHIMTIAKGLSSGYAPIGGSLLCDEVAQVMNDCDFAHGYTYSGHPVACAVALENLRILQEEKIVDRAGSEVAPYLKEKWDTLNDHPLVGETALCGLMGSLALSPDPSSRAMFAADKGTAGLICREHCFANGLVMRHVGDRMVISPPLVITHAEIDTLVERARKALDLTHAELKDKGLMVAA

SEQ ID NO: 25041 - protein, 55 aa, Glycine max
MRKFDPWPVFFKREWKRNWPFLVGFAVTGALITKLSLGLTEEDAKNSKFVKAHKR

SEQ ID NO: 25042 - protein, 217 aa, Yersinia pestis CO92
MNQTLLSDFGTPVERVERAIDALRNGRGVMVLDDESRENEGDMVFAAEAMTLEQMALTIRHGSGIVCLCITDERRQQLDLPMMVTHNSSQFQTAFTVTIEAAEGVTTGVSAADRLTTIRKAIADNAKPADLNRPGHVFPLRGQPGGVLSRRGHTEASIDLATLAGYKPAGVLCELTNDDGSMAHAPEVIAFAKLHDMPVVTIDDLAAYLQSRAKKAS

SEQ ID NO: 25043 - protein, 461 aa, Aspergillus oryzae
MDELTRWQRNDLEKFNIESAVELSAYIPEAVLRAELHRRSGIRDSDNDKPSCGSKDRGVYNTPVHVMALFLILLLSTLACSFPVLARRFPRLPIPRRFLFLSRHFGTGVLIATAFVHLLPTAFVSLTDPCLPRFWSESYRAMAGFVAMVSVFVVVVVEMFFAMKGAGHVHGSEYDHLIGDVGGDTASVYRNEGPEYLQESTENIHLEGMPDGSCTSSLPQSSGHLLSDFTDDGSQSQSANLVAHKEDVEVDLEGPDSYDGSRTNAHRNPYSQSELARPSPAISCEHPDTMLTIQNPQRQLLQCLLLEAGILFHSIFIGMALSVATGTSFIVLLVAICFHQTFEGFALGSRIASLIPDLFAPSSMKPWLMSLAYGTTTPIGQAIGLILHNLYDPTSTAGLLMVGITNAISSGLLLFAGLVELLAEDFLSESSYATLHGRKRVEACIAVACGALLMALVGAFA

SEQ ID NO: 25044 - protein, 235 aa, Alopecurus myosuroides
MAGGNDLKLLGTWPSPYAIRVKLALAHKGLSYEYAEEDLANKSELLLSSNPVHRKIPVLIHNGVPVCESNIILEYIDEAFAGRSILPADPYERAMARFWAAYVDDKLLAAWATMVFKGKTEEEKLEGKKALFAALETLEGALAKCSDGKDFFGGDTVGLVDMVLGSHLSFLKATEAMAGEEILRSDRTQLLAAWMARFSELDAAKAALPDVDRVVEFVKMRQARLAAAAAAASNN

SEQ ID NO: 25045 - protein, 678 aa, Aspergillus nidulans FGSC A4
MSTEDNHDSQILTARHRSDASEQSFKSLFGGPSSEDGKETEPDTHDHNHSFSNAKAPAKFANQNVAPFLARHIPEQYAPLGAQSILPADLSSANSKYCYRHRPDQKCRRQADEPSMDKLQRELESLPQGDQQSISHVWSLFSAAPAKHRKLILQGIMAQCCFPQLSYISATVRDLIRIDFITALPPEIAFKILCYLDTTSLCKASQVSRGWRALADDDVVWHRMCEQHIHRKCKKCGWGLPLLDRKRLRESKREIELRATTWDKGVVGPRSPDASAESPPSGKRKLEDDEVAVVKRHCSSLGSDAGVDKDSDFFKTRYRPWKEVYKDRFKVGTNWKYGRCSIKTFKGHTNGVMCLQFEDNILATGSYDTTIKIWDTETGEELRTLRGHESGIRCLQFDDTKLISGSMDRTIKVWNWRTGECISTYTGHRGGVIGLHFDASILASGSVDKTVKIWNFEDKSTFSLRGHTDWVNAVRVDTSSRTVFSASDDCTVRLWDLDTKTCIRTFHGHVGQVQQVVPLPREFEFEEHDAECENDDLSTTSGDADPPSIQASMGLEPNAAYSQSSAFGTSFDNGRAAPPRYMVTSALDSTIRLWETTTGRCLRTFFGHLEGVWALGADTLRIVSGAEDRMIKIWDPRTGKCERTFTGHSGPVTCIGLGDSRFATGSEDCEVRMYSFQS

SEQ ID NO: 25046 - protein, 440 aa, Bordetella parapertussis 12822
MKITVVGTGYVGLVSGACLADMGNEVLCLDTDAAKVAMLREGHIPIYEPGLEDLVKRNVAGGRLQFTDDIAASVAFGDVQFIAVGTPPGEDGSADLQYVLAAARSIARHMTTRKVVVDKSTVPVGTADKVRAAMQEVLAERGVEVPFSVASNPEFLKEGAAINDFMSPDRIIVGADDEHTIDTMRRIYAPFQRTHERVMVMDVRSAELTKYAANAMLATRISFMNEMANLAEALGADIEQVRRGIGADPRIGYHFLYPGIGYGGSCFPKDVQALMRSAGEHALPMRVIEAAETANQAQKLRLAHKVVARYGADLQGRTFALWGLAFKPNTDDMREAPSLSTIADLTRRGARIRAYDPVAMPQAAKVLDDNPAVELVDDMYQALDGADGLLITTEWKVFRAPDLTRVKQMLKAPLIIDGRNLYVPADMRAQGFDYQGIGRA

SEQ ID NO: 25047 - protein, 235 aa, Alopecurus myosuroides
MAGGDDLKLLGTWPSPYAIRVKLALAHKGLSYEYAEEDLANKSELLLSSNPVHRKIPVLIHNGVPVCESNIILEYIDEAFAGPSILPADPYERAMARFWAAYVDDKLLAAWATMVFKGKTEEEKLEGKKALFAALETLEGALAKCSDGKDFFGGDTVGLVDMVLGSHLSFLKATEAMAGEEILRSDRTQLLAAWMARFSELDAAKAALPDVDRVVEFAKMRQARLAAAAAAASNN

SEQ ID NO: 25048 - protein, 959 aa, Vitis vinifera
  misc_feature (314)..(314): Xaa can be any naturally occurring amino acid
  misc_feature (338)..(338): Xaa can be any naturally occurring amino acid
MVLSIPGTSTLKPPKKRPFENHVHHQYQSFPPKFRRPKVDAVRDWPIWCGKFTPPTDSNVIGDNIAFGTAGNLQAPVANGIQGSPSTIDAEVTRDKVPRSYPPRKVLKNYPVVRDFPAGFKSASSSTNKNSASEKFNAEPRPLEIIETCPKSLGREMQGGRAFNGALERSSYEESNEVKRKIGGEVGETSGAVGEWVGDAKEVCILLGQEIQVGDSFQSALERSSCKETGNEIQNNFGGDVAETYKVEVKCGVDAKKMCTSLGQVKQGGGTCNRALKRSPWEATINEFWDKFGDVGETSGLLVRQGGDTKEIGXHPQLERNLLQLDPWCQTFGNKAGXGKSVLRSIGKEVEICSKDQSSMDHQTIVNNSRVQGALNLFQELLEKLTHEASLTMKKVIISKLHVEAAMTLKRQQKWVNTTKRLGHVPGIEVGDTFRYRVELCIIGLHSHFQNGIDYMEKDGKILAISIVDSGRYANDKESSDILIYSGQGGNPMVGHKQAEDQKLERGNLALKNSMDAKTPVRVTRGFQATKVTSQGYTYDGLYFVDKYWQEIGQFGTLIFKYQLKRIRGQPKCNLREFNESKKSKVRWKITFNDISRGRELNKPKKSKVRMKTILNDISQGKEERPIRVVNTIDDEKPQPFSYIARMVYLESSNWSIPSGCDCTDGCSDSVKCACVLKNGGEIPFNCSGAIIEAKPWIYECGPLCKCPPSCNNRVSQNGIRFPLEVFKTKSTGWGVRSRNYIPSGSFICEYAGELIQDKEAEQRVGNDEYLFDLGGGMNCLESQLNSFEAMDDLQSSSYKAKDYGAFAIDAAKFANVGRFFNHSCSPNLYAQNVLYDHDDKRMPHIMLFATKNIPPMRELTYDYNYMVGQVRDINGKIKKKRQFRRSIWVKFNPVFNVSGIAEIFNPVVPREGQLLMMKNGDLTVTQAFLESNDAGNTQRLLESNDETMGTISNDGIKW

SEQ ID NO: 25049 - protein, 499 aa, Aspergillus oryzae
MSYLPLPPRQLFYDGKVQSASSGKTFQSVNPSDATPLAEIQVASHSDIDAAIAAADRVFPSWSQTPPIARARILQKASLILRERNDEIARVESLDSGKAFTETSTVDVVTGADVLEYYANLVGGGGLNGETTQLREDAWVFTKKAPLGVCAGIGAWNYPIQIALWKSAPCIAAGNTMVYKPSEFTPLHAQTLAEIYKEAGLPDGVFNIVYGAGDVGAYLTSHPTIAKVSFTGQVATGMKVAGSAAGNMKYVTMELGGKSPLVILPDAELENAVDGAMMANFYSTGQVCTNGTRVFVPSSMKAAFENRLLEKMQYIRPGPLFDEATNFGPLSSAIHLEKVISYIRHGIETDKATLLYGGLGKPQVSKELENGFWVRPTIFTDCKDDMLIVKEEIFGPVMSILYYETIEEAVRRANTTELGLAAGVFTKDVNLAHRIIDQLQAGITWVNTWGESPAEMAVGGWKKSGLGVENGRRGIEAWVKNKSTLVDMNGAVATVFAKL

SEQ ID NO: 25050 - protein, 317 aa, Coccidioides immitis RS
MATEVTGTRFTLNTGVEIPALGLGTWQSAPGQVQAAVYHALKVGYRHIDAALCYQNEKEVGRGIAQAVREGIVRREDIFVTTKLWNTYHRRVEEGLETSLKDLGLEYVDLYLMHWPAPMNPNGNHPLFPKLPDGSRDIDWSRSHIDSYKDMEKLLASGKVKAIGVSNYSLKYLQQLLEHVSVVPAVNQIENHPLLPQQEIVDFCREKGIMVTAYSPLGSTGGPLMTSDAVVEVARRKGVSPSTILLSWHVARGSCVLSKSVTPSRIEANLHLLKLDEDDMKIIAKFTAESVSRNGFTRFVYPPFGIDFGFPDKTLKD

SEQ ID NO: 25051 - protein, 182 aa, Brassica napus
  misc_feature (4)..(4): Xaa can be any naturally occurring amino acid
  misc_feature (14)..(14): Xaa can be any naturally occurring amino acid
  misc_feature (16)..(16): Xaa can be any naturally occurring amino acid
  misc_feature (34)..(34): Xaa can be any naturally occurring amino acid
  misc_feature (67)..(67): Xaa can be any naturally occurring amino acid
  misc_feature (112)..(112): Xaa can be any naturally occurring amino acid
  misc_feature (114)..(114): Xaa can be any naturally occurring amino acid
  misc_feature (162)..(163): Xaa can be any naturally occurring amino acid
  misc_feature (166)..(166): Xaa can be any naturally occurring amino acid
  misc_feature (168)..(169): Xaa can be any naturally occurring amino acid
  misc_feature (174)..(174): Xaa can be any naturally occurring amino acid
  misc_feature (180)..(180): Xaa can be any naturally occurring amino acid
MAAXLGLRLKAAYXTXEERSSCYSSSKDLLVGKXRKGRRGFCSEAREGRTNNQGIGRPLAKILKELXNKKVPDSAIKTRVEDGFSMKYIPWHTVNRIMNLHAPEWSGEVRSXTXSPDGNTVTVAYRVTLYGTDAEIYRESTGTTSVNDKGYGDPVQKAEAMXXPRXCXXLGLGXHLYHEXAL

SEQ ID NO: 25052 - protein, 180 aa, Picea sitchensis
MKISTLGSLTINSQLSSPRGQTLAGLMSQTSPRSNPISSNQLSPGNRVLRASASFNGRTISASCATEGKRDIPFRRVKDHYALLGVPSHASCSDIRVAYRRLALKYHPDVMPLHQLETATELFSEINKAYDTLSDPQKRKAYDDLYVIPNFETARAAACPSSSSFGHWRGRNWETDQCWC

SEQ ID NO: 25053 - protein, 366 aa, Corynebacterium diphtheriae NCTC 13129
MMTRLPLGATLPDFPWDSLADAKKTASSHPDGLINLSVGSPVDEVAPGIRLALAEAAAAPGYPQTIGTQELRAAIVDSLQRRYHATSLGGVLPVVGTKEAIALLPTLLGIRGTVVIPEVAYPTYEVGALMAGATPLRCDAPHELPNDDIDLVFINSPSNPTGRVASVEELRSIVAWAQANDVIVASDECYLGLAWDGEAVSILDPRVNDGNLSNLLAIHSLSKSSNLASYRAGFLAGDEALIAELTEIRKHSGLMVPGPIQAAMVEALRDDDQEALQKLRYARRRALLMRALIDAGFTVEHSEAGLYLWATRGENCRATVDWFASHGILVAPGDFYGPDAHNFVRVALTTTDDNAEKVAARLQKGN

SEQ ID NO: 25054 - protein, 270 aa, Glycine max
MVRFSNNVIGLLNFLTFLLSIPILVAGVWLSKQGATECERWLEKPVIALGVFLMLVSLAGLVGACCRVSWLLWLYLLVMFVLIVLLFAFTIFAFVVTNKGAGEVVSNRGYKEYRLGDYSNWLQKRVNNTKTWNRIRSCLQSGKVCTEFQSKFLNDTVTEFYSENLSALQSGCCKPAEECQFSYVNPTTWTKPTNVTNQSNPDCDAWNNDPTVLCFNCQSCKAGLLQNLKTDWKRVAVVNIVFLVFLIIVYSIGCCAFRNNRRENWKGYSR

SEQ ID NO: 25055 - protein, 565 aa, Herminiimonas arsenicoxydans
MKPFRFSFRPSLLKDLRGYDVPAFFRDLSAGLTVGIVALPLAMAFAIASGVKPEAGIFTAIIGGFLISALGGSRIQIGGPAGAFIVIIYGIVEKYGVANLLIATIFAGLMLCAMGFFRLGSLIRYIPVPIVIGFTNGIAVLIALSQMKDFFGLHIEKMPGDFFAQIQTLTANAHSFNLASIAIALVSLLLIFIWPKLWQAKPNTMDEVIGGKDKRILRILRAFPGTILVLVLATLAVSLFDLQVDTIGSKFGGIPQGLPSFALPHFTWELVKQLFPPALTIALLGAIESLLCARVADNITGDRHDPNQELMAQGCANFIVPFFGGIPATGTIARTVTNIRAGAVSPIAGILHALTLLVIVLVAAPLASNIPLAALAAILLYVAYNMGEWHEFARLRHFSMNYRILMLATFLLTVIVDLTVAVQVGLVLACVFFIYRISSLTRIELIPPDRLSTPLPHGVLAYSIFGSLFFGAVDKLEGLIEAESMPEQALILELHQLINLDATGLDALETVRKTLQKKGSQLILCGPNRQPLDLMRRSGFLARLGPQNCLDNLPDALARSAALAA

SEQ ID NO: 25056 - protein, 58 aa, Salmonella enterica
MSFLPVIMAGGTGSRLWPLSREYHPKQFLSVEGKLSMLQNTIKRLASLSTEEPVVICN

SEQ ID NO: 25057 - protein, 435 aa, Roseovarius nubinhibens ISM
MGILASLRSARRNILSIIPEIATKQPMVSGRTGKRWHMVMDPGAIRRILLEELDNYPKSLVTKNLLRPAVGESLFIAEGDHWRWQRRAAAPAFSHRNVLNLAPVMSGAAGRSADRVAAAGGQAIDMAEDMVRTTFDVISDVTFSGGDAFDADGVHRAIDDYISAAGKISLFDILGFPDWVPRPARVAAGPGMRQMKALADRAVNDRRARGHDGTPDLLDLLLAGEDPETKRKMNTAELRDNLLTFIVAGHETTALTLAWSLYLCAFDQEVQDRARAEAKAVLTDGQPATGEDVAKLPFIRQIADEALRLYPPAGMISRTALKKDRLCDRDIRPGDTVIIPIYALHRNHLLWDDPDHFRPERFADRKAVDRYAYLPFGDGPRICIGSSFALQEAVIILATLLARFRFRPIAGRDPKPVMILTLRPEGGVWLTAEEL

SEQ ID NO: 25058 - protein, 554 aa, Synechococcus sp. RS9917
MAARWRGLSIHGLDPSQWRGDLLGGLTAAVVALPLALAFGNAALGPGGAISGLYGAIVTGFLAALFGGTPAQVSGPTGPMSVTVAGVVGSLAAVGVSRELGGGALLPLVMAAVVMGGLVQILIGLLGLGRYITLVPYSVVSGFMSGIGVIILLLQIGPLLGIASSGGVVQALSQVAGAFHPNPAALTIGAITLLVVLFTPASLSRWLPSPLLALVLVTPLSLLLFGKDQLPRIGAIPEGGLQMAWPDWHQHLPVLVQAGVMLALLGSIDSLLTSLVADNLTRSRHRSNRELIGQGIANTVAGLCSGLPGAGATMRTVINIKSGGRTPLSGMTHSLVLLVVLLGAGPLAAGIPTALLAAILIKVGLDIIDWGFLLRAHRLSRKTALVMWGVLLMTVFWDLIGAVLVGMFVANLLTIESLTAHQLEGMAVGGEDLDLEEARLMEHCGDDLLLFSLQGPLSFGAAKGISERMMLVRHYRMLILDIGKVPHLGVTAALALERMVEEARQHGRTVLVSGASGKVRQRLREFGIHDLVSSRREALRRAADQLGGDNASFS

SEQ ID NO: 25059 - protein, 248 aa, Chlamydophila caviae GPIC
MNNVLLGKKAIVTGGSRGIGFAIAKLFIEQGADIEIWGINDEGGKKAAEELSRIGRPATFAKVDVSNNESVKDAAQNFISAHGSVDILVNNAGITRDNLLMRMSEEEWSSVINTNLNSLYYVCSAVIRSMIKARSGSIINISSIVGLMGSPGQTNYAAAKAGIIGFSRALAKEVAARNVRVNCIAPGCIDTDMTKVLNDNLKTEWLKNVPMGRMGSPEEIANAALFLASPLSSYVTSQVLSVDGGMAY

SEQ ID NO: 25060 - protein, 451 aa, Desulfitobacterium hafniense Y51
MLRMKEVITSEDVLAKNLKDKLQDHSATVGVIGLGYVGLPLAVEKGKVGFSVIGFDINAARVAKVNAGDNYIADVKDEELLELTQKGMITATTDYAKLAECDVVVICVPTPLTITRDPDISYIQASSEQIAKYLKPGQLVTLESTTYPGTTEEVILPMLEQSGLKVGKDFFLAFSPERVDPGNKRFTTNNTSKVVGGMTPVCLEVAYTFYAQTIVNVVPVSSPAAAELTKVFENTYRAVNIALVNELMLLCDRMGIDIWEVVEAAGTKPFGIQTFWPGPGVGGHCIPIDPFYLTWKAREYDFHTRFIELAGEINVEVSYHVINKVIRALNNENKSLKDAKVLILGVAYKKDIDDVRESPALKIMELLRKNGANIAYHDPYIPVIEPHGGSTVHLENTELTDEALAAADCVLILTDHSVVDYERVAEKAPLIVDTRNATRGVENNREKIVKI

SEQ ID NO: 25061 - protein, 348 aa, Populus trichocarpa x Populus deltoides
MTQMARWSFHGILAFVSLLVFLTHGVYASDGDADPIYKACVEQCEKTGCVGEKCFQHCKFSSDGKPVGGPWYLQEPLYLQWKQWDCRSDCQYHCMLVREEEREKLGGKPVKYHGKWPFHRAYGFQEPVSVALSALNLAIQFHGWVSFFILIYYKLQLTPSKKTYYEYTGLWHIYGILSMNSWFWSAVFHSRDVELTEKLDCSSAVALLGFSLILAILRAFSMRDEAARVMVSAPIIAFVTTHILYLNFYNLDYDLNMKVCVAMGVAQLLIWAVWAGVTNHPSRLKLWVAVVGGGLAILLEIYDFPPYQGFVDAHALWHATTIPLTYLWWSFVKDDAEFRTSSLLKKAR

SEQ ID NO: 25062 - protein, 229 aa, Alopecurus myosuroides
MAGGDDLKLLGTWPSPYAIRVKLALAHKGLSYEYAEEDLANTSELLLSSNPVHKKIPALIHNGVAVCESNIIVEYIDEAFAGPSILPADPYERAIARFWAAYVDDKLFGAWATMLFSGKTEEEKLEGKNALFAALETLEGALAECSDGKDFFGGHTVGLVDMALGSHLSWLKATEVMAGEEILRSDRTQLLAAWMARFSELYAAKAALPDVDRMAKMRQERLAAAAAAA

SEQ ID NO: 25063 - protein, 497 aa, Burkholderia xenovorans LB400
MDKKSLAFWQDKAATLSIEGRAFIDGEYRDAEGGRTFDCLSPIDGKLLAKVADSGAADVDAAVSAARRAFDSGVWSGLNPRQRKAILLRWAASIREHMDELALLETLDAGKPIADTTSVDVPGAAYCVEWFAEAIDKVGGEVAPADHHLVGLVTREPIGVVAAVVPWNFPILMASWKFGPALAAGNSVVLKPSEKSPLTAIRLAQLALDAGIPAGVFNVVPGAGEPGKLLALHQDVDCLAFTGSTNVGKLIMQYAGQSNLKRVWLELGGKSPNIVMPDCPDMDRAANAAAGAIFYNMGEMCTAGSRLLVHRDIKDVFLDKLIAAARSYTPGNPLDPNTSMGAIVDKVQLERVLGYIEAGRAEAKLLLGGARVKEETGGFYIEPTIFEIPASGAKVAREEIFGPVLSVITFDTVEEAIRIANDSEYGLAAAVWTSNLTIAHEVSRKLRAGTVWVNCYDEGGDMNFPFGGYKQSGNGRDKSLHALEKYTELKSTLVRLR

SEQ ID NO: 25064 - protein, 636 aa, Candida albicans SC5314
MKSEIPPIKNTNYNCKIPRSTFFVVCVFSLLIYSLSTIYRSSGLVLPPLSFIDQIPENLSRSDPYLTLHVDISDDPLSDKIGQPELNPSPKHLHVGSKAMVASDVPLCSTMGKEILLRGGNAADAAVTVALCIGSVNSHSSGIGGGGFIVSRNNGDAISIDAREMAPGSAYKEMYGNSLVLSKIGGLSIAIPGELKGLYELFKLHGSGNLSWKQLFEPVIKLNRNGFKCSKIFETVLAKEYDLVLSRVPVLKDSWDFIFKPNGELLQEGDVITRPNYANTLELIANNGSSSIFYDPNGPIVQSLVSTIQKWGGIATVQDFSNYEVNLEKPLISTINNYTFYTSNGISSGLGLLAGLNFFDRVFNESDDDTLFTHKLVENFKWLSSIRTRFGDIDNRQDLIDKYTNSTWIDDVLDEKKYSDEKTFHWKHYDPKYDIAEPQGTSHFSVVDENDNSVAMTTTVNLLFGSMIYDSKTGIILNDEMDDFALPNVSNAFNLTPSIFNFIHPGKRPLSSTAPTIIINDATNSTDFVIGAAGGSRITSAILQAIVRTYYRKYDLLSTIAFPRLHHQLIPESVMSENLTVWDQEHTGIASSMKKLGHTFLETGSLTAMNGIKRVKGGKLHGVSDWWRKRGESDGY

SEQ ID NO: 25065 - protein, 294 aa, Desulfitobacterium hafniense Y51
MSTRRIRKAIIPAAGLGTRFLPATKAQPKEMLPIVDKPTIQYIVEEAVHSGIEDIIIVTGRNKRAIEDHFDRSIELETFLQKSEKEELLDMVQDIARMVDIYYVRQKEALGLGHAIYCARKFIGNEPFAVLLGDDIIHSEVPCLRQMMHVYERHGASIVGVQQVPLEDTSKYGIVDAVPLDDSLYRALDLVEKPQPEDAPEARLAIMGRYILNPEIFGILESIPPGKGGEIQLTDGLKELARFQEILAYEFDGQRYDVGDKLGFVQATIEYALRREDLAEPLMRYLKQRIESDE

SEQ ID NO: 25066 - protein, 444 aa, Burkholderia xenovorans LB400
MHDIDDFLKKNRVTEIEAIIPDMAGIARGKIIPRSKFESGESMRLPQAVMIQTVTGDYPEDGTLTGVTDPDMVCVPDPSTIRMIPWAVDPTAQVIHDCVHFDGTPVAISPRRVLRRVLELYKAKGWKPVIAPELEFYLVDMNKDPDLPLQPPIGRTGRPETGRQAYSIEAVNEFDPLFEDIYEYCEVQELEVDTLIHEVGAAQMEINFMHGDPLKLADSVFLFKRTVREAALRHKMYATFMAKPMEGEPGSAMHMHQSLVDEETGHNLFTGADGKPTTLFTSYIAGLQKYTPALMPIFAPYINSYRRLSRFMAAPINVAWGYDNRTVGFRIPHSGPAARRIENRIPGVDCNPYLAIAATLAAGYLGMTQNLEATEPLLSDGYELPYQLPRNLEEGLTLMGACEPIAEVLGEKFVKAYLALKETEYEAFFRVISSWERRHLLLHV

SEQ ID NO: 25067 - protein, 481 aa, Burkholderia xenovorans LB400
MSYRTEEVAYVQPAQPAASAQAAQATQQRSTAEYRALDAAHHIHPFSDMGALNRTGSRVIVKAQGVYLWDSDGNKVIDGMAGLWCVNVGYGRKELADAAYRQMMELPYYNTFFKTTHPPVIELSALLAELAPEPFNHFFYCNSGSEGNDTVLRIVHHYWATQGKHAKKFVISRKNGYHGSTIAGGTLGGMGYMHEQMPSKVENIVHIDQPYFFGEAQGNLTPEEFALARAQQLEAKILEIGADNVAAFIGEPFQGAGGVIFPASTYWPEIQRICRKYDILLVADEVIGGFGRTGEWFAHQYFGFEPDLITLAKGLTSGYIPMGAVGLHDRVAKAIIENGDFNHGLTYSGHPVAAAVAVANLKLLRDEKIVERVKTDTGPYFQKKLRDTLGNHPIIGEISGAGLVAGLQLAQDPKTRKRFANGGDVGTICRDFCFNGNLIMRATGDRMLLSPPLVINKLEIDEIVSKAKKAIDATAQQLGIS

SEQ ID NO: 25068 - protein, 280 aa, Campylobacter jejuni RM1221
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKANAKNLRAALYSMYGARLELVICKDQPKLYRLNANNEFIFIKDLKMNEKGKINATGGTQKFWEEKHAKFIKNLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 25069 - protein, 463 aa, Pseudomonas syringae pv. phaseolicola 1448A
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWMFTLVITLLLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYIAPAAVFDFLLASSGAIALLVYLVIAVSQLRMRQKRIAAGEAIDFKMWLFPWLTWAVIAFIVAVLTIMLIQEEHRVEIIATGLLSLLVISAGLLVSRRRKAGRVGAAALG

SEQ ID NO: 25070 - protein, 119 aa, Oryza sativa
  misc_feature (109)..(109): Xaa can be any naturally occurring amino acid
ELLAQCNGRKAKDSNPACSVELRRLPSPPPADAAAAGEKNAHPPPRVLVTYFNGVEESFVAAEGATAQGIRDQILDRGRLLDTEQLFRDGGEKWPVLIPEEELTSFCLXPKKAEEKPQA

SEQ ID NO: 25071 - protein, 817 aa, Yersinia pestis biovar Microtus str. 91001
MLKFGGTSVANAERFMRVADIIESNARQGQVATVLSAPAKITNHLVAMIDKMVAGQDISPNISDAERIFAELLRGLADTQPGFDYDRLKALVGHEFAQLKHLLHGISLLGQCPDSINASIICRGEKLSIAIMEALFQAKGYHVTVINPVEKLLAQGHYLESTVDITESTRRIGASGIPSDHIILMAGFTAGNDKGELVVLGRNGSDYSAAVLAACLRADCCEIWTDVDGVYTCDPRTVPDARLLKSMSYQEAMELSYFGAKVLHPRTIAPIARFQIPCLIKNTSNPQAPGTLIGGESIDEDSPVKGITNLNNMAMINVSGPGMKGMVGMAARVFAVMSRSGISVVLITQSSSEYSISFCVPQGELLRARRALEDEFYLELKDGVLDPLDVMEHLAIISVVGDGMRTLRGISARFFSALARANINIIAIAQGSSERSISVVVNNDAVTTGVRVCHQMLFNTDQVIEVFVIGVGGVGGALIEQIYRQQPWLKQRHIDLRVCGIANSKAMLTNVHGIALDNWRQELAEVQEPFNLSRLIRLVKEYHLLNPVIVDCTSSQAVADQYADFLTDGFHVVTPNKKANTSSMNYYRQMRAAATKSCRKFLYDTNVGAGLPVIENLQNLLNAGDELMRFTGILSGSLSFIFGKLDEGMSLSEATRQAKALGYTEPDPRDDLSGMDVARKLLILAREAGYKLELADIEVESVLPASFDASGDVDTFLARLPSLDAEFTRLVANAAEQGKVLRYVGVIEDGRCKVRMEAVDGNDPLYKVKNGENALAFYTRYYQPIPLVLRGYGAGNDVTAAGVFADLLRTLSWKLGV

SEQ ID NO: 25072 - protein, 396 aa, Escherichia coli CFT073
MMKTVNELIKDINSLTSHLHEKDFLLTWEQTPDELKQVLDVAAALKALRAENISTKVFNSGLGISVFRDNSTRTRFSYASALNLLGLAQQDLDEGKSQIAHGETVRETANMISFCADAIGIRDDMYLGAGNAYMREVGAALDDGYKQGVLPQRPALVNLQCDIDHPTQSMADLAWLREHFGSLENLKGKKIAMTWAYSPSYGKPLSVPQGIIGLMTRFGMDVTLAHPEGYDLIPDVVEVAKNNAKASGGSFRQVTSMEEAFKDADIVYPKSWAPYKVMEERTELLRANDHEGLKALEKQCLAQNAQHKDWHCTEEMMELTRDGEALYMHCLPADISGVSCKEGEVTEGVFEKYRIATYKEASWKPYIIAAMILSRKYAKPGALLEQLLKEAQERVK

SEQ ID NO: 25073 - protein, 470 aa, Corynebacterium diphtheriae NCTC 13129
MTEHTAPTLTKGLKVRHLTMMGLGSTIGAGLFLGTGVGIKAAGPAVLIAYIIAGFIAVMIMRMLGEMGSVVPASGSFSEYADAGIGHWAGFIQGWVYWLATVAVLGAEITGASGFVASWLGVSPWIPALVFVAFFGLVNLMRVRAFGEFEFWFAFIKVAVLVVFLIIGSLLVLGLLPNHDFVGLSNVRAEGFAPTGLGGIAAALLAVAFGFGGIEVVAIASAESEDPQKSLVNAVRTTITRISIFYLGSVAIIVLLLPYSSLGKAKSAAESPFSQVLAMANIPGVVGVIEVVIVLALLSAFNAQIYASSRMMMSLAERRQAPNIFARVDNRGVPLPAIVLSVVLSVIMVILNYVDTGWLLTFLLNAAGASLLTVWTFIAVSQLKLRRRLEALQGNLAVRMWAFPGLTIATLAILFGLAILMLSDAGARIELLSAIAMVAILFAISLIAVKQPFDKALLPREASYPQNSPS

SEQ ID NO: 25074 - protein, 277 aa, Yersinia pestis CO92
MTMQPLIKLYDGRLMPQLGLGVWQASIQETELAVSKALEVGYRSIDTAAIYKNEEGVGKALKAAAVARDELFITTKLWNDDQHNPQQALETSLQKLQLDYVDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 25075 - protein, 182 aa, Campylobacter jejuni subsp. jejuni NCTC 11168
MLIKFKNHSPKLGQNVFVAEGAKIIGEIEIGDESSIWFNCVLRADVNFIKIGKRTNIQDLSTVHVWHREFDEKGKLKDAGFPTIIGDDVTIGHNCVIHACVIKNRVLIGMNAVIMDNALIEEDSIVGAGSVVTKGKKFPPRSLILGNPAKFVRELNDEEVSFLKQSALNYVDFKNEFLKDLQ

SEQ ID NO: 25076 - protein, 454 aa, Corynebacterium diphtheriae NCTC 13129
MTQATTETELGTGLKTRHLTMMGLGSAIGAGLFLGTGVGIAAAGPAVLIAYVLAGIFVVFVMQMLGELAAARPASGSFSVYAEQAFGHWAGFSLGWLYWFMLTMVLGAEMTGAAAIMGQWFGIAPWIPALICVIFFAVVNLARVSGFGEFEFWFAFIKVAVIILFLVIGVLLIFGLLPNYDFVGTQHFLGDGFMPNGISGVATGLLAVAFAFGGIEIVTIAAAESEDPKTAIATAVRSVIWRISLFYLGSVLVICFLIPFSSIGGAKSAADSPFTIILGMANIPGVVGFMEAVIVLALLSAFNAQIYATSRIVHSFAERGDAPKIFAATNPSGVPMPAVLLSMFFAFVSVGLQYWNPAGLLNFLLNAVGGCLIVIWVIIAFAYLKLHPELVRNGEITTVRMWGFPWLGWVTIAGFLGLTVLMLTDDASRSQITSVTVVFLLLIVVSFFTKKKSK

SEQ ID NO: 25077 - protein, 367 aa, Prochlorococcus marinus subsp. pastoris str. CCMP1986
MSILNKIKNKFSFNYRKKRWPGLINAYKQYLPVSSKTPIISLNEGNTPLILSKSISDLIGNDTKVYLKYDGLNPTGSFKDRGMTMAISKAKEEGREAVICASTGNTSAAAAAYASRGGLKSYVLIPDGYVAQGKLAQALMYGAEIISIQGNFDKALEIVRKLSSEYPINLVNSVNPYRIQGQKTAAFEIVDDLGIAPDWLCIPMGNAGNITAYWLGFKEYAKIKKNLKLPLMMGFQSEGSAPLVKNIIVQDPETIATAIRIGNPVNRDKAKIVKKESKGDFQSVTDEEIIVAYKMLAKEGIFCEPASAASVAGLIKNKNRIKKESTIVCVLTGNGLKDPDCAIKNNDAIFQKNIEPSLKNITKILGY

SEQ ID NO: 25078 - protein, 468 aa, Kluyveromyces lactis NRRL Y-1140
MTSLNEPNVDFHLKLNQQQFNIPSELLKRNWDKFNNLYTSYSVELQGQFATLNTLLEDPNKDEQSIEKLNDIINTVNILQKRLSQLHDNELTILERIEKRVEYFKQFERFKYDSNTDKLLKWYRSYTDLLIADYLVRHGSNSIDHKNKIASNSGIEFIKTRGLEDLIDYEVLIEANQISMELIENKNLRPLLEWIENNSAHLTEKGSHLQFQALLQEYIELVRCSDYKAAIRCFQTHLAHFANIYPKELKLAAGILAFFKSCLNNGRDDEVTNEQKLFHAYFRKQMYRPHPLSSISSSNVVHNAELCRYGPLLDHERWESLNKMFLHEFYSLYKISYHDPLLIYISLGISSLKTKDCGHTISAQLIPHENPEVNEYIKSNVVNTDCPVCNHDIFPLSENLPFAHHIQSSLFENPVMLPNGNIYDSEKLISLSRKLNKMGYTKLKENQVMDPIDKSIYATTDFIKMYPT

SEQ ID NO: 25079 - protein, 403 aa, Bradyrhizobium sp. BTAi1
MTSVAATHLLPVFARVDLAFERGEGAWLIATNGDRYLDFTSGVAVNSLGHAHPHLVKALQEQATKLWHMSNLFKSPDGERLAARLCEQSFADYVFFANSGAEAMEGAIKITRKYHAAKGHPERYRIITFEGAFHGRTLATLAATGSAKYLEGFGPPMDGFDQVPLGDLEAVKKAIGPHTAGILIEPVQGEGGVRTAPLSFYKALRQLCDDHGLLLVVDEVQTGMGRTGDLFAHRWLGVTPDVMSLAKALGGGFPIGAVLATAEAASGMTPGSHGSTFGGNPLAVAAANAVLDVMLAPGFFEHVRRMSLLLKQKLAAVVDRHPDIISEIRGEGLLIGVKAVVPSGDLVAALREQKLLTVGAGDNVVRFLPPLIVSEAEIEQSVEMLDRACAALSGGPAKQAAAS

SEQ ID NO: 25080 - protein, 308 aa, Bradyrhizobium sp. BTAi1
MANTPRHFLDLTEMPVEELRNMLALSSRMKKTLKANEPAKKPLEGKVLAMIFDKPSTRTRVSFDVGMRQLGGEAIMLTGTEMQLGRGETIADTARVLSRYVDAIMIRILSHEALLELAAHATVPVINGLTRRSHPCQVMADVMTFEEHRGSIEGRTVAWTGDDNNVLASWAHAAERFKFRLNVATPPQLSPGKPMKDFIRATKADIHLGHDPEAAVTGADCVVTDTWVSMGDKDGEHRHNLLKPYQVNSKLMSLAKPEAIFMHCLPAHRGEEVTDEVIDGPQSVVFDEAENRLHAQKGILAWCFGERA

SEQ ID NO: 25081 - protein, 277 aa, Rhodospirillum rubrum ATCC 11170
MTAAFAAGPRLRVPFFQVDAFADVAFAGNPAAVCLLEKAWPEDELLQAIAAENNLSETAFVVRGGENHALRWFTPLTEVPLCGHATLASGHVLLRELGACGPQRFDTRAGMLEVSATDEGALAMRLPAKPPKSAIFPEDLDRVLGVRPMEVAQGGGFLIVVLGGVEAVRGLRPRLSMLRALGIPKLVVTAAGGGADSADACDFASRVFAPGVGIDEDPVTGSAHCVLTPFWAKRLGRDRLLAHQVSPRGGRLVCTLMGAEVEMIGQAVTVISGTLSV

SEQ ID NO: 25082 - protein, 465 aa, Blastopirellula marina DSM 3645
MVLHEKDTRREELDDDVYASTDLSVSMPKYKFPHVEQNPRHAYSVVHDELMLDGNSRQNLATFCQTWVEPEVHKLMDECLDKNMVDKDEYPQTAEIEARCVHMLADLWNSPSEANTIGCSTTGSSEAAMLGGMAMKNRWKAKRVAAGKPVDKPNLITGPVQVCWHKFARYWDIELREVPMEEGRLLLTPEEVIKRCDENTIGVVPTLGVTFTCQYEPVFEIAAALDKLEKEKGLDIPIHVDAASGGFLAPFCAPELVWDFRLPRVKSINTSGHKFGLAPLGVGWVIWREEKDLPDDLIFWVNYLGGNMRDLALNFSRPGGQIVCQYYNFLRLGRDGYRKIHSACYDTASYLAEEIDKIGLFDVIYDGDRRSGIPALCWKLKPGVKPGFSLYDLADRLCTRGWQVPAYSLPDDQSDQVIQRILVRHGVSRDLGSLLLEDIQRGIEYFENHPIDQPLTEEEAGGFHH

SEQ ID NO: 25083 - protein, 347 aa, Coprinopsis cinerea okayama7#130
MTFFRRAGLAFVLFALFYLVSASAGDSNRQYKACLRICDLNRCETGEYEATKPFSLWLTRWTCTDDCQYRCMHTMVDNAISSGKKVHQYYGKWPFWRFAGMQEPASVVFSVLNFMAHLSGYRKIKRALPNSHPMKPYYILWAVCSMNAWLWSSVFHTRDLPITEKLDYFSAALVILNALYGTIIRLFHLYPQPERVKLTGSTGVPGWKILRGACVLVYAGHIYYLTSGPRFDYTYNTIFNLVIGLSHNILWTLYALPSSLSVLKSRFPGAPKGYRPSFVNKAGLFVLLTTLATSLELFDFPPWFRTIDAHSLWHAATAPIGYLWYDFLVQDSLDPSWQTPLLRQRPE

SEQ ID NO: 25084 - protein, 360 aa, Populus tomentosa
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILEGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLANGAGFQGFEVMCCAFNTHVIE

SEQ ID NO: 25085 - protein, 375 aa, Cryptococcus neoformans var. neoformans B-3501A
MSNTIAYFDITIANEPAGRLTFELFDDVVPKTANNFKHLCIGDKTNEAGVKLAYAGSSFHRCIKGFMLQGGDFTRGDGTGGESIYGEKFEDENFELKHDKPMLLSMANAGPGTNGSQFFITTVPTPHLDGKHVVFGRVIYNRSLVRRIENIPTTSDRPDQEVTISSAGVLSPDEFAQLEAERQAKQAGSDGGDIWEDWPQDEEGVDAEKPEEALVVAGKLKEVGTKEFKAGNFAVALDKYQKALRYLDVHPVLPNDSPAELVESFRSLRLPLLTNAALCALKLPASPNTSSLVVSLTSRALTLPNLSASEKGKALYRRAQAYVLKKDDEAAEKDLKGALECVPGDAGVIKLLKDVEAKRKARREKERQAFAKMFG

SEQ ID NO: 25086 - protein, 134 aa, Brassica napus
GQCFALKGSSGYVQIRLRGPIVPDAFTLEHVAKSVAYDRSSAPKDCVVSGWLQGNGQESSEESEKMQLLTEFTYDLERSNAQTFNVLDSSDSGLVDTVRLDFTSNHGSNSHTCIYRFRVHGRAPDPVPVVETEL

SEQ ID NO: 25087 - protein, 212 aa, Brassica napus
MMSDHGGRKVWGKTKRNREDLEENPNIPIAARVGRMMKKVSITSEEEEAVGPQQQFLTMNGKVYSLRYQDDFVDASVKEVDLLNELEVSKLYHCDGLVLCVAKDNSELVLWNPYLCQTRWIGPRESFHLSDRHAVGYDEGRNHKILRFVDNFIKNMNKIEVVYEIYEIRSDSWRVLEEVNPEGLIDTHQRGVSVKGNTYFVANHYGLAHKVP

SEQ ID NO: 25088 - protein, 525 aa, Vitis vinifera
MQGGHLAFEEPVRLSSVLTPSTFSSIPLLTKIVGTLGPRSRSVETIEACLQAGMSVARFDFSWLDGDYHQETLENLRIAVKNVKKLCAVMLDTMGAELQVCNATGNPIKLKADDHVTITPDASKIPSAEVLPVNYDGLAESVKKGDSIFLGQYLSTGIESTSVWLEVLETRGPDVICLVKNSATLAGSIFPMHMSQVRVKLPTLTEMDKQVISNWGSRNKVEFIALSYTRHVEDVRELRAFLKTQNLNETQIFAKVETLEGLKHFDEILQEADGVILSRGNLGVDLPPEKVFLFQKSAVHRCNMAGKPAIITRVVDSMTENLRPTRAEATDVANAVLDGADGILLGPETLCGLYPIEAIQIVGKICAEAESVYNQSLHFKRIAKHVGEPMSHAESVASSAVRTAVNVNAAMIVAFTSTGGAPRLIAKYRPPVPVLAVVIPRLKTNSLKWTLTGTLQARQLLSVRGVHPILSSPNVATSGGSSEDWGLKFALNHCKSMGWLKHNDRVVVFQKIGDSSVAKIVELQD

SEQ ID NO: 25089 - protein, 335 aa, Mycobacterium tuberculosis CDC1551
MPGHDSHMHAIEVTETGGPGVLRHVDQPQPQPGHGELLIKAEAIGVNFIDTYFRSGQYPRELPFVIGSEVCGTVEAVGPGVTAADTAISVGDRVVSASANGAYAEFCTAPASLTAKVPDDVTSEVAASALLKGLTAHYLLKSVYPVKRGDTVLVHAGAGGVGLILTQWATHLGVRVITTVSTAEKAKLSKDAGADVVLDYPEDAWQFAGRVRELTGGTGVQAVYDGVGATTFDASLASLAVRGTLALFGAASGPVPPVDPQRLNAAGSVYLTRPSLFHFTRTGEEFSWRAAELFDAIGSEAITVAVGGRYPLADALRAHQDLEARKTVGSVVLLP

SEQ ID NO: 25090 - protein, 505 aa, Pseudomonas syringae pv. phaseolicola 1448A
MKTALPRELLASVVVFLVALPLCMGIAIASGMPPAKGLITGIVGGLIVGWIAGSPLQVSGPAAGLAVLVFEVVREHGMAMLGPILVLAGLLQLLAGRFKLGCWFRVTAPAVVYGMLAGIGVLIVLSQAHVMFDSSPKPSGLDNLIAFPSTLIQAFGPGTGMQAGMLGLGTMLIMWGWEKLRPQSLRFVPGALLGVGIATGISLFMALQVKRVEVPDNLADAIDWLRPTDLMNLADPAILVAAIVVAFIASAETLLSASAVDRMHSGQRSDFDKELSAQGVGNMLCGVLGALPMTGVIVRSSANVQAGATTRFSTIFHGLWLLAFVLLLSSVLQSIPVASLAGVLVYTGLKLVDLKAFRGLGRYGRMPMFTYAATAVAIIFTDLLTGVLVGFGLTLVKLAFKASRLKINVVELAGEKEFELRLVGAATFLKVPALTQALGTIPQGSTVHVPLGNLSYIDHSCLELLEEWGRSNAAHGTRLLIEPHGLKRRLEGRIYTTTGIGSGAA

SEQ ID NO: 25091 - protein, 847 aa, Bordetella parapertussis 12822
MDIGFLVFGLAGLLTLVCFMPPLAGRLKLPYSVLLALVGCLLGIGVHLHGWAPPVLGDLLDTIEHFEISSETFLMVFLPVLLFETALSMNVRRLIDDIGPILMMAIVAVVVCTLVVGFAVDAVSSYGLIVCLLLGAIVATTDPAAVVGIFREVGAPKRLTTLVEGESLFNDAASIALYSVLLAALGGSGELSVGAVFNDFIFHFVGGGLAGFLMGRLACALFAWLRGFPTAEITLTLTLAYLSFFISEHYLGVSGVVATVIAGLVVGSTGRTRMSPTTFEFLSSAWGQFGFWANSLIFLFAAMLIPKLMAEADWQELLLVLVVFAATLAARAIVVFGLLPLLRVARIGAEVSNPYKSVMWWGGLRGAVSLALALAVTEQSSVPEQARQFVAVATTGFVLMTLMINGVSLRPLIRMLGLNQLSPVERTIRNQVLAAALEDLQGRTEEIAKVDHVNPEARDRIRAVFDASLTSVHDGQVGQMTLDQRVAVGLSIVARREEEMFFDILKAQIVDWRLAEGLLARAERLEDAVRAGGLAGFEAGIVADVRYSRLFRMALRTHYMFGFQGWLARELGKRFASLLTKRSVARDLMKFAREQVAPLLGEEAADRIIAAHQRRLDLIENALQALTLQYPSYSLWLQESHLGRVARELERRRYRDMLEQFLISGEVYADLMAQLKARWQHIDKHPPLDIELGSAELVKRVPLFEGLSQDSLRAICRLLKPRLALPDQHILTEGRHGQEMCIVASGAVVVHLPDHTTIELGSGEFFGELALLGEEQLVPDVTSLGYSKLLMLSARDFHALLARDEHLRERIQTVAKQRMRAIEVWKQYSQAAAAAAASTASEDSAPA

SEQ ID NO: 25092 - protein, 347 aa, Triticum aestivum
MAGILAWAADVVGGAGDSDDEAAAERERAAAMTPEQRLRAADLDARASSLRRAIQDLRARVPPPNVAQRLPHLHAHSLASSAALALQLNAHSSTKEQALHREVKIQEENTAYEKAISDCRQKIQEKQMEAAVLQSNLKEMEIAELDLKAKVDNAIMEQEAAQRKASMAASEATGNALLEAESLMNLKSKDLEEKKGELKLLEDKIQILEKVWSSVEEESLKNPSPAQREKVLEKQLHSLIEQLTAKQAQAERLITDIHAKEKDLERLNSIQRNLHSGSSEAGAARNRFGGGLLSGDEDSGSKAARRPGQSGGFRTEGQKRLMILRSAFVLYILVLHVVVFIKISVSN

SEQ ID NO: 25093 - protein, 1032 aa, Escherichia coli CFT073
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDALNKLLQNEAFLARHGLQEKRESLQALPARIPTSMVQGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWEEYKQRWHKPAGSGSRHPVAVIGAGPAGLAAGYFLARAGHPVTLFEREANAGGVVKNIIPQFRIPAELIQHDIDFVADHGVKFEYGCSPDLTVEQLKNQGFHYVLIATGTDKNSGVKLAGDNQNVWKSLPFLREYNKGTTLKLGKHVVVVGAGNTAMDCARAALRVPGVEKATVVYRRSLQEMPAWREEYEEALHDGVEFRFLNNPERFDADGTLTLRVMSLGEPDEKGRRRPVETNETVTLHVDSLITAIGEQQDTEALNAMGVPLDKNGWPDVDHNGETRLSDVFMIGDVQRGPSSIVAAVGTARRATDAILSRENIRSHQNDKYWNNVNPAEIYQRKGDISVTLVNSDDRDAFVAQEAARCLECNYVCSKCVDVCPNRANVSITVPGFQNRFQTLHLDAYCNECGNCAQFCPWNGKPYKDKITVFSLSQDFDNSSNPGFLVEDCRVRVRLNNQSWVLNIDSEGQFNNVPPELNDMCRIISHVHQHHHYLLGRVEV

SEQ ID NO: 25094 - protein, 393 aa, Campylobacter jejuni subsp. jejuni NCTC 11168
MKVYLDNNATTMLDPNAYELMLPFLKDMYGNPNSLHQYGSATHPALREALDKLYAGLGANDLDDIVVTSCATESINWVLKGVYFDHILDKERNEVIISSVEHPAVTAAAYFLKSLGVKVIELPVNEEGVSTVEDLRKVISDKTALVSVMWANNETGMIFDIKAMAELAHEFGALFHTDATQAVGKIKVNLTQVGVDFASFSAHKFHGPKGVGGLFIKKGLKLTPLLHGGEHMGGRRSGTLNVPYIVAMGEALRIANTMLDFEDSHIRRLRDKLEDQILALPDTTVVGKREHRVPNTILASIKGVEGEAMLWDLNKNGIAASTGSACASEALESNPIMEAIGAEHDLAHTALRLSLSRFNTEEEIDYAAKQIKNATQRLRAISCTYAYNPNNYK

SEQ ID NO: 25095 - protein, 311 aa, Triticum aestivum
MASNAAPDDNEVAHDYGLVRVYKSGRVERPLVAPPAAAGLDPVTGVESKDVQLGDYSARLYLPPAASTATDKFPVIVYVHGGGFVAESVASPNGHRFLNSLTAACPALAVSVEYRLAPEHPLPAAYEDCVAALTWVLSAADPWVAEHGDLGRVFVAGDSAGANACHHLVIQPGAVRLKGAVLIHPWFWGSEAVGEETRNPAWRAMGGRLWEFACPGSSGVDDARMNPMAPGAPGLETLACERVMVCVAEGDFLRWRGRAYAEAVAAARGGEGQGVELLETEGVGHVFHLFKPDCDKAKEMFDRIVAFVNAP

SEQ ID NO: 25096 - protein, 528 aa, Stevia rebaudiana
MEFHLSLLTTVTAILVVTAFFLQISKRKKVDTTKNKLLPPKAKGAWPLIGHLPLLGKNRIAHRVLGDLADKYGPIFTIKLGVYQVLVVSSADAVKDCFTTSDKAFASRPKSTAVEIMGYNYAMFGLAPYGEYWRQVRKIAVLEILSQKRVDMLEWARVSEVRTSTNEVYDAWRVNKENEGSDMVLVDMKQWFTNLILNVLVRIISGKRFPFKSVEGIRFQKMEKKLFELLGAFVVSDLIPSMKRFDIGGYQKQMKMAAEEINDIMEGWLNNRKTQKESGEQKEGDQYFMDVLISVLKDASDADFPGYDHDTVIKATCMALLAAGSDTTSVTIIWALALLLNHPEKMKIAQDEIDKHVGRDRLVEESDLKNLVYINAIIKETMRLYPAAPLSVPHEAMEDCVVGGYHIPKGTRLLPNFWKIQHDPNIWPEPYEFKPERFLSTHKDVDVKGKHFELLPFGTGRRMCPAITFVLQILPLTLANLIQQFEIRKPSNDPIDMTESAGLTTKRATPLDVLIAPRLSLKMYPVDV

SEQ ID NO: 25097 - protein, 649 aa, Cucumis sativus
MAQVPPQPQVPNSGADPAANGGANQHVTTSLYVGDLDVNVTDSQLYDLFNQVGQVVSVRVCRDLTSRRSLGYGYVNYSNPVDASRALDVLNFTPLNGNPIRVMYSHRDPSVRKSGSGNIFIKNLDKAIDHKALHDTFSAFGSILSCKVATDSSGQSKGFGFVQFDTEEAALKAIEKLNGMLLNDKQVFVGPFLRKQERESVSEKTKFNNVFVKNLAETTSEEDLKNMFGEFGPITSVVVMRDGEGKSKCFGFVNFENADDAARSVEALNGKKVDGKEWYVGKAQKKSEREVELKSRFEQSVKEAADKYQGANLYVKNLDDSIDDDKLKELFTGFGTITSCKVMRDPNGISRGSGFVAFSSPEEAARALAEMNGRMIVSKPLYVALAQRKEDRIARLQAQFSQMQPMAMASSVAPRGMPMYPPGGPGIGQQIFYGQAPPTIISSQPGFGYQQQLMPGMRPGGGPMPNFFVPMVQQGQQGQRSGGRRAGAIQQTQQPVPLMQQQMLPRGRVYRYPPGRGLPDLPMPGVAGGMFSVPYEMGGMPPRDAVHPQPVPVGALASALANATPDQQRTMLGENLYPLVEQLEPDNAAKVTGMLLEMDQTEVLHLLESPEALKAKVAEAMEVLRSVAQQSGNAADQLASLSLTDNLDS

SEQ ID NO: 25098 - protein, 644 aa, Escherichia coli CFT073
MKGMQMNKFIAAEAAECIGCHACEIACAVAHNQENWPLSHSDFRPRIHVVGKGQAANPVACHHCNNAPCVTACPVNALTFQSDSVQLDEQKCIGCKRCAIACPFGVVEMVDTIAQKCDLCNQRSSGTQACIDVCPTQALRLMDDKGLQQIKVARQRKTAAGKASSDAQPSRSAALLPVNSRKGADKISASERKTHFGEIYCGLDPQQATYESDRCVYCAEKANCNWHCPLHNAIPDYIRLVQEGKIIEAAELCHQTSSLPEICGRVCPQDRLCEGACTLKDHSGAVSIGNLERYITDTALAMGWRPDVSKVVPRSEKVAVIGAGPAGLGCADILARAGVQVDVFDRHPEIGGMLTFGIPPFKLDKTVLSQRREIFTAMGIDFHLNCEIGRDISFNELTAEYDAVFLGVGTYGMMRADLPHEDAPGVIQALPFLTAHTRQLMGLPESAEYPLTDVEGKRVVVLGGGDTTMDCLRTSIRLNAASVTCAYRRDEVSMPGSRKEVVNAREEGVEFQFNVQPQYIACDEDGRLTAVGLIRTAMGEPGPDGRRRPRPVAGSEFELPADVLIMAFGFQAHTMPWLQGSGIKLDKWGLIQTGDVGYLPTQTHLKKVFAGGDAVHGADLVVTAMAAGRQAARDMLTLFDTKAS

SEQ ID NO: 25099 - protein, 337 aa, Arabidopsis thaliana
MKSIFQSIRVLLPVAIKRINRSICNGGVGFGVRKVFGKGSFGSVRLFSYKRRCDGETLYATVKTSDDAKSLYEEFQILSKFKGCPRIVQCYGNGVKQRFNDKGYVEYMIPMEYATGGSLNNFMDRFNDRKLPDPMIRKFTRMLLEGLATIHRYGYVHYDIKPENILVFPGSVYKEGAWRYSYKLKISDFGLSKRDGDTKWWHPLKSYAGTRIYMSPESISHGEIGKGLDLWSLGCVVLEMYTGKRPWWHTNYELEDLMKCYEPLFPPNLPCDAKLFLMTCFAPEPDERKDALTLLRQSFFRRDVNKLTKLLKVDNRNDFTLELKKLRQMLSEIRSMR

SEQ ID NO: 25100 - protein, 248 aa, Candida glabrata CBS 138
MARTFFVGGNFKLNGTKKSIKEIVDRLNTASLPENVEVVICPPATYLDYTVSLVSKKQVTVGGQNTYTKASGAYTGENSVDQLKDVGAKWVILGHSERRTYFHEDDKIVAEKTKFALDQGLGVILCIGETLEEKKAGVTLKVVERQLDAVIAEVKDWTNVVIAYEPVWAIGTGLAATAEDAQDIHHSIRSYLAEKLGKDTAEKTRILYGGSANGANAGTFKDKADVDGFLVGGASLKPEFVDIINSRN

SEQ ID NO: 25101 - protein, 339 aa, Prochlorococcus marinus str. MIT 9313
MQHESMIAPFTPQVDGAYRFSVAPMLDCTDRHFRVLMRQISRRALLYTEMLVAQALHHSNRLDHLLDFDIIEHPLSLQVGGDDPKILAEAARLADAWGYDEINLNVGCPSSRAKAGNFGACLMAKPDQVARCVEAMAMASPLPVTVKHRLGIDNFDSDALLMTFVDRVSIAGATRFTVHARKAWLEGLDPKQNRTIPPLQHQRVTHLKQQRPQLTIEINGGLEHPADCLTALQTCDGAMVGRAAYAHPLRWQSMDELVYGEQPRSINASQVIGGLLPHAETHLSRGGRLWDLCRHLLQLVEGVPGAKAWRRDLGIKAQKVDADLRVLQKAAQQLEDAGL

SEQ ID NO: 25102 - protein, 318 aa, Idiomarina loihiensis L2TR
MTRDLVSGGQQIHAPDDLKSLLEEIHQQAMKITEGHVADYIPALAEVDPELCGLTLATLDGEVFNVGDTQEQFSIQSISKIFGLMLAMERLGEDLWDRVKMEPSGQAFNSIVQLEWEKGIPRNPMINAGAIVVSDVLVSRYSASKNAVLSLVRTLCGNDNVYADNIVHQSEKEHGHRNAALAHLMKSFGNIDAEVDELLDHYFWQCALTMSCENLARSFTFLANDGICPFSKKKIMSKRDSQRINALLSTSGMYDQSGEFAFTVGVPAKSGVGGGMIAVVPDFGVICSWSPRLNSYGNSARGMYMVRELANRLGLSVY

SEQ ID NO: 25103 - protein, 352 aa, Bacillus licheniformis ATCC 14580
MWKGLIHQYKEYLPVTDKTPELTLNEGNTPLIYLQNLSKKLGIELYVKTEGVNPTGSFKDRGMVMAVAKAKEEGNDTIMCASTGNTSAAAAAYAARANMKCIVIIPDGKIAFGKLAQAVMYGAEIIAIDGNFDDALKMVRSICEKEPIALVNSVNPYRIEGQKTASFEICEQLGEAPDILAIPVGNAGNITAYWKGFKEYHEKNGTGLPVMKGFQAEGAAPIVKNKVIEKPETVATAIRIGNPASWDKAVNAAKESNGKIDAVSDEEILHAYQLLAREEGVFAEPGSCASIAGVLKQLQTKEIQPGAKVVAVLTGNGLKDPNTAVDVSQIKPVTLPTDEEAILEHLKGAARV

SEQ ID NO: 25104 - protein, 417 aa, Streptomyces carzinostaticus
MNSHQLQILFLDLAIILVMARGLGHLASRIRQPPVVGEILAGVLLGPTLFDGVLSETLFPDDVRPVLSGVANLGVALFMFVVGLEIEGNLMKGHGRTTVAAAVGSTAVPFLLGIGLAFALMPGHDPADRGTFVVFIGLAVSVTAFPVLARILAERGLTRTAIGGIALAAAAFVDVVAWAALAAVNASVGAAGDHRLVLLTVPYLAAMLFVVRPLLRRVLAPGDKAAEPGPLKFAVVLVGALLSAAATEAMGMHHIFGAFLFGLMVPRERAQALRADLHDRTTHLTSVLLPVYFVVAGFQVDLGGIGLGGLRELSLILLVAIAGKFGGTYLGARATKLAPRPSATLAALMNTRGLTELVILGVGLQLGLLDDSLYSLMVVMAVVTTVMTGPLLSLAGSGRSGTPADGTAPRERISAAP

SEQ ID NO: 25105 - protein, 636 aa, Synechococcus sp. RS9917
MSLISLVGAAKDFGIRTLFADLTLHIGDRDRLGLIGPNGAGKSTLLKVLAGVEPLGSGERRCSPRLRIELVGQESAVQPGLTVLEQVLAGCGEKRDLLLRFNALSEAVAANPNDGTLLSALGQLSERMDEAEAWGLEQQCQEVLQRLGISDLQRPVEALSGGYRKRVSLASALVACPDVLLLDEPTNHLDAAAVEWLQSWLDRYPGAVVLVTHDRYVLDRVTNRMVEVERGEARSYAGNYSTYLQRKAEQDAADAASAASFKSVLRRELAWLRQGPKARSTKQKARLQRIEAMREAPTRQARKQLEMTSVSRRIGKIAIEAEQIRVTADGTPDGTVLLEDFTYSFSPEDRIGIIGPNGSGKSTLLDLIAGRRQPSSGQLRLGDTVHLGYLDQHTEALSSGKGLERKVIDFVEEAASRIDLGSEQLSASQLLERFLFPPAQQHSPLSKLSGGERRRLTLCRLLIQAPNVLLLDEPTNDLDVQTLSVLEDLLDDFRGCVVVVSHDRYFLDRTVDRLFCFEQGRLERFDGNYSAFMDQRREQERLASQERPTPSRRPEAQGSSAKPDQGPRRRSFKESRELEALDRELPELEQRKAALESALSTAGSDDLTRLSEELAAVHQQLEQTEERWLELSELAP

SEQ ID NO: 25106 - protein, 560 aa, Triticum aestivum
  misc_feature (164)..(164): Xaa can be any naturally occurring amino acid
  misc_feature (348)..(348): Xaa can be any naturally occurring amino acid
  misc_feature (362)..(362): Xaa can be any naturally occurring amino acid
MAPSIAPPSSPSCLRGKLFPRFTGTNSQPMNSVLRCDISVSPTLASNSLRRTSSVHLANNNRIKSFHVCHAGVDPSERIVVNGQASPSKTVQADAAALGTISADMAPVVDGFSADDDELDLDLPTEGFSSIPEAIEDIRQGKYVIVVDDEDRENEGDLIMAASXVTPEAMAFIVRHGTGIVCVSMKEDDLERLQLPLMVVAKENEEKLRTAFTVSVDAKEGTTTGVSAKDRASTVLALASPYSKPEDFNRPGHIFPLKYREGGVLKRAGHTEASVDLAMLAGLPPAAVLCEIVDDDDGSMALLPKLKEFAERENLKIVSIADLIRYRRKRDRLVERLCVTPLQLQWGXHLKSYCYRSLIDGXMEHIAMIKGDVGDGQDILVRVHSECLTGDIFGSARCDCGGQLALAMTMIEKAGRGVVVYLRGHEGRGIGLGHKLRAYNLQDAGRDTVEANEDLGLPADSREYGIGAQILRDLGVRTMRLMTNNPAKYTGLKGYGLSVLGRVPLLTPITNENRRYMETKRLKMGHIYEDPPNGHTSGMSDEEQYQEDSGSEQDQTLEPQ

SEQ ID NO: 25107 - protein, 455 aa, Zea mays
DQSPNYFPLRIPMPRTVAVVGAGAAGLVAARQLLREGLDVAVFEKSGRAGGTWAYDPCADADPLSRDPGAPGAAHGSLYASLRTNLTRDLMSFSDFPMAGRVFAGDARAFPGHQEVLAFLDAFAEECGVAARVRLRSEVLRVAGAPLGQRERWAVSWRREDGEVAEEVFDAVVVCNGHCTVPQVPGIRGIDNWSGKQIHSHNYRTPEPFRDQNVVVVGFSTSGIDIASEISRLAKEVHVADRYSRDRLGKMALYQNVWIHAEVDCIQDDGKVRFAEGSVVDADVILYCTGYRYHFPFLDLDGLTVDDNRVGPLYKHVFPPMYAPNLSFVGLPTIVFQELEQEAKWVAAVLSGRATLPSEEDMMASVRSHYQLMEEAGRPKRHTHALAAQWAEHMNWLADQVGEPPVEPWKCEMFDKVLASILALDEAYRDRWEQEEDAGSGGHQEGIRIRASSIM

SEQ ID NO: 25108 - protein, 328 aa, Synechococcus sp. RS9917
MAIPPAIVAGARAGWHWQWKRLMQGLAPADAAGHYRRPASDRSVVAAPDPADLAGRSGATLPRLIVGRSCPWAHRTWLVHRLRRLDSTLTLLMARADHRKGLWRLDPAWLHCDTLLQLYQHCGCPPSHRATVPALVDPGRNDKHPARLLGNDSAGLCLALNRWPAPQDAPDLAPEPQRAAIERWQTLLQPRVNDGVYRCGFARTQAAYDQASAALFEALQEVEQALSGAGPWLCGDQLTLADVRLFPTLIRWEAVYAPLFGCSAQPLWTLPALWRWRQRFYALPGVADTCDASIWRQDYFGALFPLHPSGIVPAGFELSKLVKAVPPE

SEQ ID NO: 25109 - protein, 241 aa, Populus trichocarpa x Populus deltoides
MEFVNPEGLRLDGRRPMEMRQLRAQIGAVAKADGSAVFEMGNTKVIAAVYGPREVQNRSQQINDQALVRCEYSMANFSTGDRRRKPKGDRRSTEISLVIRQAMEECILTNLMPRSQIDIYVQVLQADGGTRSACINAATLALADAGIPMRDLVTSCSAGFLNSTPLLDLNYVEDSAGGPDVTVGILPKLDKVTLLQMDAKLPIDTFENVMQLAVEGCKAIANYIREVLLENTKQLEYRRGL

SEQ ID NO: 25110 - protein, 229 aa, Vitis vinifera
MDGGGWFDGDLNGDFEVKRCLSSFVDEGRIESHRYYLARRTLLEMLRDRGYSIPALDIDISLQDFRSFYSQKPDPDRLRISAALRSDPSKKILVIFCGPDVVKVNAIRSIATQIVNKDSLSKLILVLQNHITSQALKAVDLFSFQVEKFQITDLLVNITKHVLKPKHRVLTDQEKNKLLKKYSLNEKQLPRMLQQDAIARYYGLEKGQVVKVIYNGEITGSHVTYRCVW

SEQ ID NO: 25111 - protein, 331 aa, Coprinopsis cinerea okayama7#130
MYHNNSIRILTGNSHPELAQAVAERLNVPLVPCTVKNFSNGEINVRITESVRDEDVFIIQSGCNDVNDHLMELLILVSACKTASARRITAVIPCYPYARQDKKDKSRAPITAKLVANMLTVAGCDHVITMDLHASQIQGFFDIPVDNLWSEPLMIGYIKRSIPGWQEAIVVSPDAGGAKRVTAIADKLGVEFALIHRKRAGKSLTAPERMELLVGDVEDKVVILVDDMIDTGRTLSLAVQTLHEKGAREIYALISHGLLSGSDLEALNELPINKLVVTNTIPQDKHRHILTKLVTVDVSPTIAESIRRTHNGESISLLFGEWAETIGVQTI

SEQ ID NO: 25112 - protein, 264 aa, Vitis vinifera
MAAKLYDTQAKEYRDIRPSYPPELFQFIASKTPIHDLAWDAGAGNGQATLSLAGIYKNVVATDTSQNQLHLAPDLPNVRYQQTTPLMTEAELHHNVATQSSVDVVTVAQALHWFDISAFFQQAKWVLKKPQGVIAAWCYSAPEVDESVDSVFNRYYLESKPYWDPARNILDDKYRSIDFPFMPVDGEVHTGPFKFKTEKLLDLDDYFAYLRSSSGYQMPRKKGVELLRSDVIEDFERAWNEDGNAHKIATFPIYLRIGKVGNPN

SEQ ID NO: 25113 - protein, 276 aa, Vitis vinifera
MGDFYDKLANRYSEIRPNYPPELFQFIASKTPVRDLAWDVGAGNGQAARSLAGMYKNVVATDISQKQLDLAPKLPNVRYQQTSPVSTIADIEHDVAPQSSVDLITIAQAVHWFDLPKFYQQAKWVLKKPHGVIAAWCYTPAEFNQSVDSVFARFYIDAKPYWDPARYHLDDRYRSIEFPFMPVEGEDHTGPFKFKTERQMDLDSYFAYLRTWSGYQTAQKNGVELLTSNVIEDFERAWNEDGGGQKIGVFPIYLRIGKVGIPGSQAPRLENGYLVK

SEQ ID NO: 25114 - protein, 265 aa, Vitis vinifera
MAELFTEQAKQYSEARPSYPPELFQFIASKTPDRDLVWDVGTGSGQAAVSLAGIYKNVIGTETSQSQLEFAAKLPNIRYQYTSPVMTIADLQASVAAQSSVDLVTIAQAMHWFDLPKFYQQVEWVLKKPHGVIAAWCYTVPEVNESVDLVFERFYADSKPYWDSARDLVDDKYRSIEFPFKPVDGEDDTGPFRFKTERIMDLEAYFTYIRSWSSYQTAKKEGVELLRNDVIEDFERAWNRDGKGKKVVTYPIYLRIGKVGNACQT

SEQ ID NO: 25115 - protein, 110 aa, Zea mays
MATATRRLLPALLRTLAPAGARGLSTEKAVGAAAVVGSHTAKWMQDTSKKSPMELINEVPPIKVDGRIAVCDGASEGVGLGHPIEYICLDLEAPNVCKYCGLRYVQVHHH

SEQ ID NO: 25116 - protein, 377 aa, Corynebacterium diphtheriae NCTC 13129
MTHTLTESDVRAALARVEDPEIGKPITEIGMVKSINIDGNNVDVDIYLTIAACPMKNTLVTNTKAAIEDIDGVGTVNVGTDVMSDEQRRELRMSLRGSVDEPVIPFAQPDSTTRVFAVASGKGGVGKSSMTVNLATALAAHGLKVGVLDADIYGHSVPGMLGSTDRPHAVDDMIMPPQAHGVKLISIAHFVEGNAPVVWRGPMLHRAIQQFLADVFWGDLDILLLDLPPGTGDIAISVAQLVPNAELLVVTTPQSAAAEVAERAGSISIQTNQKIAGVIENMGSMVLPDGSTMDVFGSGGGQAMADRLKALTGTPVPLLGSVPLDPRLREGGDAGTPIAVSDPQSPTGAAIHKIADKLVVRRDSLAGKPLGLGVTSH

SEQ ID NO: 25117 - protein, 251 aa, Brassica napus
MAAARLVFSLSLPSSTHGINRKFQPFLLTQTVAPSRVRALRCQATPESSEPQEKLVVDNGSTSETSPATKEASSGFPESPNRDVNRRVAVASVVAALALFLSTRLDFGISLKDLTASALPYEEALSNGKPTVVEFYADWCEVCRELAPDVYKIEQQYKDKVNFVMLNVDNTKWEQELDEFGVEGIPHFAFLDRQGNEEGNVVGRLPRQYLVENVNALAAGKQSIPHARAVGQYSSAEARKVHQVTDPLSHG

SEQ ID NO: 25118 - protein, 293 aa, Physcomitrella patens subsp. patens
VQLEVLDMKIEKGSNDLRNEFKEKLDSQVAEMESGVKDLKAQVDRLYQGGGPLNRDEVIELVKKFMEHRASDSTGKSFSLEDVRSIARKIVMSEVEKHAADGIGRTDYALASGGGRVVDHSEGVFLGRGRQLFSMVFSSILTGEARKHPLAQKVLEPSFGEPGECLPLKGSNVFVEISLRTAILPDAVTLEHVSKSVAYDLSSAPKEFQLYGWREARPADRSAQPSPVHRLLGQFVYKTDGPSNIQTFHLSKEDVGDEPINMVRLHVLSNYGSTLHTCIYRVRVHGVDPQGTL

SEQ ID NO: 25119 - protein, 475 aa, Kluyveromyces lactis NRRL Y-1140
MSAEESQQAQTETAAPVPVPAPAVEQDHSNEATTTVEEKSPGAATTAPATEEAPASEKPASQDNNGDGEKQQEEGDEEDDSAAPVLATQGGREKSDKILYVGNLPKSIDDDLLKQYFQIGGSISSVKIIPDKNSQECNYAFVEYFEPHDANVAYQTLNGKEVEGKVLKINWAFQSQQVNSDETFNLFVGDLNVDVDDATLAGTFKEFPSFIQAHVMWDMQSGRSRGYGFVSFGEQDQAQVAMETKQGFELNGRALRINWASKREPQQSQQGQRRFNGPASGRGGFRNNNNQNQNHHNHNGINRHAGPPPHHQMQSHLPPQLQQQPPIGIPPIHQAPLVPPPVDPEAVEDMMRRAPPRVTTAYIGNIPHFAQEHDLIPLLQNFGFIIDFKHYPEKGCCFIKYDTHEQAALCIVALTNFPFQGRNLRTGWGKEKPTFIRPQQQMGPIPGQLPLEEQQQQFENAPQQHDQQQPQQQEQ

SEQ ID NO: 25120 - protein, 534 aa, Physcomitrella patens subsp. patens
MTKTGLDGSEDHMVVVAISLFVTLLCACIVLGHLMEEFQYISESVTAIILGFCTGIIVLVASNGASSHVLQFNEELFFIYLLPPIIFNAGFQVKKKQFFRNFIAIMLYGVIGVFISFAIISAGCKFTFPKFGLDKLTIGDYLALGTIFSATDSVCVLQVLNQDDSPLLYSLVFGEGVVNDATSVVLFRAVQKLSFKDFTGMEVIRICGSFLQLFFSSTVLGVAIGLLSAYIIKTLYLARHSTDREIALMTIMAYLSYILAELFYLSGILTVFFCGIVMSHYTWHNVTESSRITTRHGFATMSFIAETFIFLYVGMDALDVDKWKMVQISSGDYFGLFFTIITLVLVGRAAFVFPLSALANYMRKSSDTKITFRQQIVIWWAGLMRGAVSIALAFNQFWRCKKVQNMRAAITATILWFLVQVFGTATKPLMRCVLPPTSKSEYLESEPHTPKDFSFSDFHVPLLLGSNQLSGSPRPVARRSSLVMLLSAPTNVIHDAWRAFDDAYMRPLFGGRGFVPYNSDPLTNAEDDVAYPCH

SEQ ID NO: 25121 - protein, 286 aa, Lactobacillus plantarum WCFS1
MTALTKLTDTYTLNNGTKIPIVGFGTWQTPDGQVAYDSVLAALKAGYRHIDTAAAYGNEESVGKAIADSGVAREDLFVTTKLWNADHGYDAAKKALDTSLAKLGLDYVDLYLIHWPNPAAMRDNWEQLNADTWRAMEEAYTARKARAIGVSNFRPKHLDALLKTAKVVPAVNQIFLNPSDMEDEVVAYNRKHDILSEAYSPLGTGKIFSIPELKTLADKYDKSVAQVVLRWSLQHGFLPLPKSVHADRIEQNTELFDFELSDDDMKVIDGFHGVAGLANDPDQVNF

SEQ ID NO: 25122 - protein, 275 aa, Xanthomonas campestris pv. vesicatoria str. 85-10
MPVSRSLLLRRISPLCLCIAAGWGAVGMAQTALPESTPVQAHETAPHSGHEWGYTGPEGAEHWAELAKENALCGNGQQNSPIDLKGAIDANLGTLLLSYSAVPLVVRNTGHSIQLDLHDGGTMATGGKQYQALQLHFHHPSEHLLNGRRFPMEAHLVHQGPDGTLGVLAIFFETGKANPAFQRVLDAMPKDKDQTRQVANTTVSAEAFLPPSNQRSFYRYEGSLTTPPCSETVDWVVLSQPVQVSEAQINAFERVYPFNARPLQPLDRRFLLKSR

SEQ ID NO: 25123 - protein, 251 aa, Bradyrhizobium sp. BTAi1
MAVDLFDLTGRRALVTGSSQGIGLALAHGLSAAGAEIVLNGRDETKLARAESAIAGSRRLAFDVTDHAAARAAVDRFEAEIGPIDILVNNAGMQHRAPLEEFPDEAFQRLLQTNIASVFNVGQACARHMIGRRAGKIINIASVQSALARPSIAPYTATKGAVANLTKGMATDWAKHGLQVNAIAPGYFDTPLNAALVADPAFSAWLEKRTPAGRWGKVEELVGACIFLASAASSFVNGHVLYVDGGITASL

SEQ ID NO: 25124 - protein, 605 aa, Xanthomonas campestris pv. vesicatoria str. 85-10
MHSGGLELALVLMLAAIVAVPVFKRFGLGAVLAYLVAGVVLGPDGVGVVQDAERISGAAEIGVVMLLFVIGLELSPARLKVMRHSVFGAGATQVLVTAVILGGLLMAAQLGWKSALIVGVALALSSTAVGLQLLAERKALSSDYGRLAFAILLFQDLIAIPLLAAIPLLGGSKNATLQWQDVAKAMVALALVIVCGRFVLRHLFNVVARTRMPEVFTASALLVVLGTAWIMQEAGLSASLGAFIAGVLLADSEFRHELESQIEPFEGLLLGLFFISVGMGIDLHRVAAEPWLIAAGVAMLLVVKFSLLVGIGSVAKLPLRSSLMLGSVLWLGGEFAFVVFNEADRVGLLEPANHDRLVAIVGVSMALTPLLLLGMQRILNGPLRVRAPKTDRPYDTIDAQTPKVLVAGMGRFGQVVARLLTARHVPFVALEHNPDTVEDLRRFGSQLYYGDPTRPELLRAAGAERIKVFVIAVDDPDTNIKTVRLICRLYPQATVLARARNRQHAWKLMDLGAEPFREVFASSLELSERVLTSLGLGEALAHDHVKRFRQHDEDLLRRQHLVYDDEAKVIQTSRDARADLMNLFEADVKADVDGDEETVAATRDA

SEQ ID NO: 25125 - protein, 732 aa, Roseovarius nubinhibens ISM
MTDFTMETGADGVAIITWDTQGKSMNVMNQQGFIDLDALIDKALADDAIKGVILTSGKEGSFAGGMDLNIIARIKESAGDNPAQGLMDGLMQCHNILRKIERAGMDPKTNKGGKPIAAALPGTALGIGLEIPLACHRIFAADNPKAKIGLPEIMVGIFPGMGGTTRLVRKMGAMAASPLLLEGKLNDPKKAKQAGVVDEVVPADQLIEKAREWVLSEPNIVKPWDEKGYKMPGGAPYHPAGFMTFVGASAMVHGKTQGAFPAAKALLSAVYEGALVPFDTAIKIEARWFTNVLMNPSSSAMIRSLFINKEALEKGANRPDVADETVRKVGVMGAGMMGAGIALVSAQAGMEVVLIDQKQEAADRGKSYTADYMDKGIKRGKATEAKKDEVLGRITATTDYAALKGCDLIIEAVFEDPAVKAEVTKAVDAVTDDNCIFATNTSTLPITELAKASKNAENFIGIHFFSPVEKMMLVEIIKGRDTGPRAVAKALDYVRQIRKTPIVVNDARFFYCNRCIIPYINEGIRMVAEGVAPALIDNAARQLGFPVGPLQLVDETSIDLGAKIARATRAAMGDDYPDAAVDEVIFWMEGEGRLGRKTAKGFFDYDDKGKRQGYWSGLEEKYPRAEDQPDLITVQHRLMFAQVLEAVRALEEGVLEDIREGDVGAILAWGFAPWSGGPFSWLDILGTPYAADRCDELAEAFGPRFATPALLREMADKGQSFYGRFAGEKAAA

SEQ ID NO: 25126 - protein, 609 aa, Xanthomonas campestris pv. vesicatoria str. 85-10
MSEQATTPPCIIVVFGARGDLTKRLVMPALYNLRRSGALGDEFAIVGMDHGDISERAWRTNMGQSMTQLLSSRDAEFQTDEFDTATWDWLRERMHYLRGDFTDQGAYRSLGGVLDKLHKRYGTQGNVLFYLATAARFFEPVLLNLGEAGLVRQREGEGWRRVIVEKPFGHDLPSAQHLNATVAKVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIRPEDVVRGQYASGAVNRNAVPGYREEDTVPEDSDTETYVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAATPVKKATKKIAKKASKATSKRAGKPAAKSAETGADSSSKPTKKSGVKRATKEVAKKTAKTVRKTAAGKVVATKLVSKSVAARKARR

SEQ ID NO: 25127 - protein, 1314 aa, Bacillus anthracis str. A2012
MVSMLDWMKKLFNKEEEQTAMNKEVPKQVESQPKIPRVNHHTEAREAQMASRNAGKCRFPLVPDNGFDEEDVIETGHFEEQPVQAVTYENEPIQRGIKVERSRRQYVEKVVSTYEEPEMQYEPEREPVVKKASTPAQESNRRPFRPTEMISPIYGYNRPSVEKKEEKQEEVKEREDLEISVEGKSVVDAWLEKKGYTLSDFSEGQAPTSSSHRAANEQGERQYEESKKEEKSVVDQWLEKNGYEIERQEPIVEEKEVVQEMSAPQEVPAAELLHETIAERMEGAKQESDVVDKNILQEELVDSKVEHEDTILSEEIKRSTEIEQPTIEVEKQAPEESVIVKAEEKLEETIVVEIPEEVEVIAEAEEPEEVEVIAETEESEEVEVIAETEESEEVEVIAETEELEEVEVTAETEELEEVEVVAETEELEEVEVIAETEKLEELEEVEVIAETEESEEVEVIAETEAPEEVEPVALEEMQQEMVLNEAIEQKNEFIHVAVADEQTKKDVQSFADVLIAEEQSVVEETPIVEEQPVAEEAPVVEEQSVVEETPIVEEAPVVEGQSVVEEAPIAEEQPVAEETSVVEEQPVAEETSIVEEQPVAEEAPVVEEQPVVQKEEPKREKKRHVPFNVVMLKQDRARLMERHASRTNGMQSSMSERVENKPVHQVEEQPQVEEKPMQQVVVEPQVEEKQMQQVVEPQVEEKPMQQVVVEPQVEEKPMQQVVVEPQVEEKPMQQVVVEPQVEEKPMQQVVVEPQVEEKPMQQVVVEPQVEEKPMQQVVVEPQVEEKPVQQVVEPQVEEVQPVQQVVAEQVQKPISSTEVEEKAYVVNQRENDVRNVLQTPPTYTIPSLTLLSIPQQAALDNTEWLEEQKELLDTTFNNFHVGAHVINVSQGPAVTRFEVQPDPGVKVNKITNLSDDIKLSLAAKDIRIEAPIPGKSAIGIEVPNKESKPVFLREILRSPVFTKSESPLTVALGLDISGDPIVTDIRKMPHGLIAGATGSGKSVCINAILTSILYKAKPHEVKLMLIDPKMVELAPYNSVPHLVAPVITDVKAATAALKWAVEEMERRYELFAHAGARDLTRYNTIVSGREIPGETLPYIVIVIDELADLMMVAPGDVEEAICRIAQKARACGIHLLVATQRPSVDVITGLIKSNIPTRIAFTVSSQVDSRTIIDIGGAEKLLGRGDMLFLGNGTSKPVRVQGVYVSDDEIEKTVDHVKKQMKPNYLFKQEDLLAKTEQAESEDELFLDACQFVVEQGGASTSSVQRKFRIGYNRAARLIEEMESQGIISEGRGTKPRDVLISEDEFAAMQETNV

SEQ ID NO: 25128 - protein, 179 aa, Herminiimonas arsenicoxydans
MSLNHVPAGTDLPNDFNVIIEIPMNADPVKYEVDKESGAIFVDRFMSTAMHYPCNYGYVPQTLSDDGDPVDVLVITPFPLYPGVVVRCRAIGMLKMTDEAGGDAKLLAVPIDKILPIYSHWQKPEDINDLRLQQIQHFFEHYKDLEKGKWVKIEGWVGPDEAKEEIMSGVAAYKKSIAK

SEQ ID NO: 25129 - protein, 474 aa, Clostridium perfringens SM101
MQKTKMIFTIGPSSDSEEILREFIRIGMNAARLNFSHGDHASHKEKIELIKRLRKEEKSATAILLDIKGPKIRTHNFKNGEAELKNGDEFTFSCGDEILGDNTKCSISYKELYEDIKPGGSILVDDGLLEFKVKEVRRTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFQIAETGDNIMVAAGFPTSITGGTNMLKIEKI

SEQ ID NO: 25130 - protein, 276 aa, Vitis vinifera
MAGVAPIPMDTFKLGFIGAGKMAESIAKGVVHSGLMPASRISTAPRSSSRQDAFESLGVKIFETNQRVVEDSDVVVFSVKPQVVEDVVLELRPLLTKKKLLVSVVAGVKLKHLQEWAGHSRFIRVMPNTPAAVGKAASVMSLGKSATEEDGGLIANLFGAIGKIWRADEKYFDAVTGLSGSGPAYIYIAIEALADGGVAAGLPRELAWNLASQTVLGAADMAISTGKHPGQLKDDVASPGGTTIAGIYELEKGGFRGILMNAVVAAAKRSLDLSES

SEQ ID NO: 25131 - protein, 217 aa, Triticum aestivum
  misc_feature (86)..(86): Xaa can be any naturally occurring amino acid
EGEYSGLEHEVVPGVVESLKVMTKFCSERIAKYAFEYAYLNNRKKVTAVHKANIMKLADGLFLESCREVATKYPGIQYSEIIVDNXCMQLVAKPEQFDVMVTPNLYGNLVSNVAAGIAGGTGVMPGGNVGQDHAIFEQGASAGNVGNDKIVQQKKANPVALFLSSAMMLRHLQFPSFADRLESAVKSVIAEGKYRTRDLGGTSTTQEVTDAVIAKLD

SEQ ID NO: 25132 - protein, 293 aa, Triticum aestivum
  misc_feature (282)..(282): Xaa can be any naturally occurring amino acid
MEGKEEDVRLGANRYSEHQPIGTAAQGGGADKKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVXVIRAIPFKSRD

SEQ ID NO: 25133 - protein, 123 aa, Mycobacterium tuberculosis CDC1551
MTTRDLTAAQFNETIQSSDMVLVDYWASWCGPCRAFAPTFAESSEKHPDVVHAKVDTEAERELAAAAQIRSIPTIMAFKNGKLLFNQAGALPPAALESLVQQLKAYEVEAGEATTQNGRAQQA

SEQ ID NO: 25134 - protein, 542 aa, Candida albicans SC5314
MSPPSKIDESFTDIGNTSTSWYTEIKSIEPGVKHLTDSFFTKQKTHDIQFRLNQLRNLYYAVQDNVDALCEALSKDFNRSASETKNLEIVGGLNELVHTIASLHEWVKPEKVTDLPITLKSNPIYIERIPLGVVLIISPFNYPFFLSFSAVVGAIAGGNAVVLKQSELTPNFTRLFSEILTKALDKDIFLAVNGGIPETTELLNQKFDKIMYTGNNTVGTIVAKKAAETLTPVILELGGKSPAFILDDVQDKDIEIIARRIAWGRFTNAGQTCVAVDYVLVPKKLHDKFITALKKVLNEEFYPKLDKTDKTYTHVIHDRAFTNLSKIISTTKGKIIVGGETDPETRYIAPTVIDNVSWDDSSMKGEIFGPILPILTYDKLTDSLRDIIRNHDTPLAQYVFTSGSTSRKYNRQLDQILTTIRSGGLIVNDVLMHVALINAPFGGVGQSGYGSYHGKFSFRSFTHERTTMEQKLWNDFMVKVRYPPYNSNKDNLVRVSQQGYNGKVWFSRTGDVPVAGPGRFFSSWNSFAGVIGLLTEFITNKQ

SEQ ID NO: 25135 - protein, 457 aa, Burkholderia cenocepacia
MSAPLDDPPSFGDDDAPFDRGRLVGELDAGLAFFSPVSVQGRVNHAVGQILNATGIRARLGEICELRTPNQPTLLAEVVGFSRQTTLLTPLGDVAGLSPETTVVPSGREHVFPVGEGLFGRVLDGLGRPLDDRGPVTGAAWVSTQQDPPNPLARKMIDTPFPTGVRVIDGLMTLGIGQRVGIFAPSGVGKSTLLGMIARGAQADVNVIALVGERGREVREFIEHSLSPEVRARSIVVVSTSDRPAMERVKSALVATAIAEHFRDAGKRVLLLVDSLTRFARAQREVGLASGEPPTRRSFPPSTFAVLPRLLERAGQGAHGSITALYTVLVEGDEESDPIAEEVRSILDGHIVLSRKIALANRYPAIDVLASLSRVMPLVASRAHQHAAARVRELIAKYQEIELLVQIGEYREGSDRLGDLALRARDAIGAFCAQASDEDVRFDALLAKLTKLANDHV

SEQ ID NO: 25136 - protein, 578 aa, Candida albicans SC5314
MNPAYNPNPKETFVSITRDSDDSLISTTPDISETEFEDGENLSTPDISIIDDEYTDNEPIDEFENENQIPADSMFQFQLPDMSTTIPRLPSNQDVPSAKDDTFDNYYESYSEKYIEFMNNNPTTYHTISHFKSLLENNGFIFLPDNKPISDLSPGFYFTSKDDQCLVAFIIGGNWKPEKGSCFVGSHCDALSVKINPRGSLRDNVNGYELLGVAPYSGSLNKLWLSRDLGLAGSVLVKDNDTGKISRKLIKSHPDPIAFIPQLPEVFPESPKEYNTQTQMVPICGYTTETLVPTDEEKRSKFYKRHSLSLLRYVSKLAEVPLASIVDLDLDLVDIQTSCRGGLDNEFIYSGSLDDRLCAFDSVYGLIEYSQRFYLDKDIKTFDGLNGIYLANHEEIGSGSRTGAKGGFLIDVLKSIVSDKYKTHTPEAVANLTTNTIFLSSDVTHALNPNFKNVYLENNFPVPNTGPSIKFDSNFHVLSDSKGNEFLTRIIDDLPGIKLQHFHIRNDSRSGGTIGPIMSDSRRGINGAKLIIDVGLPILSMHSIRSIAGYKDVGIGIRFFKEVFSKWQSTINTIENGK

SEQ ID NO: 25137 - protein, 192 aa, Arabidopsis thaliana; identical to SEQ ID NO: 1219

SEQ ID NO: 25138 - protein, 160 aa, Triticum aestivum
  misc_feature (15)..(15): Xaa can be any naturally occurring amino acid
  misc_feature (25)..(25): Xaa can be any naturally occurring amino acid
MLSEWGPPRLIFVKXKFTPIETVEXREEYLVDHVAPSETHSDGGSAATQLAAHLAGIHSAIKMLNSRVRVIQQYLGAMQKGDMPLDNSLLRQVSSLVRRLPAVESEKFQGDFLTEYNDTLLMTYLAMFTNCSSTMNELVEKFNTTYERSPARRGGRGAFM

SEQ ID NO: 25139 - protein, 273 aa, Pisum sativum
MEILPILSDSYTLGFIGAGKMAESIAKGASRSGVLPSSRIVTAHSNPSRRAAFESIGITVLSSNDDVVRASNVVVFSVKPQLVKDVVLKLKPLLTKDKLLVSVAAGIKLKDLQEWAGHERFIRVMPNTPAAVGQAASVMSLGGAATEEDANLISQLFGSIGKIWKADDKFFDAITGLSGSGPAYIYLAIEALADGGVAAGLPRDLALSLASQTVLGAASMATLSGKHPGQLKDDVTSPGGTTIAGVHELEKGGFRGTLMNAVVAAAKRSRELS

SEQ ID NO: 25140 - protein, 408 aa, Bacillus licheniformis ATCC 14580
MTIGEMNIPKRTIMTPGPVEVHPRVLRALSSPVLGQFDPAFTDMMNDVMALLRQIFRTTNKWAFPIDGTSRAGLEAVLASLIKPGDRVLIPIFGRFGYLLAEICERYQADVYTMECPWGDVFEPKEVISEIKRTKPEIVAVVHGETSTGCIQPLEEIGRACRELDVLCVVDAVATIGGTDVNTDEWCLDAVVGGTQKCLSVPSGMAPITFNSRVEKRINERKKVERGIATREDIVLETGRLPISSNYFDLGMLMDYWSPRRLNHHTEATSMLYGLREGARVVLEEGLRERFSRHRLHETALIKGIKAMGLELFTEGRKKLPTVTCVKVPDRVDADLVRKMMLDDFGVEIASSFGPLAGKIWRIGTMGYSCRKENVLFTLAALEAVLIRTGASVSPGNALQAALDFYHE

SEQ ID NO: 25141 - protein, 253 aa, Bradyrhizobium sp. BTAi1
MNRRNALKALAGLALCPVCAQPGFAAEGAPHWSYEGATGPAKWGDLDAANKVCSIGSQQSPIDIEHATQARLPDFKLSWAKTADTIVNNGHTIQLNFADGSGTLKLDGTTYKLLQVHFHRPSEHQIGGKNYPMEAHFVHRAASGGLAVVGVLMTTGRPNPAFAQIVATMPDKEGPAVKADARINPNQMLPNRRSYYRYAGSLTTPPCSEVVEWLLLADPIQVAEADVAKFAKLYPMNARPVQKLDRRFVLQGV

SEQ ID NO: 25142 - protein, 217 aa, Solanum tuberosum
MAEVKLLGLRYSPFSHRVEWALKIKGVKYEFIEEDLQNKSPLLLQSNPIHKKIPVLIHNGKCICESMVILEYIDEAFEGPSILPKDPYDRALARFWAKYVEDKGAAVWKSFFSKGEEQEKAKEEAYEMLKILDNEFKDKKCFVGDKFGFADIVANGAALYLGILEEVSGIVLATSEKFPNFCAWRDEYCTQNEEYFPSRDELLIRYRAYIQPVDASK

SEQ ID NO: 25143 - protein, 362 aa, Campylobacter jejuni subsp. jejuni NCTC 11168
MPADLNDYFNKKNGNSNNNGNNNRQNFNFKAPEFNFKGFGKFSPFVYGVIIIILFLIVAKPFMVINSGEMGIKSTTGKYDPNPLEPGLHFFLPFVQKITIIDTRVRQINYASIEGSNENLSSGSGVINKNSISVLDSRGLPVSIDVTVQYRLNPLQVPQTIATWSLNWENKIIDPVVRDVVRSVVGKYTAEELPTNRNTIATQIEEGIRKTIEAQPNEPVELRAVQLREIILPSKVKEQIERVQIAKQEAERTKYEVERANQEALKKAALAEGEANATIISAKGKAMAVKIEADAQAYSNKEIANSLNTPLLNLKQIETQKEFNEALKVNQDAKIFLTPGGAVPNIWVDTKDAKKQSAANMN

SEQ ID NO: 25144 - protein, 638 aa, Anemia phyllitidis
MAQVMQAQQAPTIATPISGSSPYVAPSLYVGDLDPDVSESELYEVFNQIGQVVSIRVCRDLMTKKSLGYAYVNYGTHQDASQALELLNFTLVKGKPIRIMYSHRDPSIRKSGAANIFIKNLEKSIDNKALHDTFSAFGTILSCRVVMDDAGNSKGYGFVQFEKEESAQIAIEKVNGMLINDRQVSVAPFIRKQERDMASSKNFNNVYVKNLAEATTDEDLRKVFAGFGPISSAVVMRDADGKSKCFGFVNFENVDDAANAVENLNGKLINEKEWYVGRAQKKSEREAELKAKFEQVRKEKEEKFQGVNLYLKNIDDSIDDEKLRELFAVFGTVTSCKVMKSPQGQSMGSGFVTFSAPEEAMQAVNDMNGKMVGSKPLYVALAQRKEERRARLQAQFAQMQIVAPNAPPMAPNPPSMYHPGPQGMGHQMFYGQPAPGLLPSQANGFGYQQPMVPTMRPTSAGVPNYFMPVQRPGQQIQRPVNRRGGVGPLQPQHHQPPPQQFPRGGNRSMRYSQFSRTMPDSTMQGFGMMGAANASNIGLMPALASALASASPEEQRVMLGEQLYPLVDRLEHDHAGKVTGMLLEMDQPEVLHLIDLLRQLKAKVAEAMDVLRMAQGSISSNSPLDQLASLSLTESLTS

SEQ ID NO: 25145 - protein, 422 aa, Oryza sativa
  misc_feature (249)..(249): Xaa can be any naturally occurring amino acid
MADRFFPNNMPGYADEGAPPPPAAAAAAAIPSTYSSSLHHLLSLPYPDLADRFLHAALHLKQKVVHETWDKRRRAAAAAGEAVGDFTLYTGALGTALLLFRAYLVTGDRADLATCAEIVAACDAASMGAEIATFICGRAGVCALGAVVAKHAGDEAGVAHYLSAFKEIKIHSKSPDELLYGRAGYLWACTFLNKHLGDNTIPPTTTDTVMRDIIRDGRTLSTIGCPLMYEWYGEKYWGALNGLLGFMHXLLDMDLTKDDTECVKGTLRYMIQNRFPSGNYPVTEEDKHDRFVHWCHGAPGISLTLAKASQVFPEERFLEAIAEAAEVVWNRGLLKRVGICHGVSGNAYTFLALFRLTKKKEPLSRAKAFACFLLDRAKQLIADGIMHSGDEPYSLFEGQVGMAYLFLDMINPLDSRFPGYEL

SEQ ID NO: 25146 - protein, 217 aa, Oryza sativa
MAPPLQVATTASSSTREGKAPALNERILSSMSKRSVAAHPWHDLEIGPEAPTIFNCVIEIPRGSKVKYELDKKTGLVKVDRVLYSSVVYPHNYGFIPRTLCDDSDPLDVLVIMQEPVIPGCFLRAKAIGVMPMIDQGEADDKIIAVCADDPEYKHYNDIKDLPPHRLAEIRRFFEDYKKNENKEVAVNDFMPATSAYETIRHSMDLYATYILEGLRR

SEQ ID NO: 25147 - protein, 231 aa, Synechococcus sp. RS9917
MKQAVAAAAVDAIQDGMVLGLGSGSTAALMIQGLGAKLAAGELRDIVGVTTSFQGEVLAAELGIPLRSLNAVERIDLAIDGADEVDPAFQLIKGGGACHVQEKLVAARAERFIVVVDATKLVDRLNLGFLLPVEVLPGAWRQVQARLASLGGAAELRMATRKAGPVVTDQGNLVLDVRFGEGIADPRALEQTINNIPGVLENGLFVDLADEVLVGEVTDGVAGVRRLERQG

SEQ ID NO: 25148 - protein, 349 aa, Arabidopsis thaliana
MGKVPSSFRSMPANLLVRKTTPSPPAPPRDFRNRTAVGGDSAKLPQNTQAPREPSLRNPFKSPNLSDAKSLFNSIAATSRIPLDLKFHNSVLQSYGSIAVVNDTVKLFQHILKSQPNFRPGRSTFLILLSHACRAPDSSISNVHRVLNLMVNNGLEPDQVTTDIAVRSLCETGRVDEAKDLMKELTEKHSPPDTYTYNFLLKHLCKCKDLHVVYEFVDEMRDDFDVKPDLVSFTILIDNVCNSKNLREAMYLVSKLGNAGFKPDCFLYNTIMKGFCTLSKGSEAVGVYKKMKEEGVEPDQITYNTLIFGLSKAGRVEEARMYLKTMVDAGYEPDTATYTSLMNGMCRKG

SEQ ID NO: 25149 - protein, 417 aa, Bacillus subtilis
ILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARYPAPDFN

SEQ ID NO: 25150 - protein, 404 aa, Populus trichocarpa x Populus deltoides
MASATFSVAKPSLQASGKGFTDFSGLRSSSAFLPFTKKTSDDFVSVVAFQTSAMGNSSGGYRKSAAEAKIKVAINGFGRIGRNFLRCWHGRKDSPLDVIAINDTGGVKQASHLLKYDSTLGIFDADVKPVGDNAISVDGKVIKVVSSRNPLDLPWKDMEVDLVIEGTGVFVDREGAGKHITAGAKKVLITAPGKGDIPTYVVGVNADAYNPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNLGFRESAEKELKGILSVCDEPLVSVDFRCSDVSSTVDSSLTMVMGDDMVKVIAWYDNEWGYSQRVVDLAHIVADQWK

SEQ ID NO: 25151 - protein, 251 aa, Nicotiana glauca
MPINQIAVGSHEELRQSGTLKAALAEFICTLIFVFAGQGSGMAFNKLSADGVATPAGLISASIAHAFGLFVAVSVGANISGGHVNPAVTFGAFVGGNITLFRGILYIVAQLLGSTVACFLLEFATGGMSTGAFALSAGVSVWNAFVFEIVMTFGLVYTVYATAVDPKKGDLGVIAPIAIGFIVGANILAGGAFTGASMNPAVSFGPALVSWTWTHQWVYWAGPLVGGGIAGVVYELVFINHSHEPLPSGDF

SEQ ID NO: 25152 - protein, 284 aa, Nicotiana glauca
MAKNVGSEGSFTTKDYQDPPPAPLIDPVELTQWSFYRALIAEFIATLLFLYITVLTVIGYKSQSATTTDPCAGVGILGIAWAFGGMIFVLVYCTAGISGGHINPAVTFGLFLARKVSLIRAVMYMVAQCLGAICGVGLVKALQSAYYHRYDGGVNMLSDGYSHGVGLSAEIIGTFVLVYTVFSATDPKRNARDSHIPVLAPLPIGFAVFMVHLATIPITGTGINPARSLGAAVIFNQHKAWKDHWIFWVGPFIGAAIAAFYHQFILRAGAAKALGSFRSSTSQV

SEQ ID NO: 25153 - protein, 550 aa, Triticum aestivum
MATTAALPFSCATTLQTLTRTLSPRRSLLIHRHRLRSLAASPRLPDRPRPRLHRPVSASAAPNGSSSAGEYDYDLFTIGAGSGGVRASRFATTLYGARAAICEMPFSTISADDLGGLGGTCVLRGCVPKKLLVYASKFSHEFEESHGFGWTYDTDPKHDWSTLIANKNTELQRLVGIYKNILKNANVDLIEGRGKVVDPHTVSVDGKLYTAKNILIAVGGRPSMPDIPGIEHVIDSDAALDLPSKPEKIAIVGGGYIALKFAGIFNGLKSDVHVFIRQPKVLRGFDEEVRDFVAEQMSLRGITFHTEHSPQAITKSNDGLLSLKTNKETIGGFSHVMFATGRKPNTKNLGLEEVGVKMDKKGAIVVDEYSRTSVDSIWAVGDVTDRINLTPVALMEGGAFAKTLFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDVTVGVHPTSAEEFVTMRSPTRKVRRKTAAEAESKDEVVTQK

SEQ ID NO: 25154 - protein, 179 aa, Oryza sativa Japonica Group
MATKAGVIATLLALNLHFFTFSDACGCQCGSCPSGGGGGGGGGGGGRGGGGGSGGGSGGGGGSGGGGSGGGGSGGGGSGGGGGGGSGGGGGGGRCPIDTLKLGVCANVLNGLINVQLGTPPRQPCCSLIQGLADLEAAVCLCTALRANILGINLNLPINLSLLVNYCGRSVPSGFQCSN

SEQ ID NO: 25155 - protein, 156 aa, Nicotiana glauca
FILVYCTAGISGGHINPAVTFGLFLARKVSLIRAVLYMVAQCLGAICGVGFVKAFQSAYYVRYGGGANVMAPGHTKGVGLAAEIIGTFVLVYTVFSATDPKRNARDSHVPVLAPLPIGFAVFMVHLATIPITGTGINPARSFGAAVIYNHDKAWDE

SEQ ID NO: 25156 - protein, 192 aa, Bacillus anthracis str. Ames
MSMTEICLVRHGQTDWNFQEIIQGREDIPLNEVGKKQASQSAAALQAEAWDVIISSPLIRAQETAKEIAEATGLQSILLDERFVERNFGEASGKPVATVRELIAEGKVEGMEQDEEIVARCFAAVKDVAETHSGKRIIIVAHSHAIKAILHAIAPEDITFKTPLKNACISYVNENSGKWDVLKYNIAEHIHV

SEQ ID NO: 25157 - protein, 447 aa, Roseovarius nubinhibens ISM
MTKRVAVIGAGPSGLAQLRAFQSAADQGAEIPEIVCFEKQANWGGLWNYTWRTGLDENGEPVHCSMYRYLWSNGPKEGLEFADYSFEEHFGKQIASYPPRAVLFDYIEGRVHKADVRKWIRFNSPVRWVSYDAETAKFTVTAHNHETDSTYSEDFDHVICASGHFSTPNVPFYEGFDTFNGRIVHAHDFRDAREFEGKDVLVMGASYSAEDIGSQCWKYGAKSITSCYRSAPMGYAWPDNWEEKPALEKLTGKTAHFADGSTRDVDAIILCTGYKHFFSFLPDDLRLKTANRLATADLYKGVAYVHNPAMFYLGMQDQWFTFNMFDAQAWWVRDAILGRITLPKDKAAMLADVAERETREEASDDVKYAIRYQADYVKELVAETDYPSFDIDGACDAFFEWKKHKAKDIMAFRDNSYKSVITGTMAPVHHTPWKEALDDSMEAYLQN

SEQ ID NO: 25158 - protein, 95 aa, Triticum aestivum
  misc_feature (36)..(36): Xaa can be any naturally occurring amino acid
  misc_feature (42)..(42): Xaa can be any naturally occurring amino acid
RPRVRSRVRTRVRLTSIFSTEKDRVNWPIYFKICAXRHGDRXCCLYNKWTVSPTLLLWNMYHRANMITPGVDTQGNPIDTRTIQGDLEDFDEDII

SEQ ID NO: 25159 - protein, 86 aa, Triticum aestivum
ECSCPELEELVNICRNNGALGARLTGAGWGGCAVALVKESIVPQFILNLKECFYQSRIDKGVIKKNDLGLYVFASKPSSGAAIFKF

SEQ ID NO: 25160 - protein, 469 aa, Lactobacillus plantarum WCFS1
MAMLYGKHNHEAEEYLEPVFGAPSEQHDLPKYRLPKHSLSPREADRLVRDELLDEGNSRLNLATFCQTYMEPEAVELMKDTLAKNAIDKSEYPRTAEIENRCVNIIANLWHAPDDEHFTGTSTIGSSEACMLGGLAMKFAWRKRAQAAGLDLNAHRPNLVISAGYQVCWEKFCVYWDVDMHVVPMDEQHMALDVNHVLDYVDEYTIGIVGIMGITYTGQYDDLAALDKVVTHYNHQHPKLPVYIHVDAASGGFYTPFIEPQLIWDFRLANVVSINASGHKYGLVYPGVGWVVWRDRQFLPPELVFKVSYLGGELPTMAINFSHSAAQLIGQYYNFIRFGMDGYREIQTKTHDVARYLAAALDKVGEFKMINNGHQLPLICYQLASREDREWTLYDLSDRLLMNGWQVPTYPLPANLEQQVIQRIVVRADFGMNMAHDFMDDLTKAVHDLNHAHIVYHHDAAPKKYGFTH

SEQ ID NO: 25161 - protein, 146 aa, Acidobacteria bacterium Ellin345
MKLRVVWIGKTKESAIQTLTGEYLKRLSRYVATEGLEIGSEEALLKLKDRPGRTAPVLVLMDERGKQVGSEELANFLGYHRDQGVQDLIFAIGPSDGWQKETLKSATQVLSMGKMTLPHELARVVLLEQLYRGYTILTGHPYHGGH

SEQ ID NO: 25162 - protein, 400 aa, Rhodospirillum rubrum ATCC 11170
MSIVAERLSAIKPSPTLAVTTKAAELKAAGRDIIGLGAGEPDFDTPDHIKQAAIAAIERGETKYTAVPGTAALRKAICAKLKRENDLEYTIEEISVGCGGKQTIYNALMATLNPGEEVIIPAPYWVSYPDIALLAGGVPVFVPSGPEVGFKLQPADLERAITPKTKWLILNSPSNPTGVAYSAADLKALAEVLLKHPHVWVMTDDMYEHLVYDGFKFATIAQVEPKLKDRTLTLNGVSKSFAMTGWRVGYAAGPVAVIKAINKIQSQSTTHTSSISQAAALAALEGPMDFLIERNAIFKERRDLVVRMINDCPGLSVGTPEGAFYVYPSCAGVIGKTTPEGKLLETDSDFVAALLESEGVAAVQGVAFGLSPYFRISYATATATLEDACQRIRRFCESLR

SEQ ID NO: 25163 - protein, 624 aa, Glycine max
MDAIVQTRGLLSLPTNPKTRVSHHLHLSHGLKHRFLSLKPKPLSTPSLSAAAAVKFHPFGPKPQNLFICRAEAAAAADGPAQPAFGEPEVAEKPKLLGIEITTLKKIIPLGLMFFCILFNYTILRDTKDVLVVTAKGSSAEIIPFLKTWVNLPMAVGFMLLYTKLANVLSKQALFYSVILPFIAFFGAFGFVLYPLSNYIHPEAFADKLLNILGPRFLGPLAIMRIWSFCLFYVMAELWGSVVISVLFWGFANQITTIEEAKRFYPLFGLGANVALIFSGRTVKYFSNLRQNLGPGVDGWAISLKAMMSIVVGMGFAICFLYWWVNNYVPLPTRSKKKKEKPKMGTMESLKFLVSSKYIRDLATLVVAYGISINLVEVTWKSKLKAQFPSPNEYSSFMGDFSTATGIATFTMMLVSQFIFDKYGWGVAATITPTVLLLTGVGFFSLILFGGPLAPGLASLGMTPLLAAVYVGALQNIFSKSAKYSLFDPCKEMAYIPLDEDTKVKGKAAIDVVCNPLGKSGGALIQQFMILTFGSLANSTPYLGGILLLIVSAWLAAAKSLDTQFTALRKEEELEKEMERAATVKIPVVAESEGGNGSLTAGSPLNPSSGDSSSSPSEASTPHN

SEQ ID NO: 25164 - protein, 372 aa, Desulfitobacterium hafniense DCB-2
MKLFEYQAKELFAESGIPIPQNALIGDISELNSALEKIGLPCVLKAQVLQGGRGKAGLVKFVRTKEEAQKEAERILEATGKKLLVEEAVPYEREMYVSITVDAASGLAMVMACLEGGVDIEQIARTTPEKIIKEKVDMSLGLMAYQADNIMYGLGLEQSAAKEGSKILLKLYQLFVKYNAELVEINPLMILRDGTMAAADGKFNLDDNALYKQNRFSLTRDHYKSDFEYEAALDGIPYIAFEGDIGMMVAGAGLANVVLDLIHYYGGTVANYLEFGGPNYHKAQQCMKMMLKAKPKCILIATFGTIARADVMAQGIVEAVKELKPEIPIVAVIRGTGEEDAQKLLRSAGLPSLSDTEEAVRKAVEIVGGAEN

SEQ ID NO: 25165 - protein, 487 aa, Synechococcus sp. CC9311
MAAAAPASTGSKGVVRQVIGPVLDVEFPAGKLPKILNALRIEGTNTAGEAIGLTAEVQQLLGDHRVRAVAMSGTDGLVRGMEALDTGSPIAVPVGEATLGRIFNVLGEPVDEQGPVNTNVTSPIHREAPKLTELETKPKVFETGIKVIDLLAPYRQGGKIGLFGGAGVGKTVLIQELINNIAKEHGGVSVFGGVGERTREGNDLYEEFKESGVINADDLSKSKVALCYGQMNEPPGARMRVGLSALTMAEHFRDVNKQDVLLFVDNIFRFVQAGSEVSALLGRMPSAVGYQPTLGTDVGALQERVASTLEGSITSIQAVYVPADDLTDPAPATTFAHLDATTVLNRALASKGIYPAVDPLDSTSTMLQPAVVGDEHYRTARAVQSTLQRYKELQDIIAILGLDELSEDDRQTVDRARKIEKFLSQPFFVAEIFTGMPGKYVKLEDTISGFNQILAGDLDSLPEQSFYLVGNIDEVKAKAEKIAAESK

SEQ ID NO: 25166 - protein, 339 aa, Synechococcus sp. CC9311
MRVEQPTPPPSLLLLATGGTIAGRGVTSTSLSSYTAGAMSGSELLQELPQLQEAAQIQVEQLVNLDSADLQFQHWKRLATRIREAFAESCELAGVVITHGTNTLEETAWLLELLIDDPRPVVLVGAMRPATALSADGPLNLFQAVQVAASPQACGHGVLVVMDGQIHGARAVTKVATQGVGAFQSPDLGPLGWVDDSGVHLPVASGFRSVPFATLALPDQWPEVAILYGCVNPSLALVSSLFQAGVKGMVWTGTGAGQLSAGEREAIKTWPGVLPLMLRANRCGRGPVHPCALQDELGLLPAGTLNPQKARILLLLALIAGMERAELSALLVTMSMNVG

SEQ ID NO: 25167 - protein, 489 aa, Triticum aestivum
  misc_feature (137)..(137): Xaa can be any naturally occurring amino acid
  misc_feature (149)..(149): Xaa can be any naturally occurring amino acid
  misc_feature (266)..(266): Xaa can be any naturally occurring amino acid
  misc_feature (319)..(319): Xaa can be any naturally occurring amino acid
  misc_feature (349)..(349): Xaa can be any naturally occurring amino acid
  misc_feature (367)..(367): Xaa can be any naturally occurring amino acid
  misc_feature (402)..(402): Xaa can be any naturally occurring amino acid
MVKICCIGAGYVGGPTMAVIAIKCPAIEVVVVDISKPRIDAWNSDTLPIYEPGLDDVVKACRGKNLFFSTDVEKHVAEADIIFVSVNTPTKTRGLGAGKAADLTYWESAARMIADVSKSDKIVVEKSTVPVKTAEAXIEKILTHNSKGXINYQILSNPGVPSPRGTAIEDLFKPDRVLIGGRGDPRGARRPVQALKGGVRPTGVPEENIITTNLWSAELSKLAANAFLAQRISSVNAMSALCEATGANVSEVSYAIGKDSRIGPKXFLNASVGFGGSCFQKDILNLVYICECNGLPEVANYWKQVIKINDYQKSRFVKXGVVSSMFNTVSGKKIAVLGFAFKKDTGDTXRETPAIDVCKGLVGDKAXVSIYDPQVTEEQIQRDLAMNKFDWDHPMHLQPTSXPTAVKQVSVVWDAYEAAKGAHGVCILTEWDEFKKLDYQKIFDNMQKPAFVFDGRNVVDAEKLREIGFIVYSIGKPLDGWLKDMPAVA

SEQ ID NO: 25168 - protein, 636 aa, Physcomitrella patens
MASEVAKPVENGIHPKLEQSFDAPAATKPSNSELLKLHRDGVPFVMPSKRGIDTTAPDFDPQDFLDLLAEDVMFIQHEKLREILEVQADVEYLRRVGLNGRTDVESFRKCVPIVSYGDLEADIMRVVNGEKTPIFTVDPIVTLNLSSGTTAGKPKFIPSTTRAYEYFMFLQTFVTSIYRREFPGYKDGTSFTLAFAGKQIDTPSGIKAGAQSTNHFRGPMFRNRVRNANREYCVPDEVILSDDTTQSMYCHLLCALAQAPEIVKVYGTFAASIVSAVRALQKHWSEIVEDIRTGTLNAKITEPEMRTAVQQMLHPNPDLASRIEEECSKDNWEGILPRLFPNAHFVSCVISGSMLQYAPALKHFSGHLPTISLAYAACECSFIGFNPSMKCAPEDITYMLWPETAYYEFIPLDEDSNPEQDGDVVRTVEACDLEVGRQYELVVTNVIGLYRYRLGDVLTMKRFHKTAPVFEFVRRKNVILSVHTDKTDEKELQSVVNLATEALAGTGMELSDYTSTADVSTLPGRYVIFWEMVDSSDLDYDVLQHCANTLDANFNSDYRRWRSGHQIGPLELRIVKEGTFNRVMDSAVARGASPSQYKPPRCVNNPHTRQILDDGLVASFHSTITPNPAPIALTGS

SEQ ID NO: 25169 - protein, 271 aa, Rhodospirillum rubrum ATCC 11170
MTDSLTVDLSEEDVARFGTDPARAFAANLLTVRDRIASACRRCGRQPEEVRLLPVTKTVPAPLLRLAFAAGLSDFAENKLQEARDKQVELADLAIRWSIIGHLQTNKVKYLVRFAAEFHALDSLRLAEEMNRRLDAQGRDLDVFVQVNTSGEASKYGLPPAEVIPFVERLADYPRLKPRGLMTLAIFSADTDRVRTCFRLLRALRDQTATLHPGMTQLSMGMSGDYEAAIEEGADVVRVGQAIFGPRPTADAFYWPGLIPPPDQQKSGNAP

SEQ ID NO: 25170 - protein, 668 aa, Emericella nidulans
MADGLNMGSLTLNDSQHAPAPGGPPSGGRAAYIPPHLRQRQVNANGDGASAPPPGPTGGSWGGPRGPRGGNWANANAPDFNPRGPNGNTNTNSGWTATEAGRPLFNPNAYGNPGHGGGYAGASARGSGDGQWRDGKHIPGPPNPRLERELFGVPNDPTKQNTGINFANYDDIPVEASGHDVPEPVNTFTNPPLDDHLISNIALARYQTPTPVQKYSIPIVMNGRDLMACAQTGSGKTGGFLFPILSQAYQNGPAAPPPSAAGQFGRQRKAYPTSLILAPTRELVSQIFDEARKFAYRSWVRPCVVYGGADIGSQLRQIERGCDLLVATPGRLVDLIERGRISLVNIKYLILDEADRMLDMGFEPQIRRIVEGEDMPNVNDRQTLMFSATFPRDIQMLARDFLKDYVFLSVGRVGSTSENITQKVEYVEDHDKRSVLLDILHTHGTTGLTLIFVETKRMADALSEFLINQRFPATAIHGDRTQRERERALEMFRSGRYPILVATAVAARGLDIPNVTHVINYDLPTDIDDYVHRIGRTGRAGNTGIATAFFNRGNRGVVRDLIDLLKEAHQEVPSFLESIAREGSGYGGRGGRGGRGRGANATRDMRRMGGGMGGPPSYGGGSGFGAPASNYGGGYGGAPSYGGAGYGGGYGGGGYGNPSGSTGPSSWW

SEQ ID NO: 25171 - protein, 453 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNNNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQPLIMNDQQQPVMSEQQQQQQQQQQQQ

SEQ ID NO: 25172 - protein, 266 aa, Oryza sativa Japonica Group
MAMGSSDGDVLYARCLVTLYLLSPLNVFALWFMSAPYGKLSRPGWGPTVPAALAWCLMESPTLWLPPLVLSATTTSLSTPTLRVTILPAALYMLHYVHRTLVHPLRLLRLRRAPAPMPILIIMFGFSFNLLNAYIQARSWALDAVPPATATPLTVARCLVGLALFVWGMWTNIAADRELLRLKEAGKGYQIPKDGLFDLVACPNYFGETVEWLGYALVAWTPAAWAFFLYTCVNLGPRARDQRLWYISKFGDKYPASRKAFIPYIY

SEQ ID NO: 25173 - protein, 355 aa, Thlaspi caerulescens
MKITQNVKLLVFFFFISLLFIAVSAGESKCKCSHEGDQKNKAGARKYKIAAIPCVLASGVIGVLFPLLGKYFPSLKPETNFFFVTKAFAAGVILATGFMHVLPEGYEKLTSPCLEGGAWEFPFTGFIAMVAAILTLSVDSFATSYFYRLHLKPSKKIGDGEERSGGGGDELGLHVHAHGHAHGIVGVDSGGSEVQTHRSRVVAQVLEVGIIVHSWVIGISLGASQSPDTAKALFAALMFHQCFEGLGLGGCIAQGNFNRMWITIMSILFSVTTPIGIAVGMGIANSYDSSSSTALIMQGVLNSASAGILIYMSLVDFLAADFMHPKMQSNTGLQIMAHISLLVGAGIMSLLAKWA

SEQ ID NO: 25174 - protein, 370 aa, Herminiimonas arsenicoxydans
MSISTTQEIVAELRAGRMVILVDEEDRENEGDLVLAAEFVTPEAINFMAKFGRGLVCLTLTEEHCDQLALSMMTSRNGTSYGTNFTVSIEAAEGVTTGISAADRAKTIQVAVARNAKPSDIVQPGHIFPLKAQKGGVLMRAGHTEAGCDFAELAGLVPAAVICEIMKDDGTMARLPDLIEFAKEHDLKIGTIADLIHYRSQHESIVDRVDERTMETVYGTFHAVLYRDKPSGGAHLALVHGDIAPDQETLVRVHQPVSILDLLDTRATTHSWNMASAIAAIRQVERGVMVLLNCEESAEELFSQFAALTHPDTRPQQRAARMDLRNYGIGAQILKDLSVGKMKLLANPRKMPSMTGFNLEVTGYRATPES

SEQ ID NO: 25175 - protein, 141 aa, Brassica napus
MLRSSLASLIVDLNLRRTLRLSSPAAHLSRSSGCVFAPRHSSQKAITFRVQRCRPHHRVTPSFSSSSYPPPPSSSSKVLTLPTVLTLCRVAAVPLLVATFYVDGWWGATATTSIFVAAAVTDWLDGYLARKMKLGSAFGAF

SEQ ID NO: 25176 - protein, 166 aa, Herminiimonas arsenicoxydans
MTVGTYEMNLAGEGLRIGIVQARFNQDVCHGLLSACLAELKHLGVVDEDILHVTVPGALEIPLALRKMAETLQFDALIAIGAVIRGETYHFELVSNESGAGITRVGLDFGLPIANAVLTTDTDEQAEVRMEEKGTDAARVAVEMANLTIALEDLADAGDDADDEDD

SEQ ID NO: 25177 - protein, 511 aa, Chlamydophila caviae GPIC
MTSNENKDGGKTLLPCPPCVMVIFGATGDLTARKLFPALYHLIKEGRLSENFVCVGFARRKKSHEEFREEMKQAIQNFSRAQELDIRIWEEFESRIFYHESNFSSPEGYASLKERLEDIDKKYKTQGNRLFYLSTPPEYFPEIIENINKHKLFYHDQSEGKPWSRVIIEKPFGVDLQSAKELQKYIDDNLDEDSVYRIDHYLGKETVQNILTIRFANTLFESCWNSQYIDHVQISVSESIGIGTRGNFFEKSGMLRDMVQNHMMQLLCLLTMEPPSVFNSEEIKKEKINILKKIRPFAKEDIIRGQYGPGEVQDVSVLGYREEDNVAPDSNVETYVALKMFIDNPRWLGVPFYLRAGKRLSKRSTDISIIFKKSLPSLFTAESCPVCPLENDLLIIRIQPDEGVALKFNCKVPGMNNIVRPVKMDFRYDTYFKTTAPEAYERLLCDCILGDRILFTCSDEVMDSWELFTPILKRWEQDSSDAHFPNYVAGSSGPKEAEELLQADGRSWRPL

SEQ ID NO: 25178 - protein, 476 aa, Opitutaceae bacterium TAV2
MQGKIVQVIGAVVDVQFAETAMPPIYQALTVEFEVNAKKERLTLEVQQHLGDGVLRAIAMSSSEGLRRGMPVMDTGAPISVPVGDGVLGRIFNVTGDPVDNKGPVKFDKKYPIHRPAPSIAEQDTKAEILETGIKVLDLICPFTKGGKAGIFGGAGVGKTVVILELINNIAKAHGGYSVFAGVGERSREGNDLYHEMSEAGVINQDDLSKSKVALVYGQMNEPPGARMRVALSALAMTEYFRDEKNQDVLLFIDNIFRFSQAGSEVSALLGRSPSAVGYQPTLANEMGILQERITSTKKGSITSVQAVYVPADDLTDPAPANTFAHLDSTIVLERSIAELGIYPAVDPLASTSKALDPAIVGEEHYTVAREVQRVLQRYKDLQDIIAILGLDELSPEDKQTVYRARKLQRFLSQPFSVAEVFTGSPGKYVSVKDTVRGFKAILDGELDHVAEGDFYMKGGIEEVLAVSGATKPAKT

SEQ ID NO: 25179 - protein, 348 aa, Zea mays
LEGRASAAAKKKSSRETLLTLTEGDMMRKLRELLQKSDNRVCADCGAPDPKWASANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHKDNTVSLSASFSSEAGMVEFIGILKVKVIRGTKLAVRDLMSSDPYIVLTLGQQKAKTSVSKRNLNPVWNEELKLSVPQQYGPLKLDPTQQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 25180 - protein, 372 aa, Mycobacterium avium subsp. paratuberculosis K-10
MPHQLRKRRPAVSAALPEFPWDTLAEAKALAGSHPDGIVDLSVGTPVDPVAPVIQQALAAAGSASGYPATAGTARLRDSAVAALARRFGVVGLTEASVLPVIGSKELIAWLPTLLGLGPADLIVVPELAYPTYDVGARLAGAWVLRADSLTQVGPQSPALYYLNSPSNPTGRVLGVDHLRKVVAWARDRGCLVASDECYLGLGWDAQPLSILHPQVCDGDPTGLLAIHSLSKSSSLAGYRAGFVAGDAELIAELLAVRKHAGMMVPTPVQAAMVAALDDDAHERTQRQRYERRRAALLPALRSAGFAVDHSEAGLYLWVTRGEPCRDTITWLARRGILAAPGEFYGPRGAQHVRVALTADDERIAAAVRRLA

SEQ ID NO: 25181 - protein, 336 aa, Cryptococcus neoformans var. neoformans JEC21
MIATQRPFPIPSPVPLAPSSTVLPTTVPENAPEHCPGVESSQAGKADACEGCPNQSVCAEGPKGPDPDLPLIRERMSSVRRKILVLSGKGGVGKSTFTAGLSWALAADEECQAGIMDIDICGPSIPLLMGLESSTIHTSASGWSPAYALDNLAVMSIGFLLPSSSDAVIWRGPKKNGLIKQFLKDVEWGDLDYMVVDTPPGTSDEHLSIVQYLKEAGIDGAVLVTTPQEVALQDVRKEIDFCKKVGIPILGLVENMSGFVCPNCKNESQIFAPTTGGAEAMGKELGIELLGKVPLDPRIGMTCDQGMSFLDEYPESPATMAYLDIVQRIREILDDE

SEQ ID NO: 25182 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWIEAADLIVKGMEGAINAKTVTYDFERLMEGAKLL

SEQ ID NO: 25183 - protein, 385 aa, Escherichia coli
  misc_feature (191)..(195): Xaa can be any naturally occurring amino acid
  misc_feature (215)..(215): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGINPCSEEXXXXXVRAAIEYAIATDRDSVTLVXKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEG

SEQ ID NO: 25184 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLL

SEQ ID NO: 25185 - protein, 285 aa, Glycine max
MASSRPPPSKSVDLDLTIVSAKHLKNVNWKNGDLKPYVVFWVDPERRLATKSDDSGNTSPVWNERFALPLPLPLHDSFLTLEIFHSKPSDTPKPLVATLRLPLKDLHDSTRLRKFPLSRPSGRPHGKIHLKLGLLGRPQFDYASLNTNPNPNFVCYRGYTPSHSPSPPASPYTSYTSYTDSYSNYYPAYYSGAPPPPPPRPFFDRYAGPSGPSAPLDYSSTYDPMPKPPKMGLGAGLAIGAVAGALGGLALDEGLNYEEDKIAERVENDVAAAARDDYSDYRVDY

SEQ ID NO: 25186 - protein, 290 aa, Physcomitrella patens subsp. patens
MKFTRGSDTGLWLLTTSVSYLALFSILVSIPELALAQPNEDDIACLHGFQSMAKSSDPALFNNWTDTAFPCNTTQDGQRATFVGITCSSSRVVSLFLSDKGLTGMISPNLSLCRNLGILDLSQNSLTGTLPSELGMLSYLMTLNVSHNQISGPIPPEIANCSYLHELDLEHNRFSGEVSTALATLQKLQILDVSHNDLVGPIPTGLSNTSDGRPRFNASSFEGNPRLYGFPLPYPKSRTLSILAIVGIGLGSGFLSLIVSFTAVCVWLRVTEQRLAAEEGKISQLVPEYD

SEQ ID NO: 25187 - protein, 306 aa, Synechococcus sp. CC9311
MGWTLKDIPDQTGRLALVTGANSGLGLETSRALLQKGATVLMACRNQKKSEAARRDLLELGTTGVDLLDLDLSDLNSVERCAKAVQERYGRLDLLMNNAGLMAPPRRLSVQGFEMQFAVNHLGHMALTQRLLPLMEGRQDPRVVTVTSGAQYFGKMQWSDLQGERRYDRWKAYSQSKLANVMFALELNHRLHKQNSTVISLAAHPGLARTNLQKVSVASRGAWQESLAYRLMDPLFQSAAMGALPQLHAATASSAKGGEHFGPGGFASMRGMPTRQPVARPARDAEQRERLWTTSDDMIQCNKSEV

SEQ ID NO: 25188 - protein, 388 aa, Escherichia coli
  misc_feature (206)..(206): Xaa can be any naturally occurring amino acid
  misc_feature (233)..(233): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIAXDRDSVTLVHKGNIMKFTEGAFKDWGYXLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 25189 - protein, 237 aa, Lactobacillus plantarum WCFS1
MANRYLHNVQGLFDTIAPNYDRMNNIISLGTHRHWRKQTMAQIHLASNAHVLDLCCGTGDWTIALAKELQAPGEVIGLDFSAPMLKLAQQKVTQQQVADRVWLRRGNAMHLPFKDNTFDLVTIGFGLRNLPDKAQALTEIYRVLKPGARLVCLETSQPDQPLIKPVWQWYFTKVVPLFGRLFAHQYQEYSYLQETTRHFASYQQLATMFQQAGFQNVHFQRFNFGAAAAHFGTKEAK

SEQ ID NO: 25190 - protein, 369 aa, Oryza sativa Japonica Group
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 25191 - protein, 406 aa, Bacillus licheniformis ATCC 14580
MNAKDIREQFPILSQQVNGHDLVYLDSAATSQKPRVVIETLDEYYNSYNSNVHRGVHTLGTKATDGYEGAREKVRKFINAKSMQEIIFTRGTTTALNTVALSYARANLKPGDEIVITPMEHHANIIPWQQAVKATGATLKYIPLQEDGTISLDDVRETVTENTKIVSAAHVSNVLGTINPIKEMAKIAHEHGAVMVVDGAQSTPHMKIDVQDLDCDFYTFSAHKMCGPTGIGVLYGKKALLENMEPAEFGGEMIDFVGLYESTWKELPWKFEAGTPIIAGAIGLGAAIDFLEDIGLDEILAHEHRLAAYALERFKELEGAVVYGPAERAGLVTFNLEDVHPHDVATVLDAEGVAVRAGHHCAQPLMKWLNVSATARASFYLYNTEEDIDKLIEALQKTKEYFTNVF

SEQ ID NO: 25192 - protein, 394 aa, Rhodospirillum rubrum ATCC 11170
MSDALLPVFSPASVLFDHGEGAWLVAANGERYLDFGAGIAVNALGYSHPHLVGALERQGRKLWHLSNVYRISEAERLAERLTAACFADVAFFANSGAEANECAIKIARRHHDAHGRPERWRIITFDGAFHGRTLATMAAGGNRKYLDGFGPAVDGFDQCPLEDIEAVRARVGPRTAALMIEPIQGESGIRPVSHGFLRQLRELCDERGLLLIFDEIQCGMARTGHLFAHQEAGVVPDIMSLAKGLGGGFPIGACLATRGAAFGMRPGAHGSTFGGNPLAGAVANAVLDIVMDDGVLAEIRRKSALLRGLLEELAGRYPDLLVEVRGRGLMLGLKTTRPSPEIVEALRARAKVLTIAAGDTVTRVLPPLIVTDKDIRLFAERCDETFAGLSRPAA

SEQ ID NO: 25193 - protein, 242 aa, Oryza sativa Japonica Group
MDVARDMEKNTTAMGQLMSSSATTAATATGPASPKRPAGRTKFQETRHPVFRGVRRRGRAGRWVCEVRVPGSRGDRLWVGTFDTAEEAARAHDAAMLALCGASASLNFADSAWLLHVPRAPVASGHDQLPDVQRAASEAVAEFQRRGSTAATATATSGDAASTAPPSSSPVLSPNDDNASSASTPAVAAALDHGDMFGGMRTDLYFASLAQGLLIEPPPPPTTAEGFCDDEGCGGAEMELWS

SEQ ID NO: 25194 - protein, 199 aa, Glycine max
  misc_feature (73)..(73): Xaa can be any naturally occurring amino acid
  misc_feature (88)..(88): Xaa can be any naturally occurring amino acid
  misc_feature (132)..(132): Xaa can be any naturally occurring amino acid
  misc_feature (139)..(139): Xaa can be any naturally occurring amino acid
RGNLNPRSLPPSLLPSPLDQPLLLYSYAIYCSRAFWDKRISQEVLGDALGEEFKGYVFKITGGCDKQGFPMKXGVLTPGRVRLLLHRXGTPCFRGYGRRNGERRRKSVRGCIVSPDLSVLNLVIVKKGESDXLPGLTDXEKPRMRGVLREHPKSVSWSTLSKEDDVRKYVNTYRRTFTTKAGKFPEVHKFSICVCMLGR

SEQ ID NO: 25195 - protein, 251 aa, Oryza sativa Japonica Group
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 25196 - protein, 462 aa, Synechococcus sp. WH 5701
MASAREKFERTLVSVQGSLVGSVAALEHPRSHGSLNYGEVFLRDNVPVMIHLLLEGRFDIVRHFLSVCLDLQSSTYQTRGVFPTSFIEENGQLMADYGQRSIGRITSVDASLWWPILCWYYVKRSQDWEFGASQKVQRGVQLLLDLVMHPTFEGTPVLFVPDCSFMIDRPMDVWGAPLEVEVLLFGCLRSCGHLMEIARRDRSSRLLEQRLELTRQWIHDLRSFLLKHYWVTSKTMQVLRRRPTEQYGDHQHENEFNVQPQVIPDWLQDWLENRGGYLIGNIRTGRPDFRFYSLGNSLACLFGLLTAPQQRGLFRLVLHNRSHLMAQMPMRICHPPMEAAEWMTKTGSDPKNWPWSYHNGGHWPSLLWYFGGAILQHEQNHPRADALLMGQAKAMLEECYWSQLNQLPRQQWAEYFDGPTGTWVGQQSRTYQTWTIIGFLLLHHLLRVNPADVSVLSIDAPP

SEQ ID NO: 25197 - protein, 368 aa, Herminiimonas arsenicoxydans
MAAELERQGRHIIHMGIGEPDFTAAPSVLAAAAQAMADGRMQYTSATGLPELRAAIAAHYRDMYGVDVAPSRIIITAGASGALLLACAALVEKGAEVLMSDPSYPCNRHFVAAFDGSAKMIASGPEHRFQLSADMVQQNWGEQTRGVLLASPSNPTGTSIDEDELRKIVEVVRGKQGFTIVDEIYHGLRYDAAPFSALSLGDDVIVINSFSKYFNMTGWRLGWLVVPETLVPPIEKLAQNLFICASSLAQHAGLACFAPAAMTVYEARKAEFKRRRDYIVPALEELGFKVPVMPDGAFYVYADCSALSDDADELTIAMLNEAGVVMVPGLDFGPSTAHRYVRISYATSMENLQEAIARLRIFLSGRTQ

SEQ ID NO: 25198 - protein, 144 aa, Streptococcus oralis
FKNLCHPTEEELKEQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASP

SEQ ID NO: 25199 - protein, 925 aa, Medicago truncatula
MMELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILNLSHNQFDMLFPSFPPSSLLISLDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 25200 - protein, 144 aa, Streptococcus oralis
FKNLYHPTEEELKEQFIRGQYRSGKIDGMKYISYRSEPNVDPESTTETFASGAFFVDSERFRGVPFFFRTGKRLTEKGTHVNIVFKQMDSIFGEPLAPNILTIYIQPTEGFSLSLNGKEVGEEFKLAPNSLDYRTDATATGASP

SEQ ID NO: 25201 - protein, 924 aa, Pisum sativum
MMELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 25202 - protein, 216 aa, Roseovarius nubinhibens ISM
MSLSEITEAIAKAEKYAGRAPGSVSLIAVSKKQPDARVEEVLDEGHRVFGENRVQEAAGKWPGFREKYDGIELHIIGPLQTNKVRQAMELAQAIHSVDRPKLAQTIARIAQEEGHCPDLFIQVNTGEEEQKAGILPKDADAFITECRGLDLPLRGLMCIPPVDEEPSLHFALLAKIAARNGLDGLSMGMSGDFERAIALGATHVRVGSAIFGDRAY

SEQ ID NO: 25203 - protein, 144 aa, Streptococcus oralis
FKNLYHPTEKELKEQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKRVGEEFNLAPSSLDYRTDATATGASP

SEQ ID NO: 25204 - protein, 312 aa, Synechococcus sp. RS9917
MSSSPSLPSLERFTLLFPLWTLLAALLSLAVPGLFAWVTGPVITWGLALIMLGMGLGLAPADFRRVLVRPRSALIGVALQFLVMPSLAALLAWGLRLEPPLAVGLILVGCCPGGTASNVVALIARADVALSVVMTSLSTGLAVVLTPSLTSLLAGRYVPVEGWTLLINVLQVVLVPVALGVALQQGQPGLARRIEPLMPPIAVVAIALIVAGILAGQRQALLSQGMLLLLATVLLHAGGFALGLLVPALLGDGASSRRTISLEVGMQNSGLAVVLARAGGFASPLTALPGAISAVVHSLLGSALAAWWRRRP

SEQ ID NO: 25205 - protein, 686 aa, Arabidopsis thaliana
MASCDDDFSLLGDDQSNPNQHHHHHQVLHHTPYAPRRFNPKPSNQILLPHHQRNGDEDDENDVVVEASSAFHGHGVNPFTADENSNPYDDNNAAVDEDEDEDLGANRSRIGGVRVEKRQSQEELSDGGTTNGGEITPYGSFKRPRTSSSSAGEYRKDREEWSDAAIACLLDAYSDKFTQLNRGNLRGRDWEEVASSVSERCEKLSKSVEQCKNKIDNLKKRYKLERHRMSSGGTAASHWPWFKKMEDIVGNSLALKGASDEDRSGSSMGNTVKPARRYPLVTYNPGVQINNVKSKATSNPRWRRVVLKISGAALACTGPNNIDPKVINLIAREVAMACRLGVEVAIVVGSRNFFCGSTWVTATGLDRTTAYHISMMASVMNSALLQSSLEKIGVQARLQTAISVQGVGEPYNRQRATRHLDKGRVVIFGGIGATLGNPLLSSDASAALRAIDSTTLLLPLSVVLFPLVTVNAEAVVKGTNVDGVYDCHSQDSNVTFEHISSQDLASRGLTSMDTMALNFCEENSIPVVVFNFLEAGNITKALCGEQVGTLIDRSGRGAVSVDETKNTVVLRAEHKNEEGRKSVDKFEVKTRNPETIKSVERKLMEKGVQRMDRHPSDGIPLRRPPSKSGHGGKYTWEGPDRMEDYEMQPDPPAMDEGDPNYDEEQVKKKFFFWGGGGGVMTWRLSL

SEQ ID NO: 25206 - protein, 250 aa, Francisella tularensis subsp. holarctica
MSKENKTTDFGFTQVPWEEKQKKVAGVFHSVAAKYDLMNDLMSFGIHRIWKKQTIAKSGVRKGDNVLDLAGGTGDLAYKFCQMVGQQGKVILSDINSSMLEVGKEKLTNKGCVGNIEYVQANAECLPFPDNYFDCITISFGLRNVTDKDKALASMCRVLKPGGRLLVLEFSKPIIPLLSKVYDEYSFKALPFLGKIITQDAESYKYLAESICKHPDQQTLKQMMYDAGFDNVEYQNMTGGIVALHIGYKY

SEQ ID NO: 25207 - protein, 516 aa, Aspergillus oryzae
MPSEDQNQQFKRIGIVGAGNMGSMMAFAFSELGLDVSIWDVKKENVDQLLQSAKDIKGQGKIEGFEDIGEFTQSLEGQGERKLFIFSITHGDPADSVLSKIKHALKKGDIILDGGNENYRRTERRQKECEEIGVSWIGTGVSGGYQSARRGPSLSPGGDEKALELVLPLLERYAAKDRKTGQPCVARVGPAGSGHFVKMVHNGIEGGMLSAVAEAWSILHYGLGLKYDEIGDIFDEWNQKGELRNNFLLDIGADVCHRRKSPEGDGKGEGIGEKNEYVLDDVLDKVVQDDDDTEGTPYWCVMETANRHVSAPTIATGHYMRIASGNRAERLRVAEKLRMPKPKPIEGIKDRRLFIEDLRRAVYCCFLSSFCQGLELIARASDDEGWNIDLSKCLQIWRGGCIIQSEAIADLLQPLLKKDVHYTNLKDIDEVAHALKHNFDSLKRIVIDSTVFDQYIPAISATLEYLKYAGGTMLPTKFMEAQMDLFGAHAYYKPGVPGEDPGPVKKGPHHYEWRPA

SEQ ID NO: 25208 - protein, 384 aa, Candida albicans SC5314
MSDTEKTTETDSEVGYLDIYLRFNDDMEKDYCFQVKTTTVFKDLYKVFRTLPISLRPSVFYHAQPIGFKKSVSPGYLTQDGNFIFDEDSQKQAVPVNDNDLINETVWPGQLILPVWQFNDFGFYSFLAFLACWLYTDLPDFISPTPGICLTNQMTKLMAWVLVQFGKDRFAETLLADLYDTVGVGAQCVFFGFHIIKCLFIFGFLYTGVFNPMRVFRLTPRSVKLDVTKEELVKLGWTGTRKATIDEYKEYYREFKINQHGGMIQAHRAGLFNTLRNLGVQLESGEGYNTPLTEENKLRTMRQIVEDAKKPDFKLKLSYEYFAELGYVFATNAENKEGSELAQLIKQYRRYGLLVSDQRIKTVVRARKGETDEEKPKVEEVVEE

SEQ ID NO: 25209 - protein, 598 aa, Myxococcus xanthus
MSFLQQALVFLAAVVLADPLSRRLGLGSVLGYLAGGAVIGPWGLKLISDVEHIFHVAELGVVVLLLFVSLELQTSRLWALRRSVFGLGGAQVLFTGALLASVGLLCSLTWGAAIVTGFGLSLSSTAFALQLLVERNRLTTPYGQLAFGILLFQDLAVVPLLALLPLLGDGGAPSPGTVWLLLLKDVGVLLAEVLSGRYLVRPAFRAVAATHRQELFTATALLLVVATASVINAVGLSMGLAASLAGVLLADSEYRHELEADLAPFKGLLMGLFFISVGMTVNLSLILQKPLLVFGLVLGLVALKGAVLYGLGRMALGRREPALDLAVVISQGGEFAFVLFSLATAQHVMERSLSELLVVVVGLSMAVLYAAHERWVRPRFKPKASGREFDVAPTEDNPVIIAGFGRVGQVVGRLLRAKRIGFTAIDASPEQIDFMKRFGSQVFYGDASRLDLLRAARADKAKVFVLAIDDIEASLRTARAVQQHFPHLTLFVRARNRVHAYELLDMGIERVMRETFLDRLEMGAGVLQELGLTYSESRRAQERRMMEHDERLLRETGRFHRDEQKLVGLGDKDRKELERLFEKEEGRNPTEPREPPPA

SEQ ID NO: 25210 - protein, 332 aa, Streptococcus agalactiae 2603V/R
MKNLRNRSFLTLLDFSTAEVEFLLKLSEDLKRAKYAGIEQQKLVGKNIALIFEKDSTRTRCAFEVAAHDQGAHVTYLGPTGSQMGKKETSKDTARVLGGMYDGIEYRGFSQETVETLAEFSGVPVWNGLTDADHPTQVLADFLTAKECLHKPYKDIRFTYVGDGRNNVANALMIGASIVGMTYHLVCPKELEPDPELLSKCQEIAKTTGASIEITADIAEGVRDSDVLYTDVWVSMGEPDEVWKERIALLEPYRITQEMLNMTENPNVIFEHCLPSFHNIDTKVGYDIYEKYGLKEMEVSDEVFEGPHSVVFQEAENRMHTIKAVMVATLGD

SEQ ID NO: 25211 - protein, 471 aa, Perilla frutescens
MASKLLLALSLSLLVSLAVRAENYRADARMGLRLSRNQQCRIQRISAVQPHHQIQSEGGLTELWDEMEAQFQCAGVVAMRNTLRPNALSLPNYHPNPRLVYIERGEGFIGVIFPGCAETYHGGEEASFEGRREGEQKEGGRARDSHQKIHRIRQGDIVVLPPGAVHWCHNDGSEDLVAVSINDLNHQSNQLDQKFRAFYLAGGVPSGQEQGQGKQEAGRESFHNIFGAFDAELMAEAFNVSPDIIRRMQASEEERGLSVMAHESMRYIRPEEMREHSRRSSSNENGLEESFCSMKIMSNLDNTREADVYSRQAGKLNVVDMHKLPILRAVDMSAEKGTLFPNAMLSPDWAMQGHTIVYVTRGNAKVQVVDHKGQSLMNDRVQQGEMFVVPQFYTSTAEAGNEGFEWVAFKTSGFPMRNQVAGYTSALRAMPLQVLTNAYQMSPNEARAIKTNRGSQTFLLSPTRAHGRKHY

SEQ ID NO: 25212 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLPQILLRPAEYDVIACMNLNGDYIYDALAAQVGGIGIGPGANIGEECSLFEATHGAAPKYAGQDKVNPGSIILSAEMMMRHMGWTEAADLIVKGMEGAINAKTVTYDFERLMEGAKLL

SEQ ID NO: 25213 - protein, 263 aa, Bacillus anthracis str. Ames
MQEVWKDIDAHAKQWIRDAGEHLMASMKKALIIETKSNAADLVTNMDREIEQFLIGKIKETFPHHNILGEEGYGDEVTSSDGVVWLIDPIDGTMNFVHQKRNFAISIGIYENGIGKIGLIYDPVHDELYHALKGAGAFCNEVPIPLLQRGIVEQGIVALNAIWLTDNPLLNMESMMALVKKARGTRSYGCAALEMVYVATGRIDAYVTPRLSPWDFGGGQIIVEEVGGKVTTFSGTPLSIVEKSSVLVAKPGVYEEVLSFISK

SEQ ID NO: 25214 - protein, 500 aa, Euphorbia lagascae
MEQKNLSFPSILISFLLVLILVVVMRLWKKQNPPPGPWKFPIIGNLPHLLLTSDLGHERFRALAQIYGPVMSLQIGQVSAVVISSAEAAKEVMKTQADAFAQRPIVLDAQIVFYNRKDVLFASYGDHWRQMKKIWILEFLSAKKVQSSRLIREEEMEDAITFLRSKAGSPVNITKIIYGIIISIMIRTSVGNCKQKERLLSVADAVNEAATSFGTADAFPTWKLLHYIIGAESKPRRLHQEIDDILEEILNEHKANKPFEADNLMDVLLNLQKNGNVPVPVTNESIKASVLQMFTAGSETTSKATEWVMAELMKNPTELRKAQEEVRQVFGEMGKVDESRFHDLKFFKLVVKETLRLHPPVVLIPRECRETTRIDGYEIHPNTRIVVNAWAIGRDPNTWSEPGKFNPERFKDCAIDYKGTTFELVPFGAGKRICPGITSAITNLEYVIINLLYHFNWELADGITPQTLDMTEAIGGALRKKIDLKLIPIPYQVSLGSNIS

SEQ ID NO: 25215 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 25216 - protein, 170 aa, Zea mays
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLNKDDDVRKYVNTYRRTFTTRG

SEQ ID NO: 25217 - protein, 349 aa, Silicibacter pomeroyi DSS-3
MQITPVAAPEHEQVVRIADPESGLLGFIAIHSTRRGPAAGGVRMRPYAQEADALNDALRLSRGMTYKNAAAGLDLGGGKAVIMADPATQKTPDLLAAFGSAVETLAGRYWTAEDMGMTPADMARIGTRTTCVAGLADGDFASGDPSPITARGIFYAIRTAAKHRLGSVDLTGRTVAVQGLGHVGHYLCGYLHQAGANLIVTDIDRAQVARVAERYGATAVAPDAIYGVEADIFAPCAIGAILNAETIPQLKVRVVAGGANNQLATPEDATRLHDLGILYAPDYVANGGGIINVATEILKISGREAWVASRLAALDDTMDRILTRARILSVSPAEVADATVDEILQAKAA

SEQ ID NO: 25218 - protein, 219 aa, Campylobacter jejuni subsp. jejuni NCTC 11168
MMNDRFTRIKWLVGEEKFQKISQTKVLVCGLGGVGGICVDALYRSGFKNLTLIDADKFEITNQNRQIHSENIGEEKAKVFERIYKVKGIVSKIDENFLKNFDLSEFDLIIDAIDDIPAKVALAHLIDFKKQIFISSTGGARKLDPTRIKTTSIFKTHGDALAKKFRYELRKSGFKGNFDVVFSDEEAHCKDLGSFMGVTASFGLALASLALRKVLAKKS

SEQ ID NO: 25219 - protein, 481 aa, Acidobacteria bacterium Ellin345
MGIGAVIGSGIFTVIGTAIAGQKFDTSSILNAPLLDYIIHHTATTGRPGAGPALALSLVLVALVCAFTALCYAELASMIPIAGSAYTYTYATMGELIAWIIGWDLILEYAVSNMAVSVGFAAHLVDAFDWFGWHPNPRWISPAYLPSGLTDLQGGTIYNTGWHFGFNIPAFLIVMLLTVVLVRGIRESAETNNIMVLLKIGAILAFVVAGMKYIHPTNYHPFAPQGWPGVLTGGSIIFFTYIGFDSVSTAAEEAKNPQRDLPIGIIATLVICTVLYIAVAVVLTGIVKWDTLIDDAAPVVNSLKKLGLMSHSKGLHWTRLVVLFGAMMGMISSLLVFQLGQARVWFAMSRDGLLPKLFGRVHPKFRTPSTATWIAGVLVGIPAGILDIGTLADLSNIGTLFAFVLVSLGVIILRFKQPERRRGFRAPGGLTAPILSVVFCILLMSGLPILTWLRFFAWLIIGMSVYWLYSRHRSEFAPVRK

SEQ ID NO: 25220 - protein, 1365 aa, Staphylococcus aureus subsp. aureus MSSA476
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSNNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 25221 - protein, 534 aa, Gibberella zeae PH-1
MSSHKDEVKDETTVATPHDEELGSTDGEGQLKRHLQNRHMQMIAIGGAIGAGLFVGSGSALHKGGPAALVIGYLIIGIMLLCTNLALAEMAVLYPVNGAFYTYIVRFVDPSWGFACGWEYALSWLTVLPFELIAASKTIEFWRSDIHMAVWVTVFLVALTIVQIFGVRGYGEVEFVLSAIKIAACLGFIILGIIINCGGVGDQGYLGTKYWHDPGAFTDFKGFCAVFVVAAFAFGGTEMVGLAAAETADPRKSVPTASKQVFWRIALFYVINLFIVGTILRSDDDRLQGASGANTKASPFVLAIQDAGIKVLPSIFNAVITISVLSVANTCTFGSTRTMQAMAMRGHAPKFLNYIDGKGRPIYCVIIQLGFGLLAYIGESPKGGTIFDWLLALSGLAFLFVWGTICLAHARMRSGMKAQGVNMNLIPYKTPFGVWGSYLGVFLNVLALVATFYSALFAPDGSAPNAESFFMSFLAGPIILVLYLGYKVYSRDWKLYVRAIDMDLQTGISLLDEEIPEEPKTWASLPRRILSAVI

SEQ ID NO: 25222 - protein, 144 aa, Streptococcus oralis
FKNLYHPTEEELKEQFIRGQYRSGKIDGMKYISYRSEPNVDPESTTETFASGAFFVDSDRFRGVPFFFRTGKRLTEKGTHVNIVFKQMDSIFGEPLTPNILTIYIQPTEGFSLSLNGKRVGEEFNLAPSSLDYRTDATATGASP

SEQ ID NO: 25223 - protein, 380 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 25224 - protein, 100 aa, Populus trichocarpa x Populus deltoides
MSCSSSSASEEDEEGIDSYRKGGYHAVRVGDQFSGGRYIAQRKLGWGQFSTVWLAYDTRSSVCFGSVSVLFFVKFKSYFIFNESCSIIDHWILLDHHQLN

SEQ ID NO: 25225 - protein, 144 aa, Streptococcus oralis
FKNLYHPTEEELKKQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASP

SEQ ID NO: 25226 - protein, 65 aa, Zea mays
LDPAVEDILITAAHVTLYDFDTDVNQWRRKDVEGSLFVVKRSAPTRAVGPLRRRRGLPVLVAGCL

SEQ ID NO: 25227 - protein, 496 aa, Zea mays
MFSHGADSAHDAGAVGVSSGGATVPTRFVWPYGGKRVFVSGSFTRWSEHLPMSPIEGCPTVFQAICSLSPGIHEYKFFVDGEWRHDERQPTISGEFGIVNTLYLTREYNQINTLSSPSTPGSRMNMDVDNENFQRTVTLSDGTVSEGTLRVSEAAIQISRCRVSEYLSLHTCYDLLPDSGKVIALDINLPVKQSFHILHEQGIPVAPLWDSFRGQFVGLLSPLDFILILRELETHGSNLTEEQLETHTISAWKEAKRQTNGRNDGQWRPQQHLVHATPYESLRDIAVKLLQNGISTVPVIYSSSSDGSFPQLLHLASLSGILKCICRYFKNSTGNLPILNQPVCSIPLGSWVPKIGDLNSRPLAMLRPNASLSSALNMLVQAGVSSIPIVDDNDSLLDTYSRSDITALAKAKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 25228 - protein, 506 aa, Aspergillus oryzae
MIRNVTCIGAGFVGGPLATVIAHQCPDIQVTVVDKNKERIDAWNTGIPPLYEPGLEAVLSSVRQRETQCNLTFSTDIDQAIREAEIIMLCIDTPTKGDGIGKGMALDLANTQAAVRTIAQAAESDKIVVEKSTVPCGTADKIRDLLESSSKNGCRFEVLSNPEFLSEGTSITDLFYPTKVLIGHQEKPSSRKAAEELAAIYTRWVSPELIITMDRWSSELSKLAANAMLAQRISSVNSLSAICEAVGADIESVSASCGMDPRIGKGMLKSTLGWGGGCFEKDILCLIYLARSLGLTPVANYWASVIEMNEYQKSRFFMRIVSSMHGSVGGKAIAVLGFAFKKNTSDTKNSAAISLVRNLLQEGALVSIYDPMVPRDRILTDVAAAGSHSTSVQVSTSAYEACNGADAVVIATEWDEFQTPIATGDVRMTTAKDTSIEEPQSPPSTPDNKGKNLNWEWIMNHMRPPKFIFDGRNILDRQYLEQLGARYIGIGSGSKWGFLERATHSL

SEQ ID NO: 25229 - protein, 727 aa, Oryza sativa
  misc_feature (102)..(102): Xaa can be any naturally occurring amino acid
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPXSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 25230 - protein, 315 aa, Clostridium perfringens SM101
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDEKGERDFEFHRGSDGEYSFNNIDLSKIEKDDIIHFGSATGFLKGELKNTYFKLLEVGRKNGNFISFDPNYRDMLIKEEGIEEFKEDCKKFISSCDFLKLSDEEIKLLTEEEDLERGVEKLHSLGAKIIAVTLGGKGTLLSNGIHLEIVPSIKINQVDSTGAGDAFVGAVLKKVSELKDKKNLDLNSWREIISYGNKVGALTCTNYGAIDAIPNEEDLMKYI

SEQ ID NO: 25231 - protein, 316 aa, Aspergillus oryzae
MLSRSVWRNLGYNARRRTAIPEVPYRCFSCSQRAQVDSNKANQDERMTHFGFSNVPESQKESMVGAVFSSVASSYDAMNDFMSLGIHRLWKDHFVRSLNPGSALPSRNTDTTGKGWNILDIAGGTGDIAFRMLDHATNINYDHDTRVTIADINPDMLAEGKKRSIQTPYYNTDRLSFMQGNAQDMPNIPDNSVDLYTVVFGIRNFTDKQAALHEAFRVLKPGGVFACMEFSKVENSVFNAVYKQWSFSAIPMIGQLVAGDRDSYQYLVESIEQFPSQEEFRGMIQKAGFMIPGRGFENLTGGIAAIHKGIKPLSQA

SEQ ID NO: 25232 - protein, 488 aa, Yersinia pseudotuberculosis IP 32953
MKIVNHWIDGKNITSKDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLANSVPYGLAAYIWTQDVSKVLRLARSIEAGMVFVNTQNVRDLRQPFGGIKASGTGREGGKYSFDVFAEVKNVCISMGEHPIPRWGM

SEQ ID NO: 25233 - protein, 400 aa, Candida albicans SC5314
MAKASKVDKKLSKKKEEKPAKKVEEESSSEESSSDDSSSEESSSDDDSSDDSSSSSSDEGSDSDSSDEEEVEKKESSSDESDDEDKKEESSSGSDEEEKKEEKSSSSDSEDSSSSDSSSSESDSDSDSDSDSDSEEEPSKKRKAEESKEEESAPVKKSKPAASTEEPATLFVGRLSWNIDDAWLKREFEHIGGVIGARVIMERATGKSRGYGYVDFESKSAAEKALEEMQGKEIDGRPINLDMSTGKPHASKSNNDRAKQYGDSQSPPSDTLFIGNLSFNANRDNLFNVFGEYGNVISCRVPTHPDTQQPKGFGYVQFSSVDEAKAALEAMNGEYIEGRPCRLDFSTPRDNTNNNNNNNRRGGFGGGFGGRERSATPRSGNSTPRPNKSTEFKGTKKTFD

SEQ ID NO: 25234 - protein, 389 aa, Escherichia coli EAEC 042
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKYWGYQLAREEFGGELIDGGPWLKVKKPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25235 - protein, 579 aa, Shewanella sp. ANA-3
MRRAGTFRPLILAIAMALPLLSSPTLHAEEPSIFSQMATAQPVWAKHGMVASQEALASRTGIEILKQGGNAVDAAVAVAFSLAVTLPRAGNIGGGGFMLVHLAKENKTIAIDYREMAPSKAKKDIFLDENGDAVTKLSREHGLAVGVPGTVMGMSLALEKYGTMTMAQVTAPAIKMAQEGISVTPDLAVSLAGLKRRMSQWPSTAAIFYKADGSDYQVDDILKQPELAHSLQLIAEKGTKGFYEGETAEKLVKAVQDAGGIMTLADLEHYKAVEREPVRGQYRGYDVVSMPPPSSGGVHIIEMLNVLQQFPIDQFGHNTAQTIHVMAETMKHAYADRSEYLGDPDFYKVPVKQLTNKDYAQKIASQIALNKTTPSTEIKPGNLAPYESDQTTHFSVVDKWGNAVSNTYTLNFSYGSGLVAKGTGILLNNEMDDFSAKPGTPNGYGLVGGDANAVEGNKRPLSSMSPTIVMKDGKPFLVTGSPGGSRIITTTLQIIMNVIDHGLNIAEASNAARVHHQWLPDELRVESSLNRDTISLLEAKGHKVKVQSAMGSTQSIMVTDQGIFGASDPRHSGSEAVGY

SEQ ID NO: 25236 - protein, 389 aa, Escherichia coli ETEC H10407
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIWCMNMNGGYICDALTAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25237 - protein, 628 aa, Chlamydomonas reinhardtii
MSSGGARRLALRLASRAAQPCSIADAQMYWASHSRLSWLPAVTHARQFASYPAHVVLNMPSLSPTMTQGNITKWHKQPGEQVAPGQILAEVETDKATIEWEAQEEGFMAKHLVPEGARDIAVGTPVAVLSEEADGVAGLASFTPGASSSSGGSAPAAQATEPKAAAAAAAPAKPAATLPPHQVLNMPSLSPTMSRGNIVEWKKKVGDSVAPGDVYCEVETDKATISWESQEEGFIARILLSDGSKDIEVGTPVLVLVEEKETVPAFADFTPGAPQAAAPAAPAPTPAHVPAAPKAAPAAAPRPGMGGSSAPSAAATASAGGRLRSSPYARKLAAELGVQLQSVAGTGPGGRVVAADVKSAPRGAAAAPSAGAATAAPSAGAAAAAGTEGEYTDIPHSQIRRVVARRLLESKQTVPHYYLTMDCNVEELLALRERMNAQLAGGVKGGAKDGAAPVKLSVNDFIIKSAAQALKAVPGVNSSWQPDYIRQYRNVDISVAVQTPGGLQVPIVRDADLKSLTAISADVRALAAKAKAGKLAPEDYVGGTFTVSNLGMYGIKQFAAIVNPPQAAILAVGASTPTVVRGAGGVFREVPVLAATLSCDHRVIDGAMGAEWLAAFKNYMEAPLLALA

SEQ ID NO: 25238 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVINFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25239 - protein, 243 aa, Synechococcus sp. RS9916
MRKPVIAGNWKMHMTCAQAREWMAAFLPLISATPNDRHLVVAPPFTAISTMAELAKGSSVELSSQNVHWEGHGAYTAEIAPSMLLEHGVGYAIVGHSEPRKYFSESDEQINHRARSAQTNGLIPIVCVGESDEQRTRGEAERVIRRQVEQGLEGLDPAKLIVAYEPIWAIGTGKTCESSEANRICGLIRSWVGSPDLIIQYGGSVKPGNIDELMSMSDIDGVLVGGASLEAESFARIANYQAG

SEQ ID NO: 25240 - protein, 731 aa, Oryza sativa
MNSQKKRSPKIEPFRHRVDADPKSFDKSWKKLEDAIREIYNHNASGLSFEELYRTAYNLVLHKHGLKLYDKLTENLKGHLKEMCRSIGDAQGSLFLEELQRRWADHNKALQMIRDILMYMDRTFITTNKKTPVFDLGLELWRDIVVRAPKIHGRLLDTLLELIHRERMGEMINRGLMRSTTKMLMDLGSSVYHDDFEKPFLEVSASFYSGESQQFIECCDCGEYLKKAERRLAEELERVSQYMDAKTADKITSVVDTEMLANHMQRLILMENSGLVNMLVDDKHEDLSRMYNLFKRVPDGHSTIRSVMASHVKESGKALVSDPEKIKDPVEFVQRLLNEKDKYDEIISISFSNDKAFQNALNSSFENFINLNNRSPEFISLFVDDKLRKGVKGANEEDVETVLDKVMMLFRYLQEKDVFEKYYKQHLAKRLLSGKTTSDEAERSMLVKLKTECGYQFTSKLEGMFNDLKTSHDTMQSFYANLSGDTDSPTISVQILTTGSWPTQPCTPCKLPPEIVDISEKFRAFYLGTHNGRRLTWQTNMGNADIKATFGGRRHELNVSTYQMCVLMLFNSADGLTYGDIEQATGIPHADLKRCLQSLACVKGKNVLRKEPMSKDISEDDTFYYNDKFTSKLVKVKIGTVVAQKETEPEKLETRQRVEEDRKPQIEAAIVRIMKSRRVLDHNSIITEVTKQLQSRFLPNPVVIKKRIESLIEREFLERDKVDRKMYRYLA

SEQ ID NO: 25241 - protein, 261 aa, Thermus thermophilus HB8
MRLAFVGLGKMGRSILKGALERGFLRPEEVGVLGRTPERSRELAEPFGVRPLTRADLGMAERVLIAVQPRDFPALAPEIAHHRLGYISIMAGISTSVLARRLDNRRVVRAMPNLAVAIGESSTALTALKEAREAEDLAFARALFATVGDVYEIPEHLFDAFTGMSASAPAYLAVVAEALADAGVKMGMPRALALRLAADALAATGELLKGRHPAQVKDEVASPGGTTIHGLHALEARAVRAAFYEAVEAATQRGHELGESE

SEQ ID NO: 25242 - protein, 257 aa, Arabidopsis thaliana
  misc_feature (17)..(17): Xaa can be any naturally occurring amino acid
  misc_feature (80)..(80): Xaa can be any naturally occurring amino acid
MASSMLSSAAVVTSPAXATMVAPFTGSKLFAAFSVTRTTNKDITLIVSNGGRVSCMNVWPPIGKKKFATLSYFPDLSDVXLAHEVDYLLPIKCISCVALPLQHGLVVRALRAHFPLTFDGLALWPIRALLHFPRAPDSLSSLSLLSPFLHQCVLLSFPFTTNWFPSITLYSYSIPLIVFSLPLLTFLYSFLYTLFLHLLPIYSSSLLSPLLSPISHCPFTILLSYSTPSSLPLIYLVWLVLIFPYFLPFSPPSLPPF

SEQ ID NO: 25243 - protein, 427 aa, Campylobacter jejuni subsp. jejuni NCTC 11168
MQNQILKNLDLKHIWHPCTQMKDHETLPLIPIKKAKGVWLYDFDDKAYMDCVSSWWVNLFGHCNEKIANAIKKQVDELEHVILAGFTHEPIIKLSARLCEKVGRNFNKCFYADNGSSAIEVALKMSFHYHLNKGVKKSKFLSLSNSYHGETLGALSVGDVALYKDTYKALLLECLSTPVPQGKDYTKELEILKDILEKNASEICAFILEPLVQCAGNMHMYEARFIDEAIKLCHKFGVQVIFDEIAVGFGRTGTLFALHQCKQSPDFICLSKGITGGFMPLSVVLTRDEIYNAFYDTYESQKAFLHSHSYTGNTLACAAANAVLDIFEDENILVKNQILSEFIKKEFSRLEKFDFLGNFRTCGMISAFDILSTKYKRVGLFVFQKALEKGLLLRPLANTIYFMPPYIITKEQIVYVLESLEQIFKEF

SEQ ID NO: 25244 - protein, 578 aa, Triticum aestivum
MGGGNGIVDGFRRLFHRRTPSGSVLGSSNQSSAGEDSSDVEAAEGLDLVGLRSIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPGVGQNGLSPTSLSSRTYLKSASISASKCVVVNPNKQPEYDDAISEETEGAVDGLSEKVSKMHA

SEQ ID NO: 25245 - protein, 370 aa, Roseovarius nubinhibens ISM
MRTRAAVAVEAGKPMEIMEVNLEGPKAGEVLVEIKATGLCHTDDFTLSGADPEGAFPAILGHEGAGVVLEVGPGVTSLEPGDHVIPLYTPECRQCEYCLNPKTNLCQSIRETQGKGVMPDGTSRFSMLDGTPILHYMGCSTFSNHTVLPEIALAKIRKDAPFDKVCYIGCGVTTGIGAVINTAKAEIGSRAIVFGLGGIGLNVIQGLRLAGADQIVGVDLNDDKAVMAKKFGMTDFVNPSKVKGDLVGHLVELTGGGADYTFDATGNVQVMRTALEAAHKGWGESIVIGVAPAGAEISTRPFQLVTGRVWKGTAFGGARGRTDVPKIVDWYMDGKIEIDPMITHTMPLDDINKGFELMHSGESIRSVVIY

SEQ ID NO: 25246 - protein, 908 aa, Saccharomyces cerevisiae
MAKNNHISASGNSTSGDHRLKEEVLTPTTSASTPHRIFSVDDDPKEIQNDIRYLEGLHEGLKFALHANKSKRSVSSQSPIVHSSNNTLHHHEHQQHLPPTLESLSSKSHSVPDLNTATPSSPKRMHSSIRELPHDDNDDEDANDDSRFIIHDSHGHDLLIDEINCQSPSHLENNDQASNASSTESFTLRERQDAINETHPFGIRIWKPALYKKHRSVQRTAAQDIHETQLKTITWEVTCSNVLWFILFGFPIAILFYSAAIVVFLLGGGGLVTNSAKEYSKCLYKLANYFLWPFGKMVYLLQDEQYLQEDKDEGISMQQFYNWVTSYSNRLVFHQSQAKFQQREDHPAPATESSSLMPPANTTATPLNSNHPSYNSIRHEIPHAAAQRRYFGRGKWSWGRVLFYTIFHLVLQPILAVLSLCLWLLVFTIPMSNVLWQIMYHCRRHPLALGFKYVENSSQSHENEITQQQLNKNILLCTFRAAGWHYYKYTVDGTNVIVVNLISIVFFTIFDFYVLKNFLHWKTWFTYESSIFILCLTSTIPLAFYIGQAVASISAQTSMGVGAVINAFFSTIVEIFLYCVALQQKKGLLVEGSMIGSILGAVLLLPGLSMCGGALNRKTQRYNPASAGVSSALLIFSMIVMFVPTVLYEIYGGYSVNCADGANDRDCTFSHPPLKFNRLFTHVIQPMSISCAIVLFCAYIIGLWFTLRTHAKMIWQLPIADPTSTAPEQQEQNSHDAPNWSRSKSTCILLMSTLLYAIIAEILVSCVDAVLEDIPSLNPKFLGLTIFALIPNTTEFLNAISFAIHGNVALSMEIGSAYALQVCLLQIPSLVIYSIFYTWNVKKSMINIRTQMFPLVFPRWDIFGAMTSVFMFTYLYAEGKSNYFKGSMLILLYIIIVVGFYFQGALSE

SEQ ID NO: 25247 - protein, 244 aa, Oryza sativa Japonica Group
MGGVPQGGRGLHQRRRALTRWNLEQSRADQLHRSAREMELYDKNGDGVVSYGDFRAQHNESSGEVNSLGFPWWKEEHFNASDADGHGFLNKTEFNDFLNPSDSENPQIINLLCKQEIRQRDKDGDGKLNFEEYFHGLHDHIHGYDYENADISHIGNNTVAKERFSKLDKDSDGFISEHELEPVLDKLHLSERYYARQQAAHAISEADKDHDGRLTLDEMIENPYAFYGSVFLSDDEDYFHDEFR

SEQ ID NO: 25248 - protein, 144 aa, Streptococcus oralis
FKNLYHPTEEELKEHFIRGQYRSGKIDGKKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASP

SEQ ID NO: 25249 - protein, 504 aa, Pseudomonas fluorescens PfO-1
MLEQYVKKILTSRVYDVAVETPLQNARQLSERLGNDIWLKREDLQPVFSFKIRGAYNKLTQLSDEERARGVVTASAGNHAQGLALAAKVLGVKATIVMPKTTPEIKVEGVRSRGGKVVLHGDSFPEALAYSLKLVDEKGYVYIHPYDDPHTIAGQGTVAMEILRQHPQPLDAIFVPVGGGGLIAGIAAYVKYLRPDIKVIGVEPDDSNCLQAAMAAGERVVLPTVGIFADGVAVAQIGQHTFDICKDYVDEVITVSTDEICAAIKDIYDDTRSITEPAGALGVAGIKKYVEQRGVSGQTFVAIDSGANVNFDRLRHVAERAELGEGREAIIAVTIPEKAGSFKAFCEAIGKRQITEFNYRYNNGSEAHIFVGVQTHPDNDPRSALLASLTEQGFPVLDLTDNELAKLHIRHMVGGRAAHVVDEVVLRFEFPERPGALFNFLNKLGGRWNISMFHYRNHGAADGRVVAGLQVPHDERHLVPAALEEIGYPYWDESDNPAYQLFLG

SEQ ID NO: 25250 - protein, 224 aa, Pseudomonas fluorescens PfO-1
MTQDQLKQAVAQAAVDFILPKLDDKSIVGVGTGSTANCFIDALAQHKGAFDGAVASSEATAARLKGHGIPVYELNTVSNLEFYVDGADESDEHLNLIKGGGAALTREKIVAAVAQTFICIADASKLVPVLGAFPLPVEVIPMARSHVARQLVKLGGDPVYREGVLTDNGNIILDVHNLQITNPVELEAQINAIVGVVTNGLFAARPADLLLLGTSEGVKTLKAE

SEQ ID NO: 25251 - protein, 498 aa, Nandina domestica
MRINPTTSGPGVSALEEKNQGRIVQIIGPVLDVAFPPGKMPNIYNALVVKGQDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEDDRLTVARARKIERFLSQPFFVAEVFTGSPGKYVGLTETIRGFQLILSGELDSLPEQAFYLVGNIDEATAKAMNLDVESKLKK

SEQ ID NO: 25252 - protein, 183 aa, Populus trichocarpa x Populus deltoides
MSSPSKRREMDLMKLMMSDYKVELINDGMQEFYVHFNGPNESPYHGGVWRIRVELPDAYPYKSPSIGFVNKIYHPNVDEMSGSVCLDVINQTWSPMFDLVNVFEVFLPQLLLYPNPSDPLNGEAAALMMRDKPAYEQRVKEYCEKYAKPEDIGAAPEEKSSDEELSEDEYESLDDEMAGQADP

SEQ ID NO: 25253 - protein, 470 aa, Bacillus anthracis str. Ames
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEEAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVNIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 25254 - protein, 341 aa, Aspergillus oryzae
MEQMKAIRIVTTGNKPSAEIRDEPLPSPGPHEVLIRVHAASLNYRDTALLRGEYPAKTKEDVVPVSDGAGEVVAVGRDVTRVKNGDRVTVSCVTNWIGGPYNPDYRSNSVGFTVDGLLAEYALFYEDALVPIPDYISYVEAASLPCAAVTAWTALNKIEPLQPGQTVLVQGTGGVSLFALQFAKIFGARVLAITSSDEKADKLKELGAEAVVNYTTCPDWDREILALTDGKGVDKVLDIAGEKTIVKSAASTKITGVVVLIGFASGFGGGLPPIDILARSLTVTGSTIGSRMDFEAMLQAMERHKARPVIDRVYPFAEYGEAYRRLESGQHVGKVVIQVTH

SEQ ID NO: 25255 - protein, 419 aa, Bacillus anthracis str. Ames
MAFEFKLPDIGEGIHEGEIVKWFIKPGDEVNEDDVLLEVQNDKAVVEIPSPVKGKVLEVLVEEGTVAVVGDTLIKFDAPGYENLKFKGDDHDEAPKAEATPAATAEVVNERVIAMPSVRKYARENGVDIHKVAGSGKNGRIVKADIDAFANGGQAVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASQEVVHKHYFNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 25256 - protein, 248 aa, Bacillus cereus ATCC 14579
MSIIKTKNEIELMHESGKLLASCHREIAKMMKPGITTKEINTFVEAYLEQHGATSEQKGYNGYPYAICASVNDEMCHAFPADVPLTEGDIVTIDTVVNLNGGLSDSAWTYRVGKVSDEAEKLLLVAENALYKGIDQAVIGNHVGDIGYAIESYVTNEGFSVARDFTGHGIGKEIHEEPAIFHFGKQGQGPQLQEGMVITIEPIVNIGMRYSKVDLNGWTARTMDGNLSAQYEHTIAITKDGPIILTKL

SEQ ID NO: 25257 - protein, 231 aa, Cryptococcus neoformans var. neoformans JEC21
MFTNITTCLPASGSNVHKAKLPDNAFVLPPTSQLQSLLTIIRDETTQRGDFVFTSDRIIRLLVEEGLNHLPVLPKKVVTPVGREFEGVAFQGRICGVSIMRAGEAMEAGLRDCCRSVRIGKILIQRDEETAQPKLFYAKLPDDIAQRYILLLDPMLATGGSCIKAIEVLLDQGVQEEKILFLNLIASPEGINKVCTRFPKLTIITAWVDEGLDNHSYIVPGLGDFGDRYFL

SEQ ID NO: 25258 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYHLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25259 - protein, 126 aa, Roseovarius nubinhibens ISM
MSTDLSHPMTLTCHCGAVELRVQLAEGLDTARRCDCSFCRRRGTPAVTVPLDGLEILRGADKLTLYQWGTKTARHHFCSVCGIYTHHRRRSNPNEYGVNMGALEGVNPAEHEPIGWHDGVNHPSDR

SEQ ID NO: 25260 - protein, 308 aa, Chlamydomonas reinhardtii
MAKEEKNFMVDFLAGGLSAAVSKTAAAPIERVKLLIQNQDEMIKQGRLASPYKGIGECFVRTVREEGFGSLWRGNTANVIRYFPTQALNFAFKDKFKRMFGFNKDKEYWKWFAGNMASGGAAGAVSLSFVYSLDYARTRLANDAKSAKKGGGDRQFNGLVDVYRKTIASDGIAGLYRGFNISCVGIVVYRGLYFGMYDSLKPVVLVGPLANNFLAAFLLGWGITIGAGLASYPIDTIRRRMMMTSGSAVKYNSSFHCFQEIVKNEGMKSLFKGAGANILRAVAGAGVLAGYDQLQVILLGKKYGSGEA

SEQ ID NO: 25261 - protein, 262 aa, Roseovarius nubinhibens ISM
MIGSANLNIMIKAARKAGRSLVKDFREVENLQVSMKGAGDFVSRADLRAEEILKEALLEARPTYGWLAEEGGEIAGADPTRRWIVDPLDGTTNFLHGLPHWAVSIGLEHKGQIVAGVIFDAAKDEMFYAEKGEGAWMNESRLRVSGRSKMIESIFATGVPFGGRSDLPHTLQDLARLMPVCAGVRRWGAAALDMAYVAAGRYEGFWERRLNAWDLAAGVVILREAGGMVQPLDPQGNIIEDGNVVCANEQVFEKFAKVIRNA

SEQ ID NO: 25262 - protein, 757 aa, Glycine max
  misc_feature (12)..(12): Xaa can be any naturally occurring amino acid
SHWLFFSSLLTXCCALSRDGVLLLSFKYAVLNDPLYVLANWNYSDETPCSWNGVSCSNENRVTSLLLPNSQLLGSVPSDLGSIEHLQILDLSNNSLNGSLPSSLSQASELRFLNLSNNLITGDVPESLSQLRNLEFLNLSDNALAGKLPESFSNMQNLTVASFKNNYLFGFLPSGLRTLQVLDLSSNLLNGSLPKDFGGDNMRYLNISYNRFSGEIPTEFAAEIPGNATVDLSFNNLTGEVPDSTVFTNQNSKSFNGNFNLCGEITKNPCPIPSSPSSEPKASAPISPPAIAAIPKSFDDSPLAPTGQKQRGLKQGTIIGIVVGDIIGVGILAMLCVYVYRLKKKKDAESTKKKNEAAITRSRSESSSSTTSESRGFTRWSCLRKRTEEEDSSETTSSSESEVEGATAATHDNSKGPQQENNKTGTLVTVDGERQLELETLLKASAYILGATGSSIMYKAVLEDGTSLAVRRIGESGVERFKDFENQVRVIAKLVHPNLVRVRGFYWGHDEKLIIYDFIPNGCLANVRYRKLGLSPSHLPWEIRLKIAKGVARGLAYLHEKKHVHGNLKPSNILLGNDMEPKIGDFGLERIVTGDTSYKAGGSARIFGSKRSTASRDSFQDMTFGPSPSPSPSSISGVSPYHAPESLRNLKPHPKWDVYSFGVMFLELLTGKIVVLDDMGQGPGLLVEDKNRALRMVDMVIRADMEGREEALLAYFKLGYSCVSSIPQKRPPMKEALQVLEKISSSFSSSSSYHYSV

SEQ ID NO: 25263 - protein, 495 aa, Chlamydomonas reinhardtii
MASAEALAVLRELQSKPDNRVCCDCEMKNPQWASVSYGIFMCLECSGRHRGLGVHISFVRSVGMDAWSADQLKKMQLGGNAKLNTFLKQYGIEKSTDIKDKYNSRAAEFYREKLRADVEGRDYTPPSPAEVGPPVLSGGSMGAKTGSARSLAAHSQHGSPAKRADDDWGDWSASGGASASASGAGSHTQRAGSEYTKAQLEASAAGKESFFARKIQENATKPEGLPPSQGGKYVGFGSAPAPRPKPAAGGVDDLTNLLSSTLTTVTRAAETAAKSATLAVKSGSAQLTQTLQEKHVGETLSANAKVVGEKAAHVAQTGFAALSGLYARVASSVEQAARQNGYNVDLGSRAAAAASTTSSSRAAGHSGGGAPSSDYQQAPSSWDAGNDEDYRSAQQQQQQPSGGIRGGGGGGFSGFDAEGDDAEGWGGWGDNKAPSSSGRSAAGAGAAAHSGGSARPSGGAVGGVAAATHKSKSMPALSKGGKSGDDGEDDEWGKW

SEQ ID NO: 25264 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25265 - protein, 389 aa, Escherichia coli
TLQNGKLNVPENPIIPYFEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGTINAKTVTYDFERLMEGAKVL

SEQ ID NO: 25266 - protein, 180 aa, Streptococcus agalactiae 2603V/R
MMKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 25267 - protein, 432 aa, Thermus thermophilus HB8
MKPSVRTPLPGPRARALLERGEKVLSPSYVRPYPFVPARGQGAFLEDVDGNLFLDFMSGIAVNTTGYAHPKVVEAVRAQAERFAHVCFSDFTHEPTLSLAERLVGKLGGGYRVFFGNSGTEGVEAAIKLVRYHTRRPYLLAFTGAFHGRSLGALSVTASKSAYRQGFAPFLPGVVHLPFPNPFRPPLGARPEEVGDAVLNHLEHLFQTVLPPEEVAALFLEPIQGEGGYVVPPPGFIPRLKEVLDRFGILLVADEVQTGAGRTGRFFALEHEGVQADVYVLAKGLASGYPISAVLFREELGSWPPGAHGTTFGGQAVAAAAAHATLDLLEGGLQENAARLGEFLLAELRALKRRFPFLGDVRGRGLMIGLDFGDPDHPRPDLRDKAVRLAFEKGLLLLPAGPSALRIAPPLVLTQEEAALGLEILEEVFRAL

SEQ ID NO: 25268 - protein, 371 aa, Robiginitalea biformata HTCC2501
MKEDYYELLGVSKGATAAEIKKAYRKKAIEFHPDRNPGDATAEENFKKAAEAYEVLSDPNKRARYDQFGHQAFEGGGFGGGGMNMEDIFSQFGDIFGSAFGGSGFGGFGGFGGGQRRVKGSNLRIRVTLDLEEVALGVEKKIKVKRKVQAPGVTYKTCGTCGGNGQVTKITNTILGRMQTAATCTACGGSGQVIDSRPDGADAHGLVMQEETVSIKIPGGVESGMQLKVSGKGNDAPGNGVPGDLLVAIETREHPTLKREGDNLHYDLYISMPDAVLGTSKEIDTIGGKVRIKLEPGIQSGKILRLRNKGIQSINGYGAGDLLVHVNVWTPKELSKEQREFFERMQEDDKFAPKPEKSDKSFFEKVKDMFS

SEQ ID NO: 25269 - protein, 279 aa, Synechococcus sp. CC9311
MPMRVAFLGPEGTYGERAARSLMRLEAIENPELVACLGLRSVVEHVADGRCESAVVPVENSVEGGVTAILDALWSYSNLRIRRAVVLPIRHALLSSGTLDGISEVLSHPQALAQCSGWLARHLPQAVQLPASSTAEAARMVRGSHFRAAIADRSLAGQQGLQELAYPVNDVAGNRTRFLLLQNGEVSREGDVASLALSLHQNTPGALIEALEVIAQLGLNMSRIESRPSKRELGEYVFFVDVELPGKETSELLEQLTTSLQPLCEHLLHFGAYPSSVLE

SEQ ID NO: 25270 - protein, 357 aa, Campylobacter jejuni subsp. jejuni NCTC 11168
MPNLEEFRNKIDAVDDKILDLLNERMTYVKSIGELKQSSGGSIYRPERERAIINRLKNANLGLLDQNAIEAIYQEIFAVSRNLEMPQTIAYLGPEGTYTHQAARSRFGAMSRYIALANIEDVFKELSNKEAKYGVVPIENNTEGAVGITLDCLGKYNELKIFGEIYMDIHHSFVGINENLKEIKRIYSHPQGYNQCRKFLESHELSAIEFVPSKSTANAAYLASQDKYAAAICSRIAAKLYNVPVLFDKIEDNAANKTRFLILSDIKNPKMPNCKTSILAHTAHKPGGLSFLLEQFKKENINLTKLESRPVKSKEFLHSFYIDFEGHIDDENVKKALKDIQEIVWLGSYLSGEKDEI

SEQ ID NO: 25271 - protein, 106 aa, Candida albicans SC5314
MSAGIPVRLLNEAQGHIISIELINGDTYRGKLLENEDNMNLSLYEATITQGKSGKVSHMDQVFIRGSMIRFISVPDILKNAPMFFMKPGDKPKPPIRGPPPKRKRV

SEQ ID NO: 25272 - protein, 534 aa, Synechococcus sp. RS9916
MTTLGPMRQWFSNPAREMLSGLVVAFAMIPEAIAFSGIAGVDPQVGLFGAFCLSITIAFVGGRTAMITSATGSTALLMTSLVASGNARGLELGVQGLGLQYLLVAGILTGVLQILWGYLRLAHQMRFVPQGVLSGFVNALALLIFQAQLPQLGINLQFGEHGDHGGQSVLAAAQIPTVGLLVVLGLVIIYGLPRLTRLIPSQLVAIVALTFISINLQRIFPEAQNLDIPTVKSLGQLPGNLPIPSLPFGALSDGKVPFSLATFSIVLPTALSISLVGLMETFLTQDILDDKTDSNSNKNTEARGQGIANLVSSLFGGMAGCALVGQSVMNIDNGGRARLSTLFSGVSLMAMILLARGWVQQIPMAALVAVMISIAVSTADIAGLRAIRRIPKSDTAVMLMTFAVTMLTTPHNLALGVLAGVALAALLFSRKVAKVIRVEAEDIAADHRRYRVTGQLFFVSKVYFLQGFDVHDHPAQITIDLSAVHIWDQTGVSALNQLTRKLERGGSKVTVEGLNTESLNLLERIGTQPEGAHG

SEQ ID NO: 25273 - protein, 516 aa, Candida albicans SC5314
MFTNSIISKSTTRLTQLSRQLSTTTMAPTSTKNSIKHFDYLVIGGGSGGVASARRAAKYGAKVLLIESNFKKFGGTCVNVGCVPKKVMWYTADLAHKKHDLYAYGLDKEPDSIKYGDFDWAKLKHKRDAYVTRLNGIYENNLKREKVDYAYGFAKFINSEGEVEVTLSGDQELPFLDEGKTYKKGEKLVFSADKTLIATGGTAIVPPSVPGAELGTTSDGFFALEKQPKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVDVKINDKQQIVADEYQVTNNPKIFSLGDVVGKVELTPVAIAAGRRLSNRLFGGPEFAKDKLDYNNIPSVIFSHPEAGSIGLSTKEAIEKYGEENLKIYQSKFTAMYYAMMDDQKDKSPTVYKIICAGPEEKVVGLHIVGDSSAEILQGFGVAIKMGATKKDFDNCVAIHPTSAEELVTMT

SEQ ID NO: 25274 - protein, 266 aa, Triticum aestivum
MSQGQPRRPEGGEAMQADRPIKYGDVFDVSGVLAAQPVAPRDAAMLQSAENEVLGLGQTQKGGPAAVMQSAATLNARAGHVGRGQLTGPVADAGVTVTEADLPGRRVITESVAGQVVGRFVAPAPVTATEPSGALDQDAVTIGRALEAVAAAGAGAKPVDQSDSAAVQAAEMRATGSNLTVPGGIAAAVQAAADQNERAAREEDKVKLRDVLSDARSKLPADKGATREDAERVVSAEMRNKLDLTTTPGGVAEAVTTAARLNQERP

SEQ ID NO: 25275 - protein, 244 aa, Brassica napus
RVFRFIDPLPFPFSTPPPTRFTLVCSSLPKFLPFRFQKMSEEQQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDYKKNENKEVAVNDFLPSENAIEAIQYSMDLYAEYILHTLRR

SEQ ID NO: 25276 - protein, 334 aa, Lactobacillus plantarum WCFS1
MAVLVLGGAGYIGSHAVDRLVAKGYDVAVVDNLVTGHRAAVNEHARFYEGDVRDTAFMNTVFDQENVEGVIHFAAFSVVPESMKDPLKYFDNNTAGMVKLLKVMAKHDVKKIVFSSTAATYGEPKQVPIKESDPQVPTNPYGESKLAMEKIMHWSDVAYGIKFVALRYFNVAGAKPDGSIGEDHAPETHLVPIILQVAAGERDQLQIFGDDYPTPDGTNVRDYVHVVDLADAHILALEYLKQGHDSDAFNLGSSTGFSNKQMLDAAREVTGKPIPAVMAPRRAGDPSTLVAASDKARTVLGWTPQYDDVKEIIKTAWTWKESHPAGYDDRGGQA

SEQ ID NO: 25277 - protein, 615 aa, Campylobacter jejuni subsp. jejuni NCTC 11168
MSKKFAHTQEELEKLSLKELENLAASMREKIIQVVSKNGGHLSSNLGAVELSIAMHLVFDAKKDPFIFDVSHQSYTHKLLSGKEEIFDTLRQINGLSGYTKPSEGDYFVAGHSSTSISLAVGACKAIALKGEKRIPVALIGDGALSAGMAYEALNELGDSKFPCVILLNDNEMSISKPIGAISKYLSQAMATQFYQSFKKRIAKMLDILPDSATYMAKRFEESFKLITPGLLFEELGLEYIGPIDGHNLGEIISALKQAKAMQKPCVIHAQTIKGKGYALAEGKHAKWHGVGAFDIDSGESVKKSDTKKSATEIFSKNLLDLASKYENIVGVTAAMPSGTGLDKLIEKYPNRFWDVAIAEQHAVTSMAAMAKEGFKPFIAIYSTFLQRAYDQVIHDCAIMNLNVVFAMDRAGIVGEDGETHQGVFDLSFLAPLPNFTLLAPRDEQMMQNIMEYAYLHQGPIALRYPRGSFILDKEFNPCEIKLGKAQWLVKNNSEIAFLGYGQGVAKAWQVLRALQEMNNNANLIDLIFAKPLDEELLCELAKKSKIWFIFSENVKIGGIESLINNFLQKYDLHVKVVSFEYEDKFIEHGKTSEVEKNLEKDVNSLLTKVLKFYH

SEQ ID NO: 25278 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYRENHKSPGYYDGRYWTMWKLPMFGCTDATQVLAEVQEAKKAYPQAWIRIIGFDNVRQVQCISFIAYKPEGY

SEQ ID NO: 25279 - protein, 151 aa, Brassica napus
NTSILARSSLGLATPVLLTATASRSSCSVSQTLLLCCCTCKSATAHREMSTVSRASLDQKLALAKRCSREATLAGAKAAAVATIASAIPTLASVRMLPWAKANINPTGQALIVSTVAGMAYFIAADKKILSLARRHSFEQAPDHLKNTSFQ

SEQ ID NO: 25280 - protein, 394 aa, Zea mays
MGSFAKLARRAVETDAPVMVKIQELLRGAKDVMSLAQGVVYWQPPESAMDKIEKIIREPIVSKYGSDDGLPELREALLEKLSRENKLTKSSVMVTAGANQAFVNLVLTLCDAGDSVVMFAPYYFNAYMSFQMTGVTDILVGGCDPKTLHPDVDWLEKVLKENEPIPKLVTVVNPGNPSGAFIPRPMLERISDLCKNAGAWLVVDNTYEYFMYDGMEHYCLEDAHIVNLFSFSKAYGMMGWRVGYIAFPNEADGFHDQLLKVQDNIPICASIIGQRLALYSLEAGPEWIKERVKDLVKNRALLVEALSPLGEDNVKGGEGAIYLWAKLPDSCSDDFEAVRWLANKHGVAVIPGSASGGPGYIRVSFGGLKEEDTRLAAERLRRGLQELVTDGMVQ

SEQ ID NO: 25281 - protein, 144 aa, Streptococcus sanguinis
FERLVQPDKEDLKRFFIRGQYKSGKVKGKKYISYRSEPNVNPDSMTETFASGAFFVNSDRFRDVPFFFRTGKRLTEKGTLVNIVFKQMESIFGEELAPNVLTIHIQPTEGFSLSMNGKEVGERFSLAPLSLDYRTDATASGASP

SEQ ID NO: 25282 - protein, 147 aa, Brassica rapa
MGPFTVEMYYKHSPRTCRNFVELSRRGYYDNVLFHRIIKDFIVQGGDPTGTGRGGQSIYGSKFEDEIKPELKHTGAGILSMANAGPNTNGSQFFITLAPAPSLDGKHTIFGRVCRGMEVIKRLGSVQTDNTDRPIHEVKILRTKVVD

SEQ ID NO: 25283 - protein, 268 aa, Triticum aestivum
  misc_feature (182)..(182): Xaa can be any naturally occurring amino acid
  misc_feature (220)..(220): Xaa can be any naturally occurring amino acid
  misc_feature (237)..(237): Xaa can be any naturally occurring amino acid
MAITKIHARSVYDSRGNPTVEVDIVTETGLHRAIVPSGASTGSHEACELRDGDKTKWGGKGVTKAVANVNDTIAPALIKEAIDVKDQSAVDAFLNKLDGTKNKEKLGANAILGVSMAIAKAAAAEKGVPLYAHISDLAGTKKPYVLPVPFQNVLNGGSHAGGRLAFQEFMIVPSEAPTFSEXMRQGAEVYQKLKSLAKKRYGQSAGNVGDEGGVAPDIQXPEEALDLITDAIEEAGXYTGKIKIAMGRRLPAEVLTRTEGKKKVRNLG

SEQ ID NO: 25284 - protein, 707 aa, Opitutaceae bacterium TAV2
MRGLYWFDAGTTLYVQIGGKGADGAQAQGNDSAFRGTGGNGVGGLWFGSGGYGGHGGAGGYALGGGFAGGGGGGASGILVNGAGLNNIYLAAGGGGGSGAAGGGSSNSKSRGGGAGGGYPGENGYGYTDAIGGTGGHGYSTSSTAGANGQDGENAAPFQYGGGGAGGGGGGFDGANGGGGGGGDGGSNNGFDGGGGAGGAGGLNFIKGTVTKPSALNYSSNSRGAGRTSGEVIITYLGVEYTIALSDEGGSGGSGSTKAYYNENMRVVSVPSRAGYIFAGYWDATSGGTQYYNASGTYVRAWNKGQDTTLYARWTPITYSITYSGLEGATHSNPISYTTETSTITLTAPSQRSGWVFAGWFTTSEVGGEQVTQIQQGSLGNEVVYARWTLAPTIPSKINNDTLVVIPDPTTLGGIVLEGAIDATPSDPEQSQVFEADKVTVYTATNILGTWSLADQSGYTIVVAADGKSFSIVINPTADAARFYRVATTLQPVDASGAPVAGDTVKYNTTLFGRYEVTVPASQTRLVVNQLANGVSDAVALFSDLAVGSSINITKPDGTTASATKIAAGGGRWQPTTLVFPVGSVASVRNAGVVASTKEFVGVVPTQSVTYSLTGGETRKVGTSLPIAASTVALGISPVVGDAVATYRSNGSLVTNTYLAAGGGRWQEGNAPTTIHIGEGFQIKYNATLFWAPRLNVVEDSMNVGLE

SEQ ID NO: 25285 - protein, 144 aa, Streptococcus sanguinis
  misc_feature (125)..(125): Xaa can be any naturally occurring amino acid
FERLVQPDKEDLKRFFIRGQYKSGTVKGKKYISYRSEPNVNPDSMTETFASGAFFVNSERFRDVPFFFRTGKRLTEKGTLVNIVFKQMESIFGEELAPNVLTIHIQPTEGFSLSMNGKEVGERFXLAPLSLDYRTDATASGASP

SEQ ID NO: 25286 - protein, 459 aa, Opitutaceae bacterium TAV2
MNICCIGAGYVGGPTMAMIALKAHDITVTVVDLNEVRIKAWNSDVLPVYEPGLDEIVKARRGKNLFFSTDVKGAIAKADIIFVSVNTPTKTYGVGAGRAADLRYIESVARTIAEVATTPKIIVEKSTIPVKTAETIQEILRSNGNGSSFQVLSNPEFLAEGTAVVDLQNPDRVLIGGERTPEGQNAIETLVSVYARWVPRERIITTNLWSSELSKLVANAFLAQRISSINSISALCEATGANVDEVAHAIGRDSRIGPKFLKASVGFGGSCFQKDILNLVYLCEYFGLPEVAAYWDNVIKINNWQKHRFAARIVRTLFNTVADKKIAVLGFAFKKDTNDTRESPAIAVVRDLLEEQANVVVYDPKVSAEKIHEDVLGITPQSSQLKALGSKLTIAANADEAASGAHAIAILTEWDEFKMLDFEKIYAAMQKPAFLFDGRNILDLEKLHSIGFRAYGLGK

SEQ ID NO: 25287 - protein, 430 aa, Treponema denticola ATCC 35405
MKKAEALMKFIDKSPSVYHAIKNAGEFLEAKGFVHLNREDTFELKPQGRYFVTNNGSALIAWQMPKSGNAENGFRIVGSHSDSPTFRIKPNPEIKVNNHYLKLNTEGYGGVILSTWFDRPLSAAGRVIIKTGDLLKPEVKLINFDKNLLTIPSLAIHMNREINDGYKFNKQKDTLPLIALINEKLEEKGFLMNLIAEEAGVTVDKILDFDLYLYDRQPGCFIGANDEFFSVGRIDNLGMACASIDALGDALPSNFVQVAAIFDNEEVGSRTAQGAGSPFLHDTLQRIIVSTSKGNAFEELQKALAKSFLISADQAHALHPNYTEKNDITNFPLMNKGPAIKVAASMSYTTDGISAAIFRDICARAKVPCQNFVNRSDMAGGSTIGPISVSNLNIKSVDIGNPILGMHSVRELGGTEDQEYITKAFAEFYK

SEQ ID NO: 25288 - protein, 604 aa, Francisella tularensis subsp. holarctica
MERREKRIRKLRNKSGKVFAIETNLTGRQLLNNRVLNKDVAFSQEERVAFALIGYLPEKVESLEEQAIRVRRQLDLKPNSLEKYVFLNRLHDLNTTLFYHFVRENLEEIMPIIYTPTVGEAVQKYSSSFRKQSGLFISISHKKHIARILERYEYNSIDLVLVTDGEAVLGIGDQGIGGMNISIGKIMVYVAASGIDPARVLPVQLDMGTNNDALLNAPGYLGVRLPRVSGETYDEFIEEFVTQVKARFPNVFLHWEDLGRDNATRILEKYKDKLCTFNDDIEGTGIVATANCIAGVKTASTIRINAGEITVEEALSGICDIKVVIFGAGSAGCGIARQLADVIADRAGVSIEKARSSIYLVDRYGLVCDRLRAKRIIPEQKLFVKTSEEIDKWKVEDFNYITLEETVKNTKCDILIGTSGQPGSFTKEIIKTMAKNNNYPIIMPLSNPTSLCEALPEDIIKWTNGKALIAAGSPFPDVTYNGRDYRISQGNNAFIFPGLGLGSVAVHARVLTKGMIRAACYRLSELSPMVINEDITQPLLARITDLVDVTKEITKAVAKQAILEGVHGVDIDLEDLTETELDEEIERLINLSSWTPTYAPYMPI

SEQ ID NO: 25289 - protein, 225 aa, Brassica napus
  misc_feature (176)..(176): Xaa can be any naturally occurring amino acid
MKSLASPPCLRLTPTTRRHLHPRQPSSACYPHGRIKSNSLSFSSSASGFASTLAVVEKELRSSFVTDAVRHVTGSLMRGEGLRFAIVVARFNEVVTKLLLEGAIETFKKYSVREEDIQVVWVPGSFEIGVVAQRLGKSGNFNAVLCIGAVIRGDTTHYDAVANSAASGVLSAGINXSGVPCIFGVLTCEDMDQALNRSGGKAGNKGAETALTALEMASLFEHHLK

SEQ ID NO: 25290 - protein, 389 aa, Escherichia coli
  misc_feature (193)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGAPSPVKHPELTDMVIFRENSEDIYAGIEWKADSADAEKVIKFLREEMGVKKIRFQEHCGIGIKPCSEEGTXXXVREAIEYAIATDGDSVTLVPKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTESADLIVKGMEGAINAKTVTYDFERLMEGAKLL

SEQ ID NO: 25291 - protein, 732 aa, Oryza sativa Japonica Group
MVGGGGGVVVVRAVLLLLAAVAAAEALSLDVHHRYSAAVRRWAAAAAPPHGTAEYYAALAGHDGLRRRSLGVGGGGGGAEFAFADGNDTYRLNDFGFLHYAVVALGTPNVTFLVALDTGSDLFWVPCDCLKCAPFQSPNYGSLKFDVYSPAQSTTSRKVPCSSNLCDLQNACRSKSNSCPYSIQYLSDNTSSSGVLVEDVLYLTSDSAQSKIVTAPIMFGCGQVQTGSFLGSAAPNGLLGLGMDSKSVPSLLASKGLAANSFSMCFGDDGHGRINFGDTGSSDQKETPLNVYKQNPYYNITITGITVGSKSISTEFSAIVDSGTSFTALSDPMYTQITSSFDAQIRSSRNMLDSSMPFEFCYSVSANGIVHPNVSLTAKGGSIFPVNDPIITITDNAFNPVGYCLAIMKSEGVNLIGENFMSGLKVVFDRERMVLGWKNFNCYNFDESSRLPVNPSPSAVPSKPGLGPSSYTPEAAKGALPNGTQLRRGGMDRYQRVEKPREEAPIKENEIRITTQGRMRNYITYATTLLQDKGSDEVVFKAMGRAINKTVMIAELIKRRIVGLHQNTTTGSTDITDMWEPLEEGLLPLETTRHVSMITITLSKKELDTSSIGYQSPLPADKVKPLVEYENEEDAPSPAGRGRGRGGQGRGRGRGRGTRGNGYMDYADGGWEDDHAPPAYAGNGYTRGRGRGFRGRGRRGGGYGAQPDYQQDGGYYDEAPVHAPPRGGYMIC

SEQ ID NO: 25292 - protein, 389 aa, Escherichia coli
  misc_feature (191)..(196): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHAGFGIKPCSEKXXXXXXRAAIEYAIATDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25293 - protein, 389 aa, Escherichia coli
  misc_feature (180)..(180): Xaa can be any naturally occurring amino acid
  misc_feature (193)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIKPCSEKGTXXXVRAAIEYAIATDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25294 - protein, 449 aa, Ostreococcus tauri
MDVVANRAIANRAIASGGRTRSREARWTSTTTETLVCVPSMGDSITEGTVSAVMKSVGDDVATDEVVAQIETDKVTVDVRAPSAGNVARVDAKTGDTVRVGQVVMAFVPGAGGNGKKTARGGAFYGRLHHRGSVAALLVKAGQRVAMDEIIAQIETDKVTIDVRASTSGTVTEVATLAPGPGPEARAETKAEGPKAVEAPKAAATPAPAPKAAGSRSETRVPMSRLRLRVAERLKSSQNTYAMLTTFNEIDMTNVMNMRAEYKDSFLEKHGVKLGFMSTFVSAAAKALQEEPSVNAVIDGDEIVYRNYVDISVAVSAPRGLVVPVLRNCESMTFADVEASIATYGKKAKDGTLSIDEMAGGTFTISNGGVFGSLTGTPIINPPQSAILGMHSIVWRPVCVGPERTIAARPMMNVALTYDHRLVDGREAVTFLKSIKESVEDPRRMLLKL

SEQ ID NO: 25295 - protein, 168 aa, Zea mays
  misc_feature (27)..(27): Xaa can be any naturally occurring amino acid
MRATSSPVPAAVLVAPSSAAVAVKPSXPQRVGGGGSTAGRRDVLAAGTGLGAALLLALGPARAADEEYVSETKEVIGKVRSTIGLDKSDPSVADAVAELRDLSNSWVAKYRREKSLLGRPSFREMYSALNAVSGHYISFGPTAPIPAKRRARILEEMDTAEKALQRGR

SEQ ID NO: 25296 - protein, 310 aa, Robiginitalea biformata HTCC2501
MQEGIYAKFHTTRGEILVKLTHEKTPGTVGNFVALAEGDQPNSARDAGKPYYDGLKFHRVIPDFMIQGGCPSGTGTGDPGYKFDDEIHPDLKHNQPGVLSMANAGPGTNGSQFFITHVPTPWLDGKHTVFGHVASGQEVVDSIAQGDRIETLEIVRVGDAAESWDALAAFDEFRDAVRKKEEAAKAEMEQQLESHAEGFETTPSGLRYKMLETGDGEKPSRGDRVAVHYEGSLLNGTVFDSSVRRGDPIEFLLGEGQVIPGWDEGIQLLRVGDKARLLIPAELAYGSRGAGGVIPPNAPLLFDVELVAIR

SEQ ID NO: 25297 - protein, 379 aa, Oryza sativa Japonica Group
MIGPAGLDSLHGLRRREFMATLHHLRARSGEPVNVGAQMFLTVMNVVTGALWGGNVGSESERTTVGKEFRELVADITELLGAPNVSDFFPALAPLDIQGIRNKSDLLKDRFDDIFARIIQKRTESDHAAAAGETASDFLEYMLKLEKEGGDGKTAFTMTNVKALLMDMVIGGTETTSNTVEWGMAEMLQNRGTLRKVREELDAVVGRDGVVEESHLPKLHYLNLVVKETLRLHPALPLMVPHCPGEDATVGGHRVPAGARVFVNVWAIQRDPAVWKDPEHFIPERFLPADGGGGRRLDFTGSEQEYMPFGSGRRICAGVAMAERMVAYSLAMLVQAFDWELPAGERLDLAERFGIVMKKATPLVAVPTPRLSNPQLYSA

SEQ ID NO: 25298 - protein, 377 aa, Physcomitrella patens subsp. patens
MATTANAATTTPGSAIARNEVKPQSQKPIYTRFSQQEMHACKPLMTPARIVAVFMTVGVVFIPIGIATLLASTSVVELVDHYGHACLDNSAAQVNQSLRTREERISFIKNPSNPKNCTRTIRILKLMKQPIYMYYEITNFHQNHHRYVKSKSEPQLQGQQASPEQLKICAPEDSVGGQPVIPCGLVAWSFFNDTYSLALNNGTSVPVNKKGIAWKSDMDKVSSTVYASNFQNNNPSAYIGGGKLPVDSPLRDNEDLWVWMRPAALSKFRKLWGRIERDLYPGDELQVNIQNVYNCFSFNGQKKLVLSTTSWMGGKNNFVGTAYLTIGLLCVALAIGFFFMYYSHPRPLGNTKQFSWNNEKQVKQRGFQSTQPRTILR

SEQ ID NO: 25299 - protein, 337 aa, Streptococcus agalactiae 2603V/R
MTQVFQGRSFLAEKDFSREEFEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTIKENFGKLEGITLVYCGDGRNNVANSLLVAGTLMGVNVHIFSPKELFPAEEIVKLAEEYAKESGAHVLVTDNVDEAVKGADVFYTDVWVSMGEEDKFKERVELLQPYQVNMELIKKANNDNLIFLHCLPAFHDTNTVYGKDVAEKFGVKEMEVTDEVFRSKYARHFDQAENRMHTIKAVMAATLGNLFIPKV

SEQ ID NO: 25300 - protein, 235 aa, Campylobacter jejuni subsp. jejuni NCTC 11168
MQKQEKIIEMFNQIAPTYDKANRILSFGADVAWRKKACQRVMSLYLKKDLKIADIACGTGDMIEIWQESALKMEKNILNIKGIDPSSGMLNVAKEKFPNVEFIKAGAQNLPLESQSLDILSISYGIRNVVERQKALSEFARVLQKDGILVVLEFTKREKGGFIAACRDFYLKNILPSIGGIISKNKSAYEYLPNSIEGFLSKKEFILELKNAGFEMLDYKSFSFGVSSMFIAKKL

SEQ ID NO: 25301 - protein, 297 aa, Saccharophagus degradans 2-40
MDNVAVLAKLAPLFLAVGMFGMGLSMQVKDFKYLLKNIKPVVVGVSLQVLLLPALGFALAVGFSLDPVLAVGLMLLAASPGGPGSNLVSYLSRGDVALSIALTSVSSILAIVSVPLITSLALAYFQSQAAVSFSIAQMVVMILVVTLVPTFLGVFTSWKAPRFAARCEQGVKVMTLVFIILLVIATIVKEKATIAAMFSTLGLPLAVFCLAAVAISLLLTRLLGFSGAHRRTIAIEAGIQNPVMAVVVATTFLNTVEYSIPAAVYPVVMLTVSLMFIAYAQFGWAPKGLGVAEVRVD

SEQ ID NO: 25302 - protein, 324 aa, Erythrobacter sp. SD-21
MTKLTVLATGGTIAGIAGSAIAKDYRAGEIGIEDYLEKVGGLGLEAELSGRQIANIDSADMGPAVWNALHPAILEALADPECSGVIVTHGTDTLEETAFLLDLTLPADKPVVVVGAMRPADAVGYDGLRNFANAVRVASDSQAAGRGVLVVMGDRVFAARDVRKVRTRGTEAFRGFPRESIGLVTPATLEWFGAPWRQGKAAMSDWYDDLPEVVIVYVHAALCAEEVLRLVGEDTRGIVLAGVGEGNMPERVRQELALFAHNGIPVVRASRADEGLVDREPEDDANRFVAARALNPQKARILLQMLVAGGITDPAAIQRKFDRR

SEQ ID NO: 25303 - protein, 307 aa, Saccharophagus degradans 2-40
MDAIDYKKIFSEIVNELSSEDEKGSVATYIPELANVDPNKLGMHLTTVTNQHFAYGDAEEAFSIQSIAKVWSLTLALKHLGADTWQRVGVEPSGTAFNSLVQLEYEMGIPRNPFINAGAIVVCDILVSCLKNPKEDLLDFIRTSSGIPSIEYCPVIAESEVKTGHRNYALAHMMKGFGNIHNDVDCVLDLYFSLCSIKLTCKQLAQAFLFLAAGGVNPATQQQVITPKRTKRINSIMQMCGFYDEAGEFAFKVGLPGKSGVGGGIVAVHPGKYCIAVFSPRLNASGNSVKAMKVLEALTTKTELSIF

SEQ ID NO: 25304 - protein, 599 aa, Oryza sativa Indica Group
MGTYKCCLIFKRRFRWNDAPPPDDVRALFANHSAGGGPHMAADGLRAYLQATGTRTATWTWSGWWSRSGSCRGAAGASRGWGGHSHSCTVDDFHRFLFSHELNPPIRHGQGQVHHDMAAPLSHYFIYTGHNSYLTGNQLSSDCSDLPIIRALQRGVRVIELDMWPNSSKDDISILHGRTPTTPVSLLKCLLSIKEHAFEASPYPVIITLEDHLTPDLQDKAAKMVLEVFGDILYYPDKDHLKEFPSPQDLKGRVLLSTKPPKEYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSSKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSELIPGIRAVALHDRKGIKLNNVKLLMRFEFE

SEQ ID NO: 25305 - protein, 406 aa, Thermus thermophilus HB27
MQELKVPSVGESIVEVEIGAWLKGEGESFAQDEPLVELITDKATLELPAPFAGTLKQILKKTGETARVGEAIALLEEGRAEAAPKAQAPAEAPKEPSPEPLAMPAAERLMQEKGVSPAEVQGTGLGGRILKEDVMRHLEERTPTKPQEAPPPPPPSRPVPPPSTPTQPPADKPWRVSEAVPMTPLRRRIAERLLMVRQTTAMLTTFNEADMSAVIALRKEFGEAFQKKYGVKLGFMSFFVKAVVQALKEIPELNAEIRDNHIVYHRYYDIGIAVGGGEGLVVPVIRDADRLSFAEIEQKIADFAERARTKKLKPEELMGGTFTITNGGIYGSLNSTPLLNPPQVGILGMHAIQERPVVRDGQVVIRPMMYLALSYDHRIVDGREAVTFLRRVKELIENPARLLLEV

SEQ ID NO: 25306 - protein, 144 aa, Streptococcus sanguinis
FERLVQPDKDDLKRFFIRGQYKSGTVKGKKYISYRSEPNVNPDSMTETFASGAFFVNSERFRDVPFFFRTGKRLTEKGTLVNIVFKQMESIFGEELAPNVLTIHIQPTEGFSLSMNGKEVGERFSLAPLSLDYRTDATASGASP

SEQ ID NO: 25307 - protein, 467 aa, Thermus thermophilus HB27
MRTRRGSFWRCSVYDLLVIGAGPGGYVAAIRAAQLGMKVGVVEKEKALGGTCLRVGCIPSKALLETTERIYEAKKGLLGAKVKGVELDLPALMAHKDKVVQANTQGVEFLFKKNGIARHQGTARFLSERKVLVEETGEELEARYILIATGSAPLIPPWAQVDYERVVTSTEALSFPEVPKRLIVVGGGVIGLELGVVWHRLGAEVIVLEYMDRILPTMDAEVSRAAERVFKKQGLTIRTGVRVTAVVPEAKGARVELEGGEVLEADRVLVAVGRRPYTEGLSLENAGLSTDERGRIPVDEHLRTRVPHIYAIGDVVRGPMLAHKASEEGIAAVEHMARGFGHVDYQAIPSVVYTHPEIAAVGYTEEELKAQGIPYKVGKFPYSASGRARAMGETEGFIKVLAHAKTDRILGVHGIGARVGDVLAEAALALFFKASAEDLGRAPHAHPSLSEILKEAALAAWERPIHL

SEQ ID NO: 25308 - protein, 388 aa, Oenococcus oeni PSU-1
MKIAVIGTGYVGLSLATLLSQQNEVKALDIIAEKVEKINRKVSPIVDHDITDFFEHKNLKLQATLDPKEAITAANFVIIATPTNYDPQTNHFDTSSVEAAIKETIEINPQAQIVIKSTIPVGFVDKAIQHFDFKKIFFSPEFLREGKALSDNLYPSRIIVGSQSKEAHQFAELLKQAAIKENIPILFSNSEEAEAIKLFSNTYLAMRVAYFNELDTYAVSNNLDTAKIIKGVGMDPRIGDFYNNPSFGYGGYCLPKDSKQLLASYEGVPQELMTAIVKSNDTRKRFIVKQILSKKPKTVGIYKLAMKSGSDNFRQSSIIDVMNYLAENNIEVIIYEPTLKTKLFQGKEVDNDLTDFKNKVDLIIANRVTEEIKDSADKLYTRDQWKRD

SEQ ID NO: 25309 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQNKEASSNLLPLNFTGLSKAVKKGDTIFIGKYLFTGSETASVWLEVSEVEGEDVTCLVKNTATLSGSLFTVHVSQIHIDLPTLADKDKEVISTWGVQNNIDFLSLYTRHVEDIRHAREFLSKLGDLKQTHIYAKIENIEGMKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPTMPVISVVIPQLKTNQLRWTFTGAFEARQSLIVRGLFPMLADPRHPAESRSGTNESILKVALDHGKAFGIIKPHDRVVVCQKVADSSVVKILELED

SEQ ID NO: 25310 - protein, 144 aa, Streptococcus sanguinis
FERLVQPDKKDLKRFFIRGQYKSGTVKGKKYISYRSEPNVNPDSMTETFASGAFFVNSERFRDVPFFFRTGKRLTEKGTLVNIVFKQMESIFGEELAPNVLTIHIQPTEGFSLSMNGKEVGERFSLAPLSLDYRTDATASGASP

SEQ ID NO: 25311 - protein, 391 aa, Thermus thermophilus HB27
MAGVKERAVLVLEDGTVYHGYAFGARGKTVGEVVFNTAQTGYQEIMTDPSYHGQIVVMTYPHQGNYGVNVYDMQSNRPWVRGFVAKEFSRVASNPRAQQTIGEFMEFYGVVGIEGIDTRALVRKIREGGVLKGTIAHASLFGAPDHAFTQEELEALRREAQAWTDIDGRDMTPEVSTPLPYAWPTLKSGRRIVVMDFGIKHAIVENLAALGFEVIVVPGKTPAHQIMALEPHGLLISNGPGDPTMPRYAHETIWKLMGLLPTFGICLGHQLLALAAGGRTFKMKFGHRGANHPVKNLQTGKIEITSQNHGYAVDIDSLKDFRPTHVNLNDGTLEGMAHARYPVFSVQYHPEAAPGPHDALYLFRRFLEEVEAFHGATGLPVEKQRADQHGI

SEQ ID NO: 25312 - protein, 646 aa, Salmonella typhimurium LT2
MMSYVDWPPLILRHTYYMAEFETTFADLGLKAPILEALTDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIQPSAEGEELDLETLAAALLKMAQGERPLILPPDAPMRPKREFRDRDDRGPRDRNDRGPRGDREERPRRERRDVGDMQLYRIEVGRDDGVEVRHIVGAIANEGDISSRYIGNIKLFASHSTIELPKGMPGEVLQHFTRTRILNKPMNMQLLGDAVPHAGGERRGGGRSFSGERREGGRNFSGERREGGRGDGRRFSGERRESRGPRRDDSTGRRRFGGDA

SEQ ID NO: 25313 - protein, 353 aa, Penicillium marneffei
MGCGMSTEDKEGKARNEEIENQLKRDKMMQRNEIKMLLLGAGESGKSTILKQMKLINEGGYSRDERESFKEIIYSNTVQSMRVILEAMESLELPLEDPRAEYHVQTIFMQPSQIEGDSLPPEVGGAIQALWHDAGVQECFRRSREYQLNDSAKYYFDSIERIAQPDYLPSDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGADYAAACDYILNRFVSLNQAEQKQIYTHFTCATDTNQIRFVMAAVNDIIIQENLRLCGLI

SEQ ID NO: 25314 - protein, 454 aa, Pseudomonas fluorescens PfO-1
MTSNNPQTREWQALSSDHHLAPFSDFKQLKEKGPRIITNAKGVYLWDSEGNKILDGMAGLWCVAIGYGRDELADAAAKQMRELPYYNLFFQTAHPPALELAKAIADVAPEGMNHVFFTGSGSEGNDTMLRMVRHYWAIKGQPNKKVIISRKNGYHGSTVAGASLGGMTYMHEQGDLPIPGIVHIAQPYWFAEGGDMTPEEFGIWAANQLEEKILEVGVDNVGAFIAEPIQGAGGVIIPPDTYWPRIKEILAKYDILFVADEVICGFGRTGQWFGSDFYDLKPHMMTIAKGLTSGYIPMGGLIVRDEVVAVLNEGGDFNHGFTYSGHPVAAAVGLENIRILREEKIIERAHEETAPYLQKRLRELNDHPLVGEVRGVGLLGAIELVQDKATRKRYEGKGVGMICRQFCFDNGLIMRAVGDTMIIAPPLVISKAEIDELVTKARKCLDLTLSALQG

SEQ ID NO: 25315 - protein, 254 aa, Bacillus anthracis str. Ames
MKEKVVIITGGSSGMGKGMATRFAKEGARVVITGRTKEKLEEAKLEIEQFPGQILTVQMDVRNTDDIQKMIEQIDEKFGRIDILINNAAGNFICPAEDLSVNGWNSVINIVLNGTFYCSQAIGKYWIEKGIKGNIINMVATYAWDAGPGVIHSAAAKAGVLAMTKTLAVEWGRKYGIRVNAIAPGPIERTGGADKLWISEEMAKRTIQSVPLGRLGTPEEIAGLAYYLCSDEAAYINGTCMTMDGGQHLHQYPF

SEQ ID NO: 25316 - protein, 458 aa, Pseudomonas fluorescens PfO-1
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 25317 - protein, 389 aa, Escherichia coli
  misc_feature (180)..(180): Xaa can be any naturally occurring amino acid
  misc_feature (192)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIKPCSEEGXXXXVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25318 - protein, 187 aa, Aspergillus oryzae
MSDYEVTLVNDNSKQEFYVRFKGPEESRYLDTQAPMSFTYSDTAPFSGGHWKIHVELPDQYPYKSPSIGFVNRIFHPNIDELSGSVCLDVINQTWSPMYDMINIFEVFLPQLLRYPNPSDPLNGEAAAMLMREPKSYEAKVKEYVAKYASKEAVDDAGEDTESEDELSSAGSYESGGEEPAGTMDDV

SEQ ID NO: 25319 - protein, 293 aa, Oryza sativa Japonica Group
MEQYEEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMVQ

SEQ ID NO: 25320 - protein, 389 aa, Escherichia coli
  misc_feature (192)..(196): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGXXXXXRQAIEYAIANDRDSVTLVHKGNIMKFTEGAFKDWGYELARKEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25321 - protein, 389 aa, Escherichia coli
  misc_feature (180)..(180): Xaa can be any naturally occurring amino acid
  misc_feature (185)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIXXXXXXXXXXXVRAAIEYAIATDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25322 - protein, 107 aa, Magnaporthe grisea 70-15
MTVHNLTNAQDFKDALKSHKFVLVDFFATWCGPCRAIAPKIAEWSDAFPNIHYVKVDVDEVPDVAQEYNVRAMPTFLLFKDGEKVDEVVGANPPKLQALISANHPSS

SEQ ID NO: 25323 - protein, 497 aa, Zea mays
WDPRGRPGLNLRDITAVVVKEMLANHMQRLILMENSGLVNMLVEDRYEDLTRMYALFNHVPDGLTAIRSVMTSHIKDTGKSLVTDPERLKDPVDFVQRLLNMKDKYDNIINVSFSNDKSFLNALNFSFEHVINLNNRSPEFISLFVDDKLRKVVKEANEEDLETVLDKVMTLFRYLQEKDLFEKYYKQHLAKRLLCGKAAPEDSERSMLVKLKTECGYQFTSKLEGMITDLNTSQDTTQGFYASTSSRLLADAPTISVQILTTGSWPTQTCNTCNLPPEIVSVSEKFRAYYLGTHNGRRLTWQTNMGNADIKATFGNGNKHELNVSTYQMCVLMLFNSSNVLTYREIEQSTAIPTADLKRCLLSLALVKGRQVLRKEPMSKDIADDDSFCVNDKFTSKLFKVKINPVVTQKETDPEKLETRQRVEEDRKPQIEAAIVRIMKSRRVLDHNSIMTEVTKQLQPRFMPNPVVIKKRIESLIEREFLERDKVDRKMYRYLA

SEQ ID NO: 25324 - protein, 935 aa, Treponema denticola ATCC 35405
MKISNNIHFFNSKEIVGKKVDKNLLGIRGRQANEFAELKLPILPGIIIDASVAQDLGDIKIYSEISPYLSKFGSEVKKTYGDAGSPLLLKLVISPNMLITSYPTLHNFGLTKDTVIGFQENVGEDFAANEVLFLLNGILTVVLKIEELEKNEQKVKDLEKALHDIKESMKMGKIGLKPGAIMDKYSKFLPKHFFDDCKVQLEESIRLIARLLTLEEDSDHDVALLIQPMVYGNYSKDSYSGSFFSRNIVNGEKKLQGQFFAEKFNEVNAEGKDINSIKPEYLKHLQQIAWQLEDYTKDIRNIRFTIEAGRLWLIEQKSVEAKSTISMVQILLDLYNRKIVDAEYVVRAVKPGQLNEILHPVIDIMSTKGMKSSKGGIAGAPGAAVGRVYFTADSLIEAQRAAKLQGLDTRCILCMPATYAGDVKGIEVSTGVISNEGGYSAHASVVARQYGKISLVRPDMKISGNKAVIEGVTINEGDYITLNVPYYGDSTVYFGEAKLIEPDPETSGLLDFIGLAKSFLSNFHVRANADSPRDAQLALDFGAEGIGLCRTEHMFFNEKRINTFREMILAPSEAERKKVLDKLQKVQTEDFYGIFKAMNGKEVTIRLLDAPLHEFLPHNDLELDGFVKYLTAQKKKVSKKDLTAEIEKLSEINPMLGHRGCRIAISYPEIYAMQIRAIFEAAYKLKKEKVDVKPEIMIPLIMNFRELKQIIYGKKIEGHTYLGIDAIAEEVKAAVKGGDLDYKVGTMIELPASALSADEIAKYAQFFSFGTNDLTQTTLGLSRDDFNSFMPDYTMYDLIDGNPFAVLDSRVRDLIEIAIQRGKLTRPDLHLGLCGEHGARPENVRFCMDAGLDYVSCSSYSVPIALLSIAQAELENAEKAGIKLEPKAHVSRKPSSAAPKSAAKKQAPEKKAVKAKPASAKKASSAKKKTAKKSK

SEQ ID NO: 25325 - protein, 151 aa, Thermotoga maritima MSB8
MRVRIAVIGKLDGFIKEGIKHYEKFLRRFCKPEVLEIKRVHRGSIEEIVRKETEDLTNRILPGSFVMVMDKRGEEVSSEEFADFLKDLEMKGKDITILIGGPYGLNEEIFAKAHRVFSLSKMTFTHGMTVLIVLEQIFRAFKIIHGENYHY

SEQ ID NO: 25326 - protein, 389 aa, Escherichia coli
  misc_feature (192)..(199): Xaa can be any naturally occurring amino acid
  misc_feature (215)..(215): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEAXXXXXXXXIEYAIANDRDSVTLVXKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25327 - protein, 258 aa, Robiginitalea biformata HTCC2501
MEVQFDQLRIAFDSDSLFALNCALALVMFGIALDIRVSGFRSLLKSPRALCGGVACQFFLLPLLTFLLVLWLQPQPSFALGMILVAACPGGNVSNFMTHLAGGNTELSVSLTAIATLVAVVMTPLNLAFWGGQYAPAGQILQQVHINPMEMVQLVGFLLALPLLAGMGLRRLRPGLARSLARYFRGGSLLFFIVLVGIAVWKDHSVLAQALGLVFGMVLLHNLLALATGFLTGKALGLRISGPSPWRPAFKIPVWAFC

SEQ ID NO: 25328 - protein, 452 aa, Shewanella sp. ANA-3
MRNLLDLDFDSAHIWHPYTSMTRALPVYGVHSAQGCELELVDGRKLIDGTSSWWACVHGYGHPAILTAMERQLHQLSHVMFGGITHEPAITLCKKLLAMTCEPLTKVFLCDSGSIAVEVAIKMALQYWQGQDLPLAQKAQKQRILTVKKGYHGDTFAAMSVCDPEGGMHTMFGEAVTKQCFVDAPQTPFGEPLRQDDLAPMQRILREQHPEIAAVIIEPIMQGAGGMRFYSSEYLRGLRALCDEYNVLLILDEIATGFGRTGKLFAYEHADITPDILCLGKALTGGYISLAATLCTDNVAQGISQSPAGVFMHGPTFMGNPLACAAACASLDLINQQEWPAQVAAIEQQMQRELADAIDIPSVKEVRVLGAVGVLEMHQAVNTAALQQQFVDLGVWVRPFANLIYIMPPYVISSSQLTRLTQAMKQVAATIAPPHANQSEALVTESITISHG

SEQ ID NO: 25329 - protein, 386 aa, Escherichia coli
  misc_feature (192)..(198): Xaa can be any naturally occurring amino acid
  misc_feature (371)..(371): Xaa can be any naturally occurring amino acid
TLHNGKLNVPENPIIPYIEGDGIGVDVTPAMLKVVDAAVEKAYKGERKISWMEIYTGEKSTQVYGQDVWLPAETLDLMREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEAXXXXXXXAIEYAIANARDSVTLVHKGNIIKFPEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAIXAKTVTYNFERLIKGD

SEQ ID NO: 25330 - protein, 440 aa, Staphylococcus aureus subsp. aureus MSSA476
MKTYDLIVIGFGEAGKTLAKYAASTGQHVAVIEQSPKMYGGTCINIGCIASKTLVHDGLEGKSFEASYNRKNDVVNALNNKNYHLLADDNNIDVLDFKAQFKSNTEVNLLDQHDDIADSITAPHIIINTGATSVIPNIKGLDQAKHVFDSTGLLNINYQPKHLVIVGGGYIALEFASMFANLGSKVTVLERGESFMPREDQDVVAHAITDLENKGITLHTNVETTELSSDNHHTTVHTNVGNFEADAVLLAIGRKPNTDLALENTDIELGDRGEIKVNAHLQTTVPHIYAAGDVKGGLQFTYISLDDYRIIKSALYGNQSRTTDNRGGVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 25331 - protein, 198 aa, Zea mays
  misc_feature (187)..(187): Xaa can be any naturally occurring amino acid
MANIDMAKILADLDRGASGGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENTIAMSYKKLPVDVKPGNVILCADGTISLAVLSCDPDGWTGRCRWRDTAMLGERKNCNLPXGSLGDLPTLTE

SEQ ID NO: 25332 - protein, 485 aa, Adansonia rubrostipa
  misc_feature (10)..(10): Xaa can be any naturally occurring amino acid
SGVSTLEKEXLGRISQIIGPVLDVAFPPGKMPNIYNALVVKGRDTAGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMES

SEQ ID NO: 25333 - protein, 192 aa, Candida albicans SC5314
MVQQADKLNTASFFKKTKNTKEQICSHSSGIGGGGFIVSRNNGDAISIDAREMAPGSAYKEMYGNSLVLSKIGGLSIAIPGELKGLYELFKLHGSGNLSWKQLFEPVIKLNRNGFKCSKIFETVLAKEYDLVLSRVPVLKDSWDFIFKPNGELLQEGDVITRPNYANTLELIANNGSSSIFYDPNGPIVQSL

SEQ ID NO: 25334 - protein, 587 aa, Bacillus subtilis subsp. subtilis str. 168
MKRTWNVCLTALLSVLLVAGSVPFHAEAKKPPKSYDEYKQVDVGKDGMVATAHPLASEIGADVLKKGGNAIDAAVAIQFALNVTEPMMSGIGGGGFMMVYDGKTKDTTIIDSRERAPAGATPDMFLDENGKAIPFSERVTKGTAVGVPGTLKGLEEALDKWGTRSMKQLITPSIKLAEKGFPIDSVLAEAISDYQEKLSRTAAKDVFLPNGEPLKEGDTLIQKDLAKTFKLIRSKGTDAFYKGKFAKTLSDTVQDFGGSMTEKDLENYDITIDEPIWGDYQGYQIATTPPPSSGGIFLLQMLKILDHFNLSQYDVRSWEKYQLLAETMHLSYADRASYAGDPEFVNVPLKGLLHPDYIKERQQLINLDQVNKKPKAGDPWKYQEGSANYKQVEQPKDKVEGQTTHFTVADRWGNVVSYTTTIEQLFGTGIMVPDYGVILNNELTDFDAIPGGANEVQPNKRPLSSMTPTILFKDDKPVLTVGSPGGATIISSVLQTILYHIEYGMELKAAVEEPRIYTNSMSSYRYEDGVPKDVLSKLNGMGHKFGTSPVDIGNVQSISIDHENGTFKGVADSSRNGAAIGINLKRK

SEQ ID NO: 25335 - protein, 96 aa, Solanum lycopersicum
MAKSGYNASFLLLISMFLILLTFSNVVEGYNKLRPTDCKPRCTYRCSATSHKKPCMFFCQKCCATCLCVPKGVYGNKQSCPCYNNWKTQEGKPKCP

SEQ ID NO: 25336 - protein, 493 aa, Bacillus subtilis subsp. subtilis str. 168
MGKPTGFMEIKREKPAERDPLTRLKDWKEYSAPFSEEASKRQGARCMDCGTPFCQIGADINGFTSGCPIYNLIPEWNDLVYRGRWKEALERLLKTNNFPEFTGRVCPAPCEGSCTLAISDPAVSIKNIERTIIDKGFENGWIQPRIPKKRTGKKVAIVGSGPAGLASADQLNQAGHSVTVFERADRAGGLLTYGIPNMKLEKGIVERRIKLLTQEGIDFVTNTEIGVDITADELKEQFDAVILCTGAQKQRDLLIEGRDSKGVHYAMDYLTLATKSYLDSNFKDKQFIDAKGKDVIVIGGGDTGADCVATALRQKAKSVHQFGKHPKLPPARTNDNMWPEQPHVFTLEYAYEEREAKFGRDPREYSIQTTKMVADKNGKLKELHTIQMEKVKNEHGKYEFRELPGTEKVWPAQLVFIAIGFEGTEQPLLKQFGVNSVNNKISAAYGDYQTNIDGVFAAGDARRGQSLIVWAINEGREVAREVDRYLMGSSVLP

SEQ ID NO: 25337 - protein, 657 aa, Aspergillus nidulans FGSC A4
MSTPSTATATHPVTHHHQHYGFPHHQTYLPNPSYPTTSSPHLNSTVYPYAVPSTTAALPYTQSPHSAAAASTATSTAAMPQPPKPASTGVSTQNGRRKKPDWGEFYKNGIPKEVIVIDDTPPPDQSAAASRTYPTASTAQVANGNTAQPAGKRRRTGIETAYDLGYFDRPSFSTNPQHYGEESSAGSLSTDRTASLHTTAPTSLSQGSSGASNGAYYEDANVGQKRKRVATRKSVRDQQKKLEQETATDAFLSYIPPPKPPIKAKDVPVPVVRSYANRGEKYDDDDGHYIVNPNTPITDRYSIIKLLGQGTFGKVVEAYDKQRKARCAIKIIRSIQKYRDASRIELRVLSTLASNDKHNRNKCIHLRDCFDFRNHICIVTDLLGQSVFDFLKGNGFVPFPSSQIQSFARQLFTSVAYLKPENILLVKNAYQTFTYNRTIPSSSTAISRNARQRRVLLDSEIRLIDFGSATFDDEYHSSVVSTRHYRAPEIILNLGWSFPCDIWSIGCILVEFFTGDALFQTHDNLEHLAMMEAVIGERIDPKLVRQVMQGGRNGNQNQAAKYFVRNRLDYPNEETTRASKKYVQAMRRLTSFMPTNTKFYRLFLDLLQRIFVYDPKQRITAKDALKHPWFKEPITDDGTEALRIGQQLQQRNNGQQR

SEQ ID NO: 25338 - protein, 144 aa, Streptococcus sanguinis
FERLVQPDKEDLKRFFIRGQYKSGTVKGKKYISYRSEPNVNPDSMTETFASGAFFVNSERFCDVPFFFRTGKRLTEKGTLVNIVFKQMESIFGEELAPNVLTIHIQPTEGFSLSMNGKEVGERFSLAPLSLDYRTDATASGASP

SEQ ID NO: 25339 - protein, 488 aa, Abroma augustum
  misc_feature (1)..(1): Xaa can be any naturally occurring amino acid
  misc_feature (7)..(7): Xaa can be any naturally occurring amino acid
XGVSTLXKRNLGRISQIIGPVLDVAFPPGKMPNIYNALVVKGRDTIGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKLK

SEQ ID NO: 25340 - protein, 458 aa, Staphylococcus epidermidis ATCC 12228
MKVAKFGGSSVSTAEQIKKVLTIVNEDPERKIIIVSAPGKRHNDDIKTTDLLIRLYEKVLNKLNYESKKQEIIQRYADIVEELGIGNDILITINDTLEEYIKHLSDKPNRLYDALLSCGENFNAQLIAQYNNSQGIPTRYISPKEAGLTVTDLPQQAQILDSAYNEIYKLRDYDEKLIIPGFFGVSKQNYIVTFPRGGSDITGAIIARGVRASLYENFTDVSGIYKANPNIINNPELIEEITYREMRELSYAGFGVFHDEALQPLYKDRIPVVIKNTNRPNDKGTYILHDREIDSKNVISGISCDKGFTVINIKKYLMNRLVGFTRKILGVLEEFNISFDHMPSGIDNISIIMRTNQIQGKESQVLNAIRKRCEVDELSIDHDLAVLMIVGEGMNQVVGTASKITHALSESNINLIMINQGASEISMMFGIHEADAEKAVLSTYEFCYNGVCLKNLCK

SEQ ID NO: 25341 - protein, 478 aa, Byttneria filipes
  misc_feature (302)..(302): Xaa can be any naturally occurring amino acid
  misc_feature (409)..(409): Xaa can be any naturally occurring amino acid
  misc_feature (435)..(435): Xaa can be any naturally occurring amino acid
  misc_feature (437)..(437): Xaa can be any naturally occurring amino acid
  misc_feature (452)..(452): Xaa can be any naturally occurring amino acid
  misc_feature (460)..(460): Xaa can be any naturally occurring amino acid
  misc_feature (463)..(463): Xaa can be any naturally occurring amino acid
  misc_feature (473)..(473): Xaa can be any naturally occurring amino acid
  misc_feature (476)..(476): Xaa can be any naturally occurring amino acid
KENLGRISQIIGPVLDVAFPPGKMPNIYNALVVKGRDTVGQQINVTCEVQQLLGNNRVRAVAMSATDGLMRGMEVIDTGAPLSVPVGGATLGRIFNVLGEPIDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKXGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARAXKIERFLSQPFFVAEVFTGSPGKYVGXAXTIRGFKLILSGELDXLPEQAFYXVGXIDEATAKATXLEXES

SEQ ID NO: 25342 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 25343 - protein, 480 aa, Thermus thermophilus HB27
MGQKKGPVAEGLPPGFPGGRRGRGKGLSPRESRTRRTSKGASKRAWARPQSSPPRGVWQGCKLHSMLRLDTRFLSGFPEALSRHGPLLEEARRRLLAKRGEPGSMLGWMDLPEDTETLREVRRYREANPWVEDFVLIGIGGSALGPKALEAAFNESGVRFHYLDHVEPEPTLRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVGGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 25344 - protein, 354 aa, Staphylococcus epidermidis ATCC 12228
MKRWQGLVKEFKEYLPVNQSTPALTLNEGHTPLIYCENLSQKLDIELYVKYEGANPTGSFKDRGMVMAVTKAKEQGKKVVICASTGNTSASAAAYAARAGLKAIVVIPEGKIALGKLSQAVMYGAEIVSIEGNFDEALEIVKEIAEENDEIELVNSVNPFRIEGQKTGAFEIVEQLDGQAPDILAIPVGNAGNITAYWQGFVEYHNKKNTQLPQMFGFQAEGASPIVQNKIIKNPETIATAIRIGNPASWQKAVNALDESNGLIDSVTDEEILEAYQLMTTNEGVFSEPASNASIAGLIKLHRSGKLPKGKKIVAILTGNGLKDPDTAISLLDNPIQPLPNNKESIIRYIKGAI

SEQ ID NO: 25345 - protein, 446 aa, Oenococcus oeni PSU-1
MKRELSNRHIQLISIGGTIGTGLFLGASRSIAFTGPSIMLVYLAAGIFMFLVTRAMGEMLYMDPDQHTFINFISKYLGKPFGFFSGWTYWLSIIFTGMGELTAVGIYFQFWFPKMPMWIIQLMFLAAIMSINLITVKFFGEAEFWFAMIKISAIVALILTSIFMLATDFKTPIGAVGLTNISKNFQLFPNGFKNFVMAFPMVFFAYQGIEFVGITTSETKNPRAVLPKAINQIIIRILIFYIGSLIAIMLIYPWQSLDPKQSPFVWIFKLLGISWAAGLINFVVLTAASSALNSILYSSGRHLYQLASDSSGKFNKNCAVISKNGVPARTICLSALAVAVSPIINSIPTIKDAFSVIASVSSGAYLLIYILTLFAHRKYTQSKDYLANGFLMPKPKFFGPLTIAFMVFILISMLFQKETCPGVVTALIWLVVFGGYSLAKYKNENS

SEQ ID NO: 25346 - protein, 388 aa, Crocosphaera watsonii WH 8501
MIGVSGLHLVVLDGGEINPSLSHLIEILSNSTPEQVKAVFEEPVPLIIDEYSEFGVGVLLFLIGLESDLKELLKVGFQSASVAIVGVTLPFVLGFLGLTYLFHVPTLPALFAGAALTATSIGITAKVMQDLGVLKSKEGQIILGAAILDDILGIVILAVVISIVETGEVDVVKALTLILIAAAFMIAAIVLNQFFGPWFVTQLEKLKSPNRGMGYFILFIFLSFLAGVVGLEPILGAFAAGLILGGTTARERLVEAIEVLSVVFSTVFFVSIGAKTDLSVLNPSVPANREGLIIAGFLIIVAIVGKVSAGFFAFTDEKINRLGIGTGMIPRGEVGLVFAGLGSATGALPPSIDVAIVLMVIATTFLSPPLLRLVFDTSESPSELVQSD

SEQ ID NO: 25347 - protein, 502 aa, Pisum sativum
MSPLFYYSFLSLTFIITIKILLQTQSRRLKNLPPGPPTIPIIGNLHHLKHPLHRTFATLSQKYGDIVSLWFGSRLVVVISSASLVEECFIKNDVVLANRPRFLTGKYIFYDYTTLGSVSYGDHWRNLRRITTIDVLSNNRLTSFLGVRTDEANRLIQNIIKHGASRDFIKVELRSILTEMTFNGMMRMISGKRYYGDDGDVTEVEEAKQFREIISEILSLLGANNKGDFLPLLRWFDLDDLEKRCKKIANRADAFLEGLIQEHRSANHGNGDTMIDHLLKLSEVQLNIIPSHIIKGLIQAMLLAGTDTSALAIEWVMSELLNHPEVLNKAKEEIETQVGKNKIIDEQDLPKLPYLQNIISEALKLHPPAPLLLPHYSSEDCTIGGFNVPKDTIILTNVWAIHRDPTRWSDALSFKPERFEKEGEVNKLMAFGIGRRACPGLSLAQRTVGLNCGACWFQCFEWKRESEEKLDMMEGKVLPCLKRSPFKALCKGTTLLPNDLMK

SEQ ID NO: 25348 - protein, 289 aa, Brassica napus
  misc_feature (18)..(18): Xaa can be any naturally occurring amino acid
  misc_feature (20)..(20): Xaa can be any naturally occurring amino acid
  misc_feature (44)..(44): Xaa can be any naturally occurring amino acid
  misc_feature (46)..(46): Xaa can be any naturally occurring amino acid
  misc_feature (75)..(75): Xaa can be any naturally occurring amino acid
  misc_feature (78)..(78): Xaa can be any naturally occurring amino acid
  misc_feature (96)..(96): Xaa can be any naturally occurring amino acid
  misc_feature (115)..(115): Xaa can be any naturally occurring amino acid
  misc_feature (119)..(119): Xaa can be any naturally occurring amino acid
  misc_feature (221)..(221): Xaa can be any naturally occurring amino acid
  misc_feature (269)..(271): Xaa can be any naturally occurring amino acid
  misc_feature (273)..(274): Xaa can be any naturally occurring amino acid
  misc_feature (276)..(276): Xaa can be any naturally occurring amino acid
IRNWFDYRNHICIVFEKXGXSLYDFLRKNSYRSFPIDLVRELGXRXLLESVAYMHDLRLIHTDLKPENILLVSSXYIXIPDYKFLSRPTKDGSYFXNLPKSSAIKLIDFGSTTFXHQDXNYIVSTRHYRAPEVILGVGWNYPCDLWSIGCILVELCSGEALFQTHENLEHLAMMERVLGPLPPHMVLRADRRSERYFRRGAKLDWPEGATSRDSLKAVWKXPRLPNLIMQHVDHSAGDLIDLLQGLLRYDPAVRLKAREALNHPFFTRXXXQXXPXNPNPGPFLYNHKN

SEQ ID NO: 25349 - protein, 209 aa, Triticum aestivum
MAEVEAALPVAATETPEVAAEGDAGAAEAKGPHKLQRQWTFWYDIQTKPKPGAAWGTSLKKGYTFDTVEEFWCLYDQIFRPSKLVGSADFHLFKAGVEPKWEDPECANGGKWTVISSRKTNLDTMWLETCMALIGEQFDESQEICGVVASVRQRQDKLSLWTKTASNEAVQVDIGKKWKEVIDYNDKMVYSFHDDSRSQKPSRGGRYTV

SEQ ID NO: 25350 - protein, 144 aa, Streptococcus parasanguinis
FEQLHNPTDDELKKFFIRGQYHSGTIEGKKDISYRSEPNVDPESTTETYASGAFFVDSDRFRGVPFFFRTGKRLTQKGTMVNVVFKQTDSIFGHSLQPNVLTIYIQPNEGFSLSINGKEVGEKFSIAPISFDYETDATATGASP

SEQ ID NO: 25351 - protein, 171 aa, Bacillus subtilis subsp. subtilis str. 168
MIYPYKEHKPDIHPTAFIADNATITGDVVIGEQSSIWFSVVIRGDVAPTRIGNRVNIQDLSCLHQSPNKTLLIEDDATIGHQVTLHSAVIRKNALIGMGSIILDGAEIGEGAFIGAGSLVPPGKIIPPGHLAFGRPAKVIRPLTEEDRKDMQRIRSEYVEKGQYYKFLQQT

SEQ ID NO: 25352 - protein, 488 aa, Arabidopsis thaliana
MSSNDWPYPDYLWQLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGVISLFLLPFVNKIV

SEQ ID NO: 25353 - protein, 165 aa, Oenococcus oeni PSU-1
MFTAAKFIQQHDPAAPGIWEILLTYSGFHAVGFYRIAHYFWQHKHRLLAMLISHWGKKATGVEIHPAAVIGKNLFIDHGLGVVIGETAVIGNQVTILQNVTLGSRRPIPGLRHPHIADNVFIGANAQILGAVKIGKYAKIGAGSVVLNNVPAHRTIVGNPGRLVD

SEQ ID NO: 25354 - protein, 463 aa, Bacillus subtilis subsp. subtilis str. 168
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 25355 - protein, 560 aa, Mycobacterium avium subsp. paratuberculosis K-10
MPESAATPRRGCTTARTAPGSGAHRNASRDRDAAPTEQSVVLLDGTSSHPRELLGNKGHGIEVMRRHHLPVPPAFCLTTAVGLRYLADPAATMDAVWDDVLDRIGWLQAQTSRTFGRGPHPLLVSVRSGATQSMPGMMDTLLNLGINDSVEQALAAEHGPAFARDTHRRFREMYRRIVGVERPVPSDPYTQLRAGIEAVFASWNSPRARAYRAHYGFADRHGTAVVVQAMVFGNHGPNSGAGAFFSRNPITGDDEPFGEWLPGGQGDDVVSGSVDVEPIAALRDEQPAVYDQLMAAARTLERLDRDVQEIEFTVEDGALWLLQTRAAERSAQAAVRSALQLRREGLIDDAETLRRVTPAHVRSLLMPALQPEIRLAAPLLAKGLPACPGVVSGTAYADVDEALHAAERGEPVILVRDHTRPEDVSGMLAARGIVTEVGGAASHAAVVSRELGRVAVVGCGAGVAAMLAGRRITVDGAEGEVREGELSLSAWSENDTPELRELAEIARLISPLRAHSGGDHPRLDDDSESAVRAALAAGQTDVVSPTPLLVMLTALRQGAP

SEQ ID NO: 25356 - protein, 369 aa, Thermotoga maritima MSB8
MKKEKKDYYEILGVPRDATQEEIKRAYKRLVKEWHPDRHPENRKEAEQRFKEIQEAYEVLSDPQKRAMYDRFGYVGEQPTYQETESGGFFDDIFRDFENIFNRDIFDVFFGERPHQEERREYARRGEDIRYEIEVTLSDLINGAEIPVEYERYETCPRCGGTGVEPNAGYMDCPSCGGTGRIREERRSFFGYFVSERTCERCGGTGKIPREYCHECGGSGRVLRKVRRTVKIPPNVEDGTHLRITGGGNAGYYGGPYGDLIIIVRVKPDPRFKKSGSDLVYDVTIDYLQAILGTTVEVPLPEGGTTMLKIPPGTQPETVFRLKGKGLPNRYGRRGDLIVNVHVEIPKSLSREERKVLEELAKKRGVTIG

SEQ ID NO: 25357 - protein, 389 aa, Escherichia coli
  misc_feature (192)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEKGXXXXVGAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGDKLL

SEQ ID NO: 25358 - protein, 256 aa, Francisella tularensis subsp. holarctica
MSQIIIKTSQEIEKMRVAGRLAAEVLEMITPFVKEGVTTAELDKICHEYIVKEQDAYPAPLNYHGFPKSICTSINHVVCHGIPADKKLKNGDILNIDITVKKDGYHGDTSKMFMIGEPSVMAKKLVEVTHECLWKGIEVVKPGNHFGDIGAAIEKHAKKFGYSIVDAFCGHGIGANFHEPPHVMHHGKAGIGAMFEEGMIFTIEPMINIGKRAVSVLKDGWTAVTKDRSLSAQWEHTILVTKDGYEVLTLREEEKN

SEQ ID NO: 25359 - protein, 389 aa, Escherichia coli
  misc_feature (192)..(196): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEKAXXXXXRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25360 - protein, 389 aa, Escherichia coli
  misc_feature (185)..(195): Xaa can be any naturally occurring amino acid
  misc_feature (213)..(213): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIXXXXXXXXXXXVRAAIEYAFANDRDSVIXVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25361 - protein, 469 aa, Mycobacterium avium subsp. paratuberculosis K-10
MADDDSHPSDLLVIFGITGDLARKMTFRALYRLERREELEHPIIGVASDDITLDQLLDRAREAIKATGETFDDAVFDRLAGRLSYLSGDVTDAGLYSELAKKIGGDSRPLYYLEMPPSLFAPIVENLAKADLLERARVAVEKPFGHDLESARDLNARLRAVLDEDQILRVDHFLGKQPVEELQYLRFANNALAKLWDRDSISEIHITMAEDFGIEDRGKFYDAVGAVRDVVQNHLLQVLALVAMEPPVGAGADDLNDKKAEVFRAMPSLDPEHCVRGQYRGYTEVPGVAKDSTTETYVALRAEIDNWRWAGVPIFLRAGKALPHKVTEVRMFLHHVPGFSFLPNRRPPEPNQIVLRIDPDPGMRLQLSAQVGDSWHDVHLDSSFAVDLGEPVRPYERLLYAAFNGDRQLFAREDAIEETWRIVQPVLDKPSRIHQYEQGSWGPEAAQALVHGRHAWQQPWLPQSTSTKR

SEQ ID NO: 25362 - protein, 389 aa, Escherichia coli
  misc_feature (180)..(180): Xaa can be any naturally occurring amino acid
  misc_feature (185)..(198): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIXXXXXXXXXXXXXXAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25363 - protein, 271 aa, Chlamydomonas reinhardtii
HTPPNQSKSHTCSSHMHRAIADHYASLEQVQEDLRKNGLESSNLIVAVDFTKSNEWTGKRSFGSRSLHAIGDQPNPYEEAIGVIGRTLSAFDDDGLIPCYGFGDVTTGDSSVFSFLADDKPCRGLEHALWRYRELCPYIRMAGPTSFAPAVRQASRIVEASGGQYHILLLVADGQVSRPSGLMDHQKSEQEQDTIDAIVEASSLPLSIVMVGVGDGPWDLMKDFDDALPERAFDNFQFVNFSELMATTQGDRARREALFALRALMEIPEQY

SEQ ID NO: 25364 - protein, 389 aa, Escherichia coli
  misc_feature (185)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIXXXXXXXXXXXVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25365 - protein, 543 aa, Streptomyces avermitilis MA-4680
MQEAPELTSAADPASEAWRANEAAHRTLGEELRAKLAAARLGGGERARARHTARGKLLPRDRVDTLLDPGSPFLELAPLAADGMYEGQAPAAGVVAGIGRVGGRECLVVANDATVKGGTYYPMTVKKHLRAQEVALENRLPCVYLVDSGGAFLPMQDEVFPDREHFGRIFYNQARMSGAGIPQIAAVLGSCTAGGAYVPAMSDEAVIVRGQGTIFLGGPPLVKAATGEVVTAEELGGGEVHARVSGVTDHLAEDDAHALRIVRNIVSTLPARGPLPWAVEPSVEPKVDPYGLYGAVPVDSRTPYDVREVIARVVDGSRFAEFKAEFGQTLVTGFARIHGHPVGIVANNGILFSESAQKGAHFIELCDQRGIPLVFLQNISGFMVGRQYEAGGIAKHGAKMVTAVACTRVPKLTVVIGGSYGAGNYSMCGRAYSPRFLWMWPGAKISVMGGEQAASVLATVKRDQLEARGESWPVDDEEAFKDPIRAQYEQQGSAYYATARLWDDGVIDPLETRQVLGLALTACANAPLPQKDYTAPGFGVFRM

SEQ ID NO: 25366 - protein, 162 aa, Coccidioides immitis RS
MATDVVIDTTMGSITVELYNDHAPKTCKNFSTLAQRGYYNNVIFHRIIPDFMVQTGDPTGTGRGGSSIYGEKFEDEINPSLKHTGAGVLSMANSGPNTNGSQFFITLAPTPWLDGKHTIFGRVKSGMRVVQRMGLVKTDGDDRPVDQVKILKARVVEETGDE

SEQ ID NO: 25367 - protein, 488 aa, Apeiba tibourbou
  misc_feature (2)..(2): Xaa can be any naturally occurring amino acid
  misc_feature (4)..(4): Xaa can be any naturally occurring amino acid
  misc_feature (7)..(7): Xaa can be any naturally occurring amino acid
  misc_feature (486)..(487): Xaa can be any naturally occurring amino acid
SXIXTLXKRNLGRISQIIGPVLDVAFPPGKMPNIYNALVVKGRDTVGQQINVTCEVQQLLGNNRVRTVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESXXK

SEQ ID NO: 25368 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 25369 - protein, 381 aa, Zea mays
MAHGGGGGRAKVTPNLAVDGEGTRTLNLTVLQRLDQAVEDILITAAHVTLYDFDTDINQWSRKDVEGSLFVVKRNAQPRFQFIVMNRRNTDNLVEDLLGDFEYQLQAPYIMYRNAAQEVIGIWFYNSQECQQVANLFSRILNAFSKVAPKPKIPPVQSEFEELEAAPALVDGPLEAQTSNIMSTTTHIQEDPLSAFFSAAANAGGNSAVAVARQPIQLFGATPVATHAATSITTTQSPGLHYLLPSQASSVSGMPADAHGSIGRSTNLVNPSLFSPLTSSQTTMVCTNSVVAIAPPQHPQTAQQPQSAPLLQPFLLPTASSPPYGTPLLQPFPPPNPSPSLASAPVLSPALSRDKVRDALLRLVENDEFVDLVYREIMNRQ

SEQ ID NO: 25370 - protein, 144 aa, Streptococcus parasanguinis
FEQLHNPTDEELKKFFIRGQYHSGTIEGKKDISYRSEPNVDPESTTETYASGAFFVDSDRFRGVPFFFRTGKRLTQKGTMVNVVFKQTDSIFGHSLQPNVLTIYIQPNEGFSLSINGKEVGETFSIAPISFDYETDATATGASP

SEQ ID NO: 25371 - protein, 303 aa, Oenococcus oeni PSU-1
MLINNLYQLIGKTPLLRLNIDVPNRSRIYAKLEMFNPGGSIKDRLGIALIAYGRKIGAVKEGTTIIEPTAGNTGIGLALAAQQYHLPVKLIVPEKFSFEKQTLMRALGAEVINTPADDGIKGAIAKAQSLAKTIKNSYVPLQFQNPANPDIYYRTLGPEILQDLSGQKIDAFVAGSGSGGTFVGTTKFLQEHYPKMQAVTVEPEGSILNGGPEHPHRIEGIGVEFVPPFFDQIRVDQVKTISDDRAFEYVKWLAAHVGLFAGSSSGAALAASLQLAKELPSDSTVVTVFPDSSERYLSKGIYD

SEQ ID NO: 25372 - protein, 460 aa, Pyrococcus woesei
MNIKKLTPLLTLLLFFIVLASPVSAAKYLELEEGGVIMQAFYWDVPRGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 25373 - protein, 357 aa, Sinorhizobium meliloti 1021
MPKMKAAIFVAPGRIVLDEKQIPDVGPLDALMRITTTTICGTDVHILRGEYPVARGLTIGHEPVGVIEKLGSAVRGYSEGQRVIAGAICTSGHSNAALCGCHAQDGPGTKHGWKGMGGWKFGNTIDGSQAEYVLVPDAMANLAPVPDGLADEQVLMCPDIMSTGFSGAESGAVRVGDAVAVFAQGPIGLCATAGARLIGATTIIAVESVPARMEMARRMGADDVVDFTVSDPTAEIMRLTDGRGVDVAIEALGRQETFEGALRVLRPGGTLSSLGVYSGDLRIPLDGFLAGLGDHTIRTTLCPGGKERMRRLMEVIASGRVDTRPLVTHRFKLDQIEEAYDLFANQRDGVLKVAINP

SEQ ID NO: 25374 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 25375 - protein, 214 aa, Triticum aestivum
  misc_feature (87)..(87): Xaa can be any naturally occurring amino acid
  misc_feature (91)..(94): Xaa can be any naturally occurring amino acid
  misc_feature (97)..(98): Xaa can be any naturally occurring amino acid
  misc_feature (201)..(201): Xaa can be any naturally occurring amino acid
RWQTRRRRDRCSAACSRSGSRCCSSRTSSSSSAPSRPPSSTATPPSSSPSPGPSSSRRRPRLAASVRTRRRRRCAARTSTPRRRWRXKLDXXXXLFXXECVTRVFFGSDFVTVTKSDETSWDYLKPEVFAAIMDFYSSGQPLFLDSNTAAAMDTAVREDDSEIVAMIKELLETRIPPGVQDDGGDIEYPGFEPKTGLGSLXMQGACSGWPSFIF

SEQ ID NO: 25376 - protein, 829 aa, Cryptococcus neoformans var. neoformans JEC21
MSGHSHRPTLKQSNKGFKSKHASKGSLKAAAKGKVSSSAHSHGTKNALGNSKKARLNANAQKRTAKRQAVIQDQKFFSTSSGGGHVPRIVSVVPLLPSISPRTFIANLLPSLGLDESELQEISAALADYGSYLLRAPRYKTSLQINLLPPLSVYPTLDAAFVSDYIVLLMSSVDEVQLQGETILRSLQGQVGGAEIVACVQAPESNPLRPDTRQLIHKSLLSFTRYFFPSVGKIYSSDTPQESLLLARALCEAAPKGMRGDDGRAYIVAENPNSIRWTGSGILTEDGQEKGQLEIIGTVRGGGTLNADRLVHIPGSGDYQVAAILSAPLPSKRQQTQIATNDTLSVPTEDADDLTATNIPDLLANEQTWPTEEEMGGSMEHTVEEPVVKKRVKRVPKGTSAYQAAWIVDDDEEVDAEDLSDDESMGASGDEAASAGERSAAEDEEEFEDVEVDSRQEVAHKDLDPEQEEADYEAYLKERSKADREDAMFPDEVDTPRHIPARTRFQRYRGLKSFRTSPWDPYEDLPIDYAKIFQFENFAATSKRIQLEGAREGVKTGTRVILVLRDVPRSVIEDRETGIPFIVHGLLRHEHKQSVLHFVVQRNTEYAEPVKAKEPLVLCVGPRRYIVRPLYSQHVRGGGKGANNVHKSEKFLRPGTATVMSVFGPICFGKSPCLLMKDRGIKTGKFILSHIDAYSDLHPLSVPDLVAMGSFLSSDPTRIIAKRIILTGHPVKIHKKTATIRYMFFNREDIEYFKSVQLHTKYGKIGNIKEPLGTHGYFKAHFDGPIQQMDTICMSLYKRQYPKWSEEFRPQLAVGAIEEAGEDVMETDE

SEQ ID NO: 25377 - protein, 144 aa, Streptococcus parasanguinis
FEQLHNPTDEELKKFFIRGQYHSGTIEGKKDISYRSEPNVDPESTTETYASGAFFVDSDRFRGVPFFFRTGKRLTQKGTMVNVVFKQTDSIFGHSLQPNVLTIYIQPNEGFSLSINGKEVGEKFSIAPISFDYETDATATGASP

SEQ ID NO: 25378 - protein, 489 aa, Mycobacterium sp. MCS
MADPRGFMKYTHRELPPRRPVPLRLRDWKEVYEDFSHETLQTQAARCMDCGIPFCHNGCPLGNLIPEWNDLVFKDRWRDAIERLHATNNFPEFTGRLCPAPCEASCVLGINQDAVTIKQVEVEIIDNAFDEGWVVPLPPDRLTGKKVAVVGSGPAGLAAAQQLTRAGHTVTVFERADRIGGLLRYGIPEFKMEKRHIDRRLEQMEAEGTQFRTGVNVGVDISVAQLRSEFDAVVLAGGATAWRDLPIPGRELDGIHQAMEFLPWANRVQLGDPVTGEDGEPPITAKGKKVVIIGGGDTGADCLGTSHRQGAASVHQFEIMPRPPETRADSTPWPTYPLMFRVSSAHEEGGERVFSVNTEEFCGDENGHVRSLKVHEVEMKAGKFEKIEGSDFELEADLVLLAMGFVGPEKDGLLTDLKVELTDRGNVARDDDFATSVPGVFVAGDMGRGQSLIVWAIAEGRAAAAGVDRYLMGSSALPAPIRPTAVPQR

SEQ ID NO: 25379 - protein, 90 aa, Glycine max
  misc_feature (38)..(38): Xaa can be any naturally occurring amino acid
PAIFWFFHQPRFSGIPNTFQTKNKTSRPPSDKKVEKFXKNLPKKGFLPTPSPKKGKNFPFGPKLPGFFVFGVHGTSFFPKNRATTNGGMA

SEQ ID NO: 25380 - protein, 147 aa, Clostridium perfringens SM101
MKYKKKEKEELKKILTEEEYYVTQENGTERPFTNEYWDFNGEGIYVDITTGEPLFTSKDKFHSSCGWPAFSKPIDRSIIKEKVDKSHGMVRTEVRSKLGDSHLGHVFCDGPEELGGLRYCINSASLKFIPKEELKEKGYEEYLELFK

SEQ ID NO: 25381 - protein, 387 aa, Bacillus anthracis str. Ames
MEQFINPRVKDIQISGIRQFSNMIQNYDNLISLTIGQSDFPTPSLVKEAAKRAITENYTSYTHNAGLLELRKAACNFVKDNYDLHYSPETETIVTIGASEAIDVAFRTILEPGTEVILPAPIYPGYEPIIRLCGATPIFIDVRETGFRLTAEALENAITEKTRCVVLPYPSNPTGVTLSKKELQDIADVLKDKNIFVLSDEIYSELVYEQTHTSIAHFPEMREKTIVINGLSKSHSMTGWRIGLLFAPSYLAGHILKVHQYNVTCATSIAQYAAIEALTAAKDAPKMMRHQYKKRRDYVYNRLIQMGLTVEKPTGAFYLFPYVGHLTSSSFDFALDLVKEAGLAVVPGTAFSEYGEGYLRLSYAYSIETLKEGCDRLEAFLQQKAKS

SEQ ID NO: 25382 - protein, 450 aa, Bacillus cereus ATCC 14579
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIEGQHIYDVECVKEVDRVMTWELSETIAAFIMEPIITGGGILMPPQDYMKAVHEMCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKDEIGEHPLVGNIRGKGLLVGIELVNDKETKEPIDNDKIASVVNACKEKGLIIGRNGMTTAGYNNVLTLAPPLVISSEEIAFVVGTLKTAMERI

SEQ ID NO: 25383 - protein, 530 aa, Glycine max
  misc_feature (146)..(146): Xaa can be any naturally occurring amino acid
MAQNGSGDRVVVDNGFESIDDAYDHEHKLSQKGSTKVKEEEVSVERVFQHLLVPSWRNQLTVRAFVVSFALSILFSFIVMKLNLTTGIIPSLNVSAGLLGFFFVKTWTKFLEKSNMLRQPFTRQENTVIQTCVVASSGIAFSGGFXGSYLFGMSEEIAKQSSDPSHFKDPKLGWIIGFLFVVSFLGLFSVVPLRKIMVIDFKLTYPSGTATAHLINSFHTPQGAKLAKKQVKMLGKFFSLSFFWGFFQWFYTATDQCGFQAFPSLGLKAYENKFFFDFAAIYVGVGMICPYIINISVLLGGIISWGIMWPLIKTKEGDWYDKGLGEGNLHGIQGYRVFIAIALILGDGLYNFIKVLTHTLWGLYHQIREKQRENVLPVADQDSPSNSHLSYDDQRRTQLFLKDQIPTWFAISGYVAIAAISTATLPHIFPELKWYYIIVIYLIAPTLAFCNAYGCGLTDWSLASTYGKLAIFTIGAWAGSSNGGVLAGLAACGVMMNIVSTASDLMQDFKTGYLTLASPRSMFVSQIIGT

SEQ ID NO: 25384 - protein, 387 aa, Bacillus cereus ATCC 14579
MEFEFFFQIAVILLSTKLGGDLSVRLGQPSVLGKLIVGIVIGPAVLGWIENSELLTQLSNVGVILLMFMAGLETDLEELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMVILKKIVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGNQIWFILALTVIAVLTKLIGCGFGARMTGFDAKSSAIIGAGMVSRGEVALIIAGTGLSSGLLAQDYFTAIGIVVILTTMITPPMLKYTFGAKDKAMKASK

SEQ ID NO: 25385 - protein, 432 aa, Photobacterium sp. SKA34
MSFLSQGFSQDLVKALTEIGYEKLTPVQQKAIPQARRGADILALAQTGTGKTAAFSLPIIQKLIEKPKSKSRFNVRALILAPTRELAEQIANNINEYAKYTDVNCTAIFGGKKMSSQEKRLEQGVDILVATPGRLIEHMELNNVSLANLEFLVFDEADRMLDMGFIGAIRVILEDIRTKPQTMLFSATSSPQMNSLASDILHKPQRITVTPENSTADTIAHVVYPVDEDRKREMLSELIGKKNWKQVLVFVNYKESANQLVKELKLDGIKAVLCHGDKAQSARRRALEEFKEGKARVMVATEVAARGLDIQNLPYVVNYDMPFLAEDYVHRIGRTGRAGQKGNAISFVSREEELTLVQIERLIGQRIHRVQLIGYEPKSRDALLERMHSKPAFSQREGRKNNPTQDQSAAERRARLRRAINIKATKITTLKK

SEQ ID NO: 25386 - protein, 496 aa, Flammulina velutipes
GIGPITDLVIANADVAPDGFTRTAALSGGTVNGALITGSRGDNFQINVVNNLNDNNILQSTSIHWHGMFMAGTSWADGPAFVNQCPIAKSNSFVYDFTALEQAGTFWYHSHLSSQYCDGIRGPMVIYDPDDPHAALYDVDNDDTVITLADWYHAFAKTLAFPTPDSTLINGLGRWAEDPTSDLAVINVESGVRYRFRLVSMSCDPNFVFAIQGHTLNIIEADGVSTEPVEVDQITIFAGQRYSFVLTADQAVDNYWIRAEPTPGPTGFEDGINSAILRYSGAAEAEPTDDTVESTNPLDEIALVPLENPGADGTAEVGADDVFAINLALAFDLSTFKFTVNGATFEPPTTPVLLQLLSGAQTADTLLPAGSLFTLPANRVVELSIPSEGLIGGPHPFHLHGHVFDVIRGPGQTDYNFENPPRRDVVSIGAAGDNVTIRFTTDNPGPWFLHCHIDWHLEAGLALVFAEDTDNWDVSTPPTSWDELCPIYDALSEDDL

SEQ ID NO: 25387 - protein, 256 aa, Botrytis hyacinthi
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFESKA

SEQ ID NO: 25388 - protein, 448 aa, Thermotoga sp. RQ2
MSLKFDFSNLFEPNISGGLTDEDVKSVEEKVTSAVRNFVENTPDFAKLDRSWIDSVKSLEDWIINFDTVVVLGIGGSGLGNLALHYSLRPLNWNEMTREERNGYARVFVVDNVDPDLMSSVLDRIDPKTTLFNVISKSGSTAEVMATYSIARGILEAYGLDPREHMLITTDPEKGFLRKLVKEEGFRSLEVPPGVGGRFSVLTPVGLLSAMAEGIDIDELHEGAKDAFEKSMKENILENPAAMIALTHYLYLNKGKSISVMMAYSNRMIYLVDWYRQLWAESLGKRYNLKGEEVFTGQTPVKALGATDQHSQIQLYNEGPNDKVITFLRVENFDREIVIPETGRAELSYLARKKLSELLLAEQTGTEEALRENNRPNMRVTFDGLTPYNVGQFFAYYEAATAFMGYLLEINPFDQPGVELGKKITFALMGREGYTYEIKERSKKVIVE

SEQ ID NO: 25389 - protein, 154 aa, Bacteroides thetaiotaomicron VPI-5482
MIEKTLVILKPCTLQRGLVGEITHLFERKGLRLAGMKMMQLTDELLSEHYAHLSSKPFFQRVKDSMMATPVIVCCYEGVDAIQAVRTLAGPTNGRLAAPGTIRGDYSMSFQENIVHTSDSPETAAIELTRFFKPEEIFDYKQATFDYLYANDEY

SEQ ID NO: 25390 - protein, 191 aa, Thermotoga sp. RQ2
MPFSLYILWTREITRLWEVFKLDLKRFIRDIPDFPQKGIVFRDITPLLRNQEAFKEAIDRMCELVFDKEFDLVVAPEARGFILGAAMAYKLGKGFVPVRKPGKLPYKTVYEEYQLEYGTEQLHIHEDAIEKGQKVLIVDDVLATGGTAEALIRLVKKLGGEVVSLAFLVELSYLEPRKRLEGYDVKTLIVY

SEQ ID NO: 25391 - protein, 468 aa, Synechococcus sp. CC9311
MPIPMLAAAMPPLLTPLLAELSAHDFEMAETLIGVGRFMLIFVAARALAEVLVRLQLPTILGELLAGVLIGASGLHLLVPPETQVELSNGLITLLSSIGNVPPESVTDLYNESFPALEAVAQLGLFALLFLTGLESELDELIAVGTQAFTVAVAGVVLPFALGTWGLMAIFHVDAIPAIFAGASMTATSIGITASVFGELGYLKTREGQIVIGAAVLDDILGIVILAVVVALASGGSLEIGPIVKLVAAAAVFVVAAIGLSRSAAPAFDWLIDKLKAPGEVLVASFVILALSCFTATAIGLEAALGAFAAGLILSGSKHNHAMQQAVLPIVTLFATIFFVLVGAGMDLSVINPSDPGSRTALIIAAFLFVVAVIGKIAAGWAFVSKQPTRRLVVGLGMMPRGEVGLIFLGLGTSAKLLSPSLEAAILLMVIGTTFLAPVLLRLVIGGDKPDDDDKVDGEVAADPVGLI

SEQ ID NO: 25392 - protein, 160 aa, Chlamydomonas reinhardtii
MEREQASSPQLCEKGCGFFANVGCGGMCSKCHREEARQHANAQATSSQPKPVEVAASRPVHESFPQPAAPSEAVASPVAEASTSSGDASPSATKSANPSRCLCCKKKVGLTGFKCKCGDVFCGTHRYAESHNCPFDYKTVHKEKLASNNPVVQASKVQKI

SEQ ID NO: 25393 - protein, 182 aa, Bordetella pertussis Tohama I
MQTDYAELVRRTIRSVPDWPTPGVTFRDITPVLQDPRTFRVLIDLFVYRYMRQRLDLVAGVDARGFIVGAVLAHELNLGFVPVRKKSKLPYRTVAEEYSLEYGNAAVEMHTDSVRTGQRVLLVDDLIDTGGTMLAAIKLLQRLGANVVEAAAIIDLPYLGGSAQITATGTPLYTVCQYQEGD

SEQ ID NO: 25394 - protein, 397 aa, Robiginitalea biformata HTCC2501
MNLHEYQGKEILASFGVRIQRGIVAHNKKEAVDAAKQLTQETGTSWHVIKAQVHAGGRGKGGGVKLAKNLKEVESIAEEIIGMNLVTPQTSAEGKKVHQVLVAEDVYYPGDSDTEEYYMSVLLNRAESRVMIMYSPEGGMDIEEVADKTPHLIFTEEIDPATGLLPFQARKIAFNLGLSGTAFKEMTRFVSSLYKAYEQSDASLFEINPVLKTSDDKILAVDAKVSLDDNALFRRKQYAEMRDLREENPIEVEARAVGLNYVDLDGNVGCMVNGAGLAMATMDLIKMAGGEPANFLDVGGTADAKRVEEAFRIILKDANVKAILINIFGGIVRCDRVAQGVVDAYKNMGDAIKVPIIVRLQGTNAELAKEILDNSGLAVHSAVQFQEAADKVKEVLA

SEQ ID NO: 25395 - protein, 740 aa, Magnaporthe grisea 70-15
MASTEKNVAADAAPAAAPSPEPAVGHPEELKEKVVVDVDEADVEDEDLYKPLIMDPSIPHEANPLTFRAVVVGIILGTLVSASNLYLGLKTGFTFSANMFGAIFGFGILKFLAKATKGYFGPQENSIVQAAATGAGGISGIFVAGLPAMYRLGLLSKTPMEDIGRMFTITIVCTFVGLFFATPLRKFFVIQVARELRLLFPSPTATALTIRSMHAGAAGGVEAMKKLKGLLITFGAAVVHRVASYYAIGILYDWHFFTWFHIWSGYTSWALNIESWGWYFEVTPSFIGSGMLIGLNSALSMFGGSFLAWGFIGPLLVHYEECIGIQLSDDPKWDSLYSFASLSGLGKRKPSPRYWLLWPGVMIMVCSSMAELFIQYKVIGVAFKAGWRQACVGINDMLAKRGKQNAFFAAQAAQGTESESGSDLVQDSARPEDRVRTWMWSSGLLVSLVLSIIVLHFQWNIGGGLTILIILLSFIFSFLAVQIGAVTDTTPLTAASKAAQLVVGGTTSGAGFALADAQRINIIASSVAGGAAGVATDLTSDFRVGFLLGTPPIKQWIAQAIGSLFSVFIAPAMFVLFATAYPCIITIQGDKDHCAFATPSVAAWQAVAQAVTDPTVSIPKSSGIAACLLGAVSVAQVVFRHYYLVGTREKYRAYLPNWGAIALSFVIPSPVFTNAALAGALIAHFWRKYRPASWETYGYAVAAGAIAGEGMGGVIGAVLQLAEVSGDIYGTNIACPADSC

SEQ ID NO: 25396 - protein, 252 aa, Bacteroides thetaiotaomicron VPI-5482
MRKNIVAGNWKMNKTLQEGIALAKELNEALANEKPNCDVIICTPFIHLASVTPLVDAAKIGVGAENCADKASGAYTGEVSAEMVASTGAKYVILGHSERRAYYGETVAILEEKVKLALANGLTPIFCIGEVLEEREANKQNEVVAAQMESVFSLSAEDFSKIILAYEPVWAIGTGKTASPEQAQEIHAFIRSIVADKYGKEIADNTSILYGGSCKPSNAKELFSNPDVDGGLIGGAALKVSDFKGIIDAFNA

SEQ ID NO: 25397 - protein, 308 aa, Streptococcus suis
MAIYQNITQLVGKTPVIKLNNIVPEGAAEVYVKLEAFNPGSSVKDRIALAMIEDAEKAGTIKPGDTIVEPTSGNTGIGLAWVGAAKGYNVIIVMPETMSVERRKIIQAYGAELVLTPGSEGMKGAIAKAKEIAEEKNGWVPFQFANPSNPKVHEDTTGQEILEDFGTTGLDAFVSGVGTGGTVSGVSHVLKTANPDIAIYAVEADESAVLSGEAPGPHKIQGISAGFIPDTLDTSAYDGIIRVKSDDALATGRAIGGKEGFLVGISSGAAIHAAIEVAKELGTGKKVLAILPDNGERYLSTALYEFND

SEQ ID NO: 25398 - protein, 130 aa, Solanum lycopersicum
MDMPKGDKLVLRGLKFHGYHGVKQEERKLGQKFLVDVDAWMDLRSAGESDCLSDTLSYTDIYRLVKEVMEGPPKNLLESVAQLIASTTLTKYPEVSAVRVQVGKPHVAVQGPVDYLGVEIIRYRSLDVQN

SEQ ID NO: 25399 - protein, 368 aa, Saccharophagus degradans 2-40
MRSTKALVSDGNGAFDVKQITVGEPAANEVRVKIKAAGLCHTDWDSIQNWNKPFIVGHEGAGIVDAVGEGVTKVAPGDKVILNWAIPCGQCQQCLTGYPHICEINSPVCGKGLCGHAHANATLYNNAPLERSFHLGTMAEYTVVKEAAVVKLETDISFSAASIVGCGVMTGWGSVVNAANVKAGSTVCVIGCGGVGLNVIQAARLSGAAKIIAIDINDERLAQAKQFGATHGVIANRADSHFDEVLTQVKQINNNRAADYAFECTAVPALGSAPLKLIRSAGTAVQVSGIEQRIDFDCELFEWDKIYINPLYGQCNPERDFPRILALYASGKLKLDELITKTYSLENITEGFDDLLNGRIAKGAIIFD

SEQ ID NO: 25400 - protein, 277 aa, Arabidopsis thaliana
MKIPSIGYVFFLIFISITIVSSSPDHGEVEDETQFNYEKKGEKGPENWGRLKPEWAMCGKGNMQSPIDLTDKRVLIDHNLGYLRSQYLPSNATIKNRGHDIMMKFEGGNAGLGITINGTEYKLQQIHWHSPSEHTLNGKRFVLEEHMVHQSKDGRNAVVAFFYKLGKPDYFLLTLERYLKRITDTHESQEFVEMVHPRTFGFESKHYYRFIGSLTTPPCSENVIWTISKEMRTVTLKQLIMLRVTVHDQSNSNARPLQRKNERPVALYIPTWHSKLY

SEQ ID NO: 25401 - protein, 331 aa, Thermus thermophilus HB8
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHILSNASCTTNSLAPVMKVLEEAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 25402 - protein, 390 aa, Thermus thermophilus HB8
MRTLLDLDPKGKRVLVRVDYNVPVQDGKVQDETRILESLPTLRHLLAGGASLVLLSHLGRPKGPDPKYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 25403 - protein, 414 aa, Thermus thermophilus HB8
MDLDAFTLFERHINPGLAGLLRFTGLDRVESHAEGPYVWDTQGKRYLDFLGLYGTLNLGHRHPKVVEAVKRQLDRMPMSVRVLVSEPTARLAAKLAEITPEGLEMVFFGNSGAEAVEAAIKLARAYTGKPGIVTTQGGFHGKTMGALSLTPKPEYQDPARPLLPGVKVVPYGDLKALEEAIDETTAAVIVEPIQGEGGIRVPPEGYLRGVRELTREKGVLMIADEVQTGLGRTGKLFGVDWEGVSPDLMTLAKALGGGVMPIGACVGRREVFEVFKNNPLFHSSTFGGNPLAAAAALAAIEVTLEEDLPGRALELGRHLMEGLKVLKEEHPHLIEDVRGRGLMVGVEFADADIGALVVAEMAERGVLTAFGLNNPKVVRLEPPLIIGKEHVDEALAVFAEALKATEKALEGLLG

SEQ ID NO: 25404 - protein, 291 aa, Oryza sativa Japonica Group
MLRRNTRLRREYLYRKSLEGKERQHYEKKRRLREASRRGEAHPHRAPQRGARPPPRDRPRGQGIRWSLIDDEYAGAALREPKILLTTSRNPRGPLTQFVKELKVVFPNSQRMNRGGQVISEIVESCRSHDITDLVLVHEHRGQPDGLIVCHLPFGPTAYFGLLNVVTRHDIKDRKAMGKMSEAYPHLILDNFTTKTGERTANIVKHLFPVPKPDSKRIITFANRDDYISFRHHVYEKHGGPKSLDLKEVGPRFELRLYQIKRGTVDQAEAQNEFVLRPYMNTAKKQKSLGA

SEQ ID NO: 25405 - protein, 166 aa, Coccidioides immitis RS
MASLKAGDSFPSDVVFSYIPWTPDNKDIKACGMPQNYEASKLWADKKVVLFSLPGAFTPTCSASHLPGYIQKLPQLKEKGVDVVAVLAFNDAWVMSAWGKANGVTGDDILFLSDPEAKFSKSIGWNAGERTGRYAIIIDHGKVTYAEIEPGREVTVSGADAVFSKL

SEQ ID NO: 25406 - protein, 144 aa, Streptococcus anginosus
FKHLHKPTDNDLKKLFIRGQYTSGKVDGKKYISYRSEPNVDPESTTETFASGAFFVDSDRFRGVPFFFRTGKRLTAKGTHVNIVFKQMESIFGSSLQPNVLTIYIQPTEGFSLSMNGKEVGEQFNLAPLTLDYRTDATASGASP

SEQ ID NO: 25407 - protein, 144 aa, Streptococcus anginosus
FKHLHKPSDNDLKKLFIRGQYTSGKVDGKKYISYRSEPNVAPESTTETFASGAFFVDSDRFRGVPFFFRTGKRLTAKGTHVNIVFKQMESIFGSSLQPNVLTIYIQPTEGFSLSMNGKELGEQFNLAPLTLDYRTDATASGASP

SEQ ID NO: 25408 - protein, 275 aa, Mycobacterium sp. MCS
MREPTMMHRVAAEFIGTFWLVFGGCGSAVFAAKYTSADGYAFGIGFLGVSLAFGLTVLTGVYAFGTISGGHFNPAVTLGAALARRVEWRVLPAYWLTQVIAGVAAGLVIYVIAKGREGWTATGNMAANGYANHSPAGYSLLAVVIAEVLLTGIFLLVILGATDTRAPKGFAGLAIGLTLTLIHLISIPISNTSVNPARSTGVAFFNGNEAPAQLWVFWIAPLLGAAIAGAAYPYLFGRHEELADRPVRDETLDAQVRAEDVADARLRRGPDPEVR

SEQ ID NO: 25409 - protein, 224 aa, Oenococcus oeni PSU-1
MVKILVVEDDENFNSLVSRYLASNGFEVISCADAQKAYDALYNNLFDLIVTDVMMPGIDGVEFAKTVRQLNENIPILFVTARDDIKTKKAGFRVGIDDYLVKPIDLDELKLRISAVLRRANISQNQKIEIGNLLLKSEEISASINGVPIPLTVREFNILFKMLSFAGRAFSRAELLDDFWDTESNASLRAVDVYITKLREKFKSTNAFEIKTIHGLGYKTVIRS

SEQ ID NO: 25410 - protein, 144 aa, Streptococcus anginosus
FKHLHKPSDNDLKKLFIRGQYTSGKVDGKKYISYRSEPNVAPESTTETFASGAFFVDSDRFRGVPFFFRTGKRLTTKGTHVNIVFKQMESIFGSSLQPNVLTIYIQPTEGFSLSMNGKEVGEQFNLAPLTLDYRTDATASGASP

SEQ ID NO: 25411 - protein, 357 aa, Mycobacterium avium subsp. paratuberculosis K-10
MSLSLGIVGLPNVGKSTLFNALTRNNVVAANYPFATIEPNEGVVPLPDPRLDKLAEMFKSERIVAAPVTFVDIAGLVKGASEGAGLGNKFLAHIRECDAICQVVRVFADDDVTHVAGQVDPRSDIEVVETELILADLQTLERAVGRLEKEARTSKERRPVYEAALAAQETLNGGKTLFSAGTDTSLLRELNLLTTKPFLYVFNADESVLTDPARIAELRELVAPADAVFLDAAIESELIELDDESAAELLESIGQTERGLDALARAGFHTLRLQTFLTAGPKEARAWVIHQGDTAPKAAGVIHSDFEKGFIKAEIVSYDDLIAAGSMAVAKAAGKVRMEGKDYVMADGDVVEFRFNV

SEQ ID NO: 25412 - protein, 129 aa, Populus trichocarpa
MGIPSELRHYWAQKTLTNQNLNHNGYDINNCNGRSLLIASPAEEQKILQARLCTQEGVRAGVKAAVITCVATAVPTLTAVRVIPWAKANLNYTAQALIISAASIAAYFITVDKTILECARRNAHYNKRD

SEQ ID NO: 25413 - protein, 291 aa, Aspergillus oryzae
MSDVAALEAEVKEFKLQLETVQSSLQVDPDNTELQSLKTELEELINLTETSIAELKPPAPSTLKTSLPLKDQGPRGSYSTSQTGYRKPTVEQTEESVPPASFSVNEHVLARWTSGDNSFYPARITSITGSSSNPVYLVSFKSYGTVESLTAKDLRPISGNDSRKRKADGSSGNSASQSPAPQLPNSSVISAAADINPALANQARQEPSKVGDGPARPAKAPRKVKANRELEAGKMKWKDFASKGKLGRKESMFRTGDSVSARVGFTGSGQKMRKDPTRTRHVYQQAEDEGY

SEQ ID NO: 25414 - protein, 323 aa, Clostridium difficile 630
MKKVISIGEALIDFIPNQNGGKLKNVSEFRRVAGGAPANVSAVVAKLGGKSSFISKLGKDAFGDYIIDVLNEVNVNTDYVLRTSKANTGLAFVSLKEDGNRDFSFYRNPSADMLLEADEVKKEWFNNCHILHFCSVDLIDSPMKLAHKKAIEYALESNSIISFDPNIRLPLWDSEQSCKKAISEFLPFAHIVKISDEELEFITGENDIEKSLHKLFVGNVELVLYTKGKDGVDAYTKKVKGMCKGVKVNAIDTTGAGDSYIGSFLYTLLYKQITLNDIKEMKQETLNEYLEFSNYYAARSTTIKGAISSYATKEEITEFIKNL

SEQ ID NO: 25415 - protein, 92 aa, Griffithsia japonica
HEALTKAAVALSENGAKSVRACCIHAVLSGPAVDRINASCIKELVITNSIAHSEEMRKKLPCLTTLSIGNVMAETIRRVHREESVSTLFDNS

SEQ ID NO: 25416 - protein, 256 aa, Botrytis paeoniae
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSSKDWRGGRTAAQNIIPSSTGAAKAVGKVIPELNGKLTGMSMRVPTANVSVVDLTVRIEKGASYDEIKAVIKKAADGPLKGILGYTEDDVVSTDMNGDNNSSIFDAKA

SEQ ID NO: 25417 - protein, 393 aa, Bacteroides thetaiotaomicron VPI-5482
MQKESQTYKIAPAERLASVSEYYFSKKLKEVAQMNAEGKDVISLGIGSPDMPPSKVTIETLCNNAHDPNGHGYQPYVGIPELRKGFAAWYQRWYGVELNPNTEIQPLIGSKEGILHVTLAFVNPGEQVLVPNPGYPTYTSLSKILGAEVISYDLKEEDGWMPDFEALEKMDLNRVKLMWTNYPNMPTGANATPELYERLVDFARRKNIVIVNDNPYSFILNEKPISILSVPGAKECCIEFNSMSKSHNMPGWRIGMLASNAEFVQWILKVKSNIDSGMFRAMQLAAATALEAEADWYEGNNHNYRGRRHLAGEIMKTLGCTYDENQVGMFLWGKIPASCKDVEELTEKVLHQARVFITPGFIFGSNGARFIRISLCCKDAKLAEALERIKKLS

SEQ ID NO: 25418 - protein, 282 aa, Bacteroides thetaiotaomicron VPI-5482
MKKIAIQGTLGSYHDIAAHKYFEGEEIELICCANFEDVFTSIRKDSQVIGMLAIENTIAGSLLHNNELLRQSGTQIIGEYKLRISHSFVCLPEESWEDLTEVNSHPIALMQCRDFLNQHPQLKVVEGEDTARSAEIIKKENLKGHAAICSKTAAERYGMKVLQEGIETNKHNFTRFLVVADPWQVDELRQHHAKATNKASMVFTLPHTEGSLSQVLSILSFYNINLTKIQSLPIIGREWEYQFYVDVSFNDYLRYKQSIAAITPLTKELKILGEYAEGKSNV

SEQ ID NO: 25419 - protein, 158 aa, Zea mays
  misc_feature (82)..(82): Xaa can be any naturally occurring amino acid
WLLHRVPHALLLRRPRGAPHRCQGGRLRRDRNLQELCCLHATVKRILGICFGHQHKKHDSYEAPIKSKEPLIFNVGFRQFTXPLFSSDNINCNKHKMERFLHHGWFSVASVYASISFLPLPLIVLKNRDGEQSTIAAVGSLKSVDPNRIILKKIVLTR

SEQ ID NO: 25420 - protein, 407 aa, Ostreococcus tauri
MLVVASRARASGDDEGFVAIARGVDRPSQTAVSSERGTICSLDERAPRTAFTVKHSSATREDAVEVNAMTFTSDHALFYALGSRVVEADARMASDSRVVDANAPLGGWAVRVFESNADVVNGLDVDVSGRCLAACDDSGEIVVYDARTGAVVKRLRGHDGCATAVAFRRKRGAESELLTTATDCRAMKWDHRAKTVPVRTWDARSVRSARDHDRAHSGAADESSDDGGQRMFNPPMLHSVSAFEGETCAENAPGARRVACAACGDGTIHGFDADLKAVASSSGKKLSSASSKAPGGAFRDGRAECVRLGEDGVGGHANAATCAGFVPWLPRGDIIVSGGADRRLIAWNWVSVSTPGDFVDDPSARASGVVADLPLNRKINDLAFVRDSRRIVVVDTGPKVTFIDFTE

SEQ ID NO: 25421 - protein, 218 aa, Arabidopsis thaliana
MATKRSVGTLKEADLKGKSVFVRVDLNVPLDDNSNITDDTRIRAVVSTIKYLMGNGSRVVLCSHSCRSKGVFFKFSLKPLASRLSVLSCVVVFLVFRFYLFWYLSFCIVLPLCRSFLLPFLFPFFLFLFFSSLSLFIISSLTSPFFFFLSFRSPIYSFLFSSFFLLSLFLFLSSLSSLPFLPLFPFLPLFLLLPLSPLFLSFLYFLFHSSFSTFSFPS

SEQ ID NO: 25422 - protein, 427 aa, Thermotoga maritima MSB8
MEIVDVRAREVLDSRGNPTVEAEVVLEDGTMGRAIVPSGASTGKFEALEIRDKDKKRYLGKGVLKAVENVNETIAPALIGMNAFDQPLVDKTLIELDGTENKSKLGANAILAVSMAVARAAANYLGLPLYKYLGGVNAKVLPVPLMNVINGGQHADNNLDLQEFMIVPAGFDSFREALRAGAEIFHTLKKILHEAGHVTAVGDEGGFAPNLSSNEEAIKVLIEAIEKAGYKPGEEVFIALDCAASSFYDEEKGVYYVDGEEKSSEVLMGYYEELVAKYPIISIEDPFAEEDWDAFVEFTKRVGNKVQIVGDDLYVTNVKRLSKGIELKATNSILIKLNQIGTVTETLDAVEMAQKNNMTAIISHRSGESEDTFIADLAVATNAGFIKTGSLSRSERIAKYNQLLRIEEELGKVAEFRGLKSFYSIKR

SEQ ID NO: 25423 - protein, 413 aa, Thermotoga sp. RQ2
MLSTGLYEDFPTLKMKINGKRIVYLDSAATTLKPKQVVKKLEEFYYNSYANVHRAVHTLAVRATTELEETREEFAEFLGVFPQEIIFTSGTTMAINLVVMSLLRSGILKKDDLVLVSLLEHHANFVPWLRLSKLHGYRIDFIKPSGRFGTLEMDDLLKHRDKNPKVVAITGLSNVTGQRIPVEELRNVFPNSIILLDGAQLIPHEPVKPKEIGVDFLAFSLHKMLGPTGVGVLYGKRELMEQMEPFLYGGEMIDRVSLEDVTFNELPYKFEAGTPNIADIVASREALRYLKETGFDSVHEKIEQLTQMALKEMMKIGGVEIYGPLDERQHGIVSFNVKGIHPHDVAHILDQEFGIAVRSGHHCAQPLMSILKEQSQIDFPNSTCRASFYIYNTEEDVKILVEGVKKVKEWFSR

SEQ ID NO: 25424 - protein, 448 aa, Burkholderia pseudomallei K96243
MSTHATDDWVARSLRAVWHPCTQMKHHERLPLIPVARGERAWLFDRAGNRYLDAISSWWVNLFGHANPRINAALKQQLDTLEHAMLAGCTHESAIELAERLAARTQHTLGHAFFASDGASAVEIALKMSFHAWRNRGRGDKREFVCIANGYHGETIGALGVTDVALFKDAYDPLIRAAHVVASPDARGARDGETAADVAARALGDVRRLFAERGEKIAALIVEPLVQCAAGFAMHDPSYVRGLRALCDAHDVHLIADEIAVGCGRTGTFFACEQAHVWPDFLCLSKGISGGYLPLSLVLSRDAIFDAFYDDDVTRGFLHSHSYTGNPLACRAAVATLELFDTDDVLAENARKSALMREALAPLASHPHVRHLRERGTIFAFDVALEGDAARTFPRRFFAHALARETLLRPIGTTVYLMPPYILDEGEIEWLASRTRATLDATLSEAHA

SEQ ID NO: 25425 - protein, 317 aa, Saccharophagus degradans 2-40
MLYDNILATIGNTPIVRLNKLAPEGQNIYVKVESFNPMASVKDRLAFAIIDDAEKRGVLKPGQTVVEATSGNTGIALAMVCAAKGYPFVATMVETFSVERRKLMKALGAKVILTPAAEKGTGMVKKAAELAEKHGWFLASQFENEANPAYHRNTTGPEILRDFAGKDLDYFVSGWGTGGTMTGAGQMLKLARPDLKVIVAEPQNAAMLSGNPWSPHKVQGWTPDFVPAVLDKTVADEIVTVSDDDAIATAKALATQEGIFCGISSGATLAATIAYAKQAPTGSTFVVMLPDTGERYLSTPLFADITEESDDEWLSQQ

SEQ ID NO: 25426 - protein, 314 aa, Saccharomyces cerevisiae
MSYNPYAYATSEQNGVNDRFSHTPQQQRPMQIPRNTPVNGQGNANMNANVNGSGGGFPFQDPRGSMAFQLGQSAFSNFIGQDNFNQFQETVNKATANAAGSQQISTYFQVSTRYVINKLKLILVPFLNGTKNWQRIMDSGNFLPPRDDVNSPDMYMPIMGLVTYILIWNTQQGLKGSFNPEDLYYKLSSTLAFVCLDLLILKLGLYLLIDSKIPSFSLVELLCYVGYKFVPLILAQLLTNVTMPFNLNILIKFYLFIAFGVFLLRSVKFNLLSRSGAEDDDIHVSISKSTVKKCNYFLFVYGFIWQNVLMWLMG

SEQ ID NO: 25427 - protein, 176 aa, Synechococcus sp. WH 5701
MKHTLSVLVQDESGALSRISGLFARRGFNIESLAVGPAEQRGHSRLTMVVEGDDHTLEQMTKQLNKLVNVLNVIDLTRIPAVERELMLLKVAAPPENRAAILDLVEVFRAKVVDVADNALILEVVGDPGKLVALEQILESYGILEIARTGKVALERASGVNTAFLKVTASDKRVPA

SEQ ID NO: 25428 - protein, 279 aa, Lactococcus lactis subsp. lactis Il1403
MKIAYLGPRGSFCSVVAETAFVSEELFAYDSILDVIEAYDEGKCDFALVPIENSTEGTVNMSIDKIFHDSKATVVAEFVLPISQNLLALSKEGKIEHIYSHPQALAQTRNYLREHYPQAKVEITDSTSAAAEFVKNHPDLPIAAVANSYAAKMYDLEIVAKNIQDLAGNSTRFWLLGKEKKSFDLLKTGEKVSLALTLPDNLPGALHKAISVFAWRDIDMTKIESRPLRTRLGQYFFNIDLVNNEKNNLKIPYALEELSGLGVKVRLLGNYAVYSLGEG

SEQ ID NO: 25429 - protein, 443 aa, Bacillus halodurans C-125
MSQSIQTQEEDLKSLLTRRERIVPRGVVNNIQTFAKEAKGAIVIDVEGKSYIDFAGAIGTINVGHSHPKVVQAVQQQADQFIHTGFNVMMYESYIELAERLAALAPGSFEKKVLLQNSGAEAVENAVKMARKYTGRQGIVSFSRGFHGRTLMTMTMTSKVKPYKFGFGPFAPEVYKAPYPYEYRRPEGMSEDAYHAYVLQEFIQFMNVEVAPESVAAVVMEPVQGEGGFIVPSKSFVQGVYRYCKEHGILFIADEIQTGFARTGHYFASEHFEIEPDLLTVSKSLGAGVPISGVIGRREVLDEASPGELGGTYSGSPLGCAAALAVLDIIEEEGLNERARKLGQVVMDKMAQLQEQYECIGHIRGLGAMCAMEVVKDRHTKEPDKELTAKIVSEAGNRGLLLLSAGQYGNVLRFLMPIVITDEQLNNGFAILEEALATAIVNR

SEQ ID NO: 25430 - protein, 437 aa, Mesembryanthemum crystallinum
MEMERVTEFPLTHHLDRRRRKRARLGWDVAPQISKAQIGIFCGQEVGNVTSFAPSAAPSEHTTTTSSLFSKGVARNGSPRQGGMMTKMGITCLSFGENLTSRYKIHGKMGEGTFGQVLECWDRERKEMVAIKIVRGIKKYREAAMIEIDVLQQLGKHDKGGSRCVQIRNWFDYRNHICIVFEKLGSSLYDFLRKNNYGPFPIDLVRENGRQLLDCVAFMHDLHLIHTDLKPENVLLVSSDYVKIRDYKGFSRSPKDSSYYKKVPKSSAIKVIDFGSTTYERPDQNYIVSTRHYRAPEVILGLGWSYPCDVWSVGCILVELCSGEALFQTHENLEDLAMMERVLGPLPQHMLKRVDRHAEKYVRRGRLDWPEGAASRESIRAVTKLLRLQNLVMQHVDHSGGDFIHLLQGLLRYDPSDRLTAREAVRHPFFTRDNLRR

SEQ ID NO: 25431 - protein, 526 aa, Aspergillus niger
MAASSSLDHLSNRMKLEWHSKLNTEMVPSKNFRRTSIIGTIGPKTNSVEKINSLRTAGLNVVRMNFSHGSYQYHQSVIDNAREAAKTQVGRPLAIALDTKGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTSGKTARYLSKYRPVCPIVMVTRNPAASRYSHLYRGVWPFLFPEKKPDFNVKVWQEDVDRRLKWGINHALKLGIINKGDNIVCVQGWRGGMGHTNTVRVVPAEENLGLAE

SEQ ID NO: 25432 - protein, 583 aa, Ricinus communis
MSQSLHFSPNLTFAKQPFPKLPLPFPTSNSRYPVNNYKSLSIKASTSPSSSSDPQVLVADNGTGNSGVLYNNNNKSVTVSDPSSIEVDAVTETELKENGFRSTRRTKLVCTIGPATCGFEELEALAVGGMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 25433 - protein, 438 aa, Aspergillus nidulans FGSC A4
MVPPMTSAVLHRDTRFVPKKAVGGKGSYLLLEDGTKFLDSTGGAAVSCLGHGHEKIIQAITEQFTKVEYCHTAFFGTEASENLASLLVDSTGGKLSKLFVVSSGSEAVEAALKLARQYFLELPTPQPQRTRFIARKPSYHGTTLGALGVGGHALRRQPFEPILSQNVSHVSPCYAYRGKNDGESDADYVARLAGELDAEFRRVGPDTVCAFIAEPIVGAALGCVPAVPGYFAAMKTICEKHGALFILDEIMCGMGRCGTLHAWEQEDVTPDLQTIGKALGGGYAPVSGLLISDKVVQTVDKGTGAFRHGQTYQGHPISCAAALAVQTVIVEEQLLDNVKSMGEYLEKRLRGTLEGMQYVGDIRGKGLFWGVEFVKNKATKEPFSSETALAFKIQETGTVNGTRGDHIILAPAYNVTKEEIDIIVDTTAKVLAEVFAQL

SEQ ID NO: 25434 - protein, 195 aa, Oryza sativa Japonica Group
MVSLRAAIVLVVAASSVAVAFSHAEGNEGPDFTYIEGAMDGPSNWGKLSPEYRMCGEGRSQSPIDINTKTVVPRSDLDTLDRNYNAVNATIVNNGKDITMKFHGEVGQVIIAGKPYRFQAIHWHAPSEHTINGRRFPLELHLVHKSDADGGLAVISGRLLLQPAGQRRLLPGIRQVILSFFFLSFFFGFLYLMLS

SEQ ID NO: 25435 - protein, 395 aa, Bacillus halodurans C-125
MPKVGGEHEYVHRAMGGKAAFLASWAITLGYVSVVAFEAVALPTVIEYIFPNYQVGYMWTIAGWDVYASWVLVGVAGSIFVIAINYFGLKPAAKIQVILTLSIILIGLMLVFGSAVGGEAANFEPLFVNGATGIMAVLIMVPFLFIGFDVIPQTAEEANIPARDIGKLLIFSVFCAIVFYILIAIGVVSALDANALEVTQLATADAMSALFGSTFFGHLLVVGGVAGIMTSWNAFIIGGSRVMFAMAQSGMLPKWFGRLHPKYRTPSNAILFIGGLAVLSPLLGRPALVWFVDSGGPAIVIAYLMVAIAFLLLRKNEPAMERPYQSGRSSIVGWIALVLSIGFLIIYLPGMPAALTGPEWVIFVGWFLIGLYFFVQMSKGKYKENENEKTSDQAM

SEQ ID NO: 25436 - protein, 144 aa, Streptococcus anginosus
FKHLHKPTDNDLKKLFIRGQYTSGKVDGKKYISYRSEPNVDPESTTETFASGAFFVDSERFRGVPFFFRTGKRLTAKGTHVNIVFKQVESIFGSSLQPNVLTIYIQPTEGFSLSMNGKEVGEQFNLAPLTLDYRTDATASGASP

SEQ ID NO: 25437 - protein, 468 aa, Bacillus halodurans C-125; identical to SEQ ID NO: 1395

SEQ ID NO: 25438 - protein, 144 aa, Streptococcus anginosus
FKHLHKPTDNDLKKLFIRGQYTSGKVDGKKYISYRSEPNVDPESTTETFASGAFFVDSDRFRGVPFFFRTGKRLTAKGTHVNIVFKQVESIFGSSLQPNVLTIYIQPTEGFSLSMNGKEVGEQFNLAPLTLDYRTDATASGASP

SEQ ID NO: 25439 - protein, 276 aa, Zea mays
MRKRERENPCGICGHYHKYEEGEVCGVCGHRPPAASPVGARQQDSAFPSEILKEFLFLGSYDNASRSELLKTIGVSHILNTVPLCQNLYRNSFTYHCLQEDKTLQFDDANQFLEQCEREKARVLVHCMSGKSRSAAFVIAFLMKSRGWRLAQSFQWVKERRPQVQLSDAAQQQLIEYEKKLFGSNDGSIPAQPFAPVDSLPSLGFGFPKPPGDIQAPTFNQQAPASIFERVTPNSFPSNFIFGAERTSDSDAKLPDSNNFGVVNSSTGSDSMMDSS

SEQ ID NO: 25440 - protein, 606 aa, Aspergillus oryzae
MRMSYKYRRQARNLAWYDQDGEPSTHNPFKKFRRQRPRRTDSIQLESKLTPIRTAGDVPLDEERRRRRDMTDGLVGPEHSDTFPPESSGTDQGTPYRAGREPSMHSNEPINIPAQTGLDEDQMGGPRKRRTFASGFGDKSLDGDMNSNSAEDVKEKPKFTAMGQLKATLFNSWVNVLLLAAPAGIALNYVDVDPVAVFVVNFIAIIPLAAMLGYATEEIAMRTGETIGGLLNASFGNAVELIVAIIALVDDEVVIVQTSLIGSMLSNLLLVMGMCFFFGGVNRLEQHFNPVVAQTAASLLALAVGCLIIPTAFHNWSGGKSMNSPLGYQMLIRLQQATVVLQNSREVSYVRRQLTDHFSQIVGTSIIMLVVYGCYLFFQLGSHTEMYNSPSPKVEKRRGKVNEGDTHRGIAQIGKMTATLAGQNAQQMQLQDPDEEEEEPQLSIWVAVLTLAIATALVALCAEFMVDSINAITDRGGISKTFVGLILLPIVGNAAEHATAVTVACKDKMDLAIGVAVGSSMQIALLVLPLIIVIGWGMGNNDMTLYFDAFQVILLFVAVLLSQVNYLIADGKSHWLEGVLLMMMYLIIAVAAWKRCKLDTKTSEDF

SEQ ID NO: 25441 - protein, 423 aa, Francisella tularensis subsp. holarctica
MDNHNSSHQLYKKAMALVLAGGRGSRLYNLTDTRAKPAVYFGGKFRIIDFALSNCLNSGIRRIGVVTQYKSHSLLRHLQRGWGFLRGELNEFIDLLPAQQRVDEEHWYRGTADAVYQNIDILRSYGPEYVIVLAGDHIYKMDYSIMLRDHAQSGYKCTVGCVEIAKEEAYAFGIMGIDENRKITSFIEKPKKNAPTIPGTTDRCYASMGIYIFNSDYLYDLLEEDITNKESSHDFGKDIIPRVVSENQALAHPFSMSCVPRGEGIEPYWRDVGTIDAFWEANLDLAANMPELNIYDKDWPVWTAQEQLPPAKFVPDRNGNHGVITNTLASGGCIVLGSEISKSLMFSKVRVLAGCKIDQCVIMPEVVVGENCRLKKVVIDKGCDIPAGMVIGEDPIEDAKNFYRTDKGVVLVTKKMIDELKEK

SEQ ID NO: 25442 - protein, 213 aa, Clostridium difficile 630
MGNTFYIVRHGQTDWNILGKTQGHGNSDLTPQGIEQAKELSEDIGKYSIDYIFSSDLGRAMQTAQILGDKLNIEVQKTEALREMGFGVWEGLLIKEIQKDYSDIYATWRNEPHLVNIPEGETLKIIKERVDAFIKELNEKYDNKNIILVTHSITLRVMLLSFLESGMENIYRIKQDNTALNIVEFKDYGPVIVKMNDTSHIKNHVKINNSALE

SEQ ID NO: 25443 - protein, 272 aa, Bacillus subtilis subsp. subtilis str. 168
MIKKAIIPAGGFGTRNLPVTKVIPKEMFPVGSKPVIHYLVEELKESGIEDILMVVSSHKNLIVDYFDSSLALEAFLASKNKLHLLREHPIPDIRIHYVRQPYAKGLGDAISFGKQFAGGEPFAVVLPDDLIFSANQPALGQLIEAYTKYQSSVIGLKETKTEDLHHYGVIKGEPVEKGLYRIQDIVEKPKQNPPSHFAAAGRYIFTPDIFNELEALEADSGGEVQVTDAIKASLGACTVYGKLLEGERYDIGLQKDYLKLIYDMLKTEKNPQ

SEQ ID NO: 25444 - protein, 428 aa, Bacillus subtilis subsp. subtilis str. 168
MKICVVGAGYVGLTLSAALASIGHDMICTDKDVKKIGQLKKGVIPFYEPGLSDAILRCGNLSFSSEVKSSMEECPVIFIAVGTPPRSDGSADTKALQSVIGDLSEAIRSYKTIITKSTVPPGTNENIAKQLIASGVSKNLFNIVSNPEFLREGNALYDMLHPDKTVIGVQEEDHVSAAIVKSIYKHIDTPFIVTSLAGAELIKYANNFFLAAKISFINEMARICEAYQSDISDISRAIGLDPRIGKHFLQAGIGYGGSCFPKDLQALQFAAQEKNTETFLLRAVQHINDTQLGLYIKKIQSFFETLQGKKAAVLGISFKPNTDDIRNSQAVRLMERLAELGCDVHAYDPEAVLPEHLRQHVTQHSQAFDAIEESDFLFLATEWSEFLAFDWKKAADIMKGRLVIDGRNVLKKELIEACGLICTGVGRP

SEQ ID NO: 25445 - protein, 498 aa, Cryptococcus neoformans var. neoformans JEC21
MPTLRKTGDRPAGTGLAKPPSVPSPRAPSKPSAPPPPAPSGPPSRTAPPAPPAPPAPPAPPAPPAPPAPPAPTRHVPPPARATPPAPPAPTSSRAPPRVPPAPPAPSRTAPPAPAPPAPPAPAPPAPAPPAPPAPPAPPAPAPPARNAVHRKEPAPPLPGRSPAPSLPNRPTNSVPARAVPPPPPRPSSMTGGRAPPPPPPRPTGPPTLPSRPASSYAAPNRALPPAIPSRTDSSNLAPPTPPRRPSSVSAPPAPPPPAPAPPAPAPPAPPAPAAPAPRRMIPPPARSIPSPAPRVVQPEPEPEPEPEYYGQEEETAPPPLPAGRPASRLPPPPPSAPPPPPPGPSPASRAAPPAPARAPPAPARAPPAPARAPPSPALERNRPHPAGTAFAPPPPPGISPAAGTNRSSLAPPILASRPRPQSLHASRTNVAQRSSEAVDSDGGADGDSGAEDQVPEPPAVVGSWTFPMKGMFPAPRPWSGGRKTYVSGNMHGGGIGF

SEQ ID NO: 25446 - protein, 316 aa, Bacillus subtilis subsp. subtilis str. 168
MKILVTGAAGFIGSHLCEELLKDKKHNVIGIDDFIGPTPFSLKLKNLKNLLPEKRFTFIKENLLTADLASLLEGVDVIFHLAAIPGVRSSWGNHFHPYAAHNIQALQRLLEACREHSIQTFVFASTSSVYGEKQGKVSENTSLSPLSPYGVTKLTGEKLCHVYKQSFGIPIVILRFFTVYGPRQRPDMAFHRLIKQHLQQKPLTIFGDGQQSRDFTYISDCVKGITAVLGKPHLIGETVNIGGAERASVLKVVSLIEDISGRKATLHFSDKIAGEPSNTWADISKAKQLLHYDPATSLKDGLTNEIAYLSSLYQGE

SEQ ID NO: 25447 - protein, 153 aa, Oryza sativa Japonica Group
MAQFTVPVPSAEEETTDAVTIGEALQAAGSDDNEPVGLADAAAVQAAEMRTTGLAGVVPGGVAAAAQQAAEANMRRRPDGDDGENKATTTTLMKDVVGGAAEALPADMVATREDADRVAAAAARNAARRGGGGGKGVAEAVAAAAEMNEGRMV

SEQ ID NO: 25448 - protein, 686 aa, Oryza sativa Japonica Group
MARSGRERRDQEEEAAVVSVERVFEGRVVPGWKEQVTLRALAVSALLGAMFSVIVMKLNLTTGIIPSLNVSAGLLGFFLLTSWTKLLDKAGVASVRPFTRQENTVVQTCVVACSGIAFSGGFGSYIFAMSDRISDQSGEARDEHNIKNPSLGWMIGFLFIVSFLGLFSVVPLRKIMIIDYKLIYPSGTATAHLINSFHTPQGAKLAKMQVKMLGKFFVMSFSWGFFQWFYTGGDGCGFMSFPTLGLEAYRNKFFFDFSATYVGVGMICPYLVNISVLLGGVMSWGIMWPLIEHKKGDWYPADLKPSSLRGIVGYRVFISISLILGDGLYNFLKVMTRTTTALVMQVRAMMSEPTLPVSGGGGQTPEETFDDKRRTELFLKDQIPNWLALSAYVVIAVVSIATVPRIFHQLRWYHVAVSYVVAPVLAFCNAYGCGLTDWSLATTYGKLAIFTVGAWADASDGGIIAGLAACGVMIGIVSTASDLTQDFKTGYMTLASPRSMFVSQVIGTAMGCVIAPSVFWLFYKAFHDIGMPGSEYPSPNALVYRNMAILGVQGLGSLPKHCLDLCIGFFVAAIAVNLARDLAAPKVARFLPLPMAMAIPFYLGPYFGIDMCIGSLIRFVWDRLDGARAKAFAPPVASGLICGDGIWTLPQSVLALAGVKPPICMKFLSRTTNIKVDAFIAKLPSS

SEQ ID NO: 25449 - protein, 216 aa, Bacteroides thetaiotaomicron VPI-5482
MKPIISPSILSADFGYLARDIEMINRSEAEWVHIDIMDGVFVPNISFGFPVLKYVAKLTDKPLDVHLMIVNPEKFIPEVKALGAHTMNVHYEACTHLHRVIQQIKEAGMQPAVTINPATPVALLQDIIQDVYMVLIMSVNPGFGGQKFIEHSVEKVRELRALIERAGSKALIEVDGGVNLETGARLVEAGADVLVAGNAVFGAPDPEEMIRQLHKL

SEQ ID NO: 25450 - protein, 712 aa, Oryza sativa Japonica Group
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPLTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFNIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGN

SEQ ID NO: 25451 - protein, 181 aa, Synechococcus sp. RS9916
MKMHDDSPHSWPEPQISPNAWVASSAVVIGDVQMADGSSLWPTAVARADLASITIGEGSNVQDGAVLHGDPGEPVTIGRHVTIGHRAVVHGATLKEGCLIGIGAIVLNGVTVGEGALVAAGAVVTKDVPPRTLVAGIPAQVKREFSEELAQKQIQHAIRYRELAQVHATRVQPEMLQNQTS

SEQ ID NO: 25452 - protein, 404 aa, Vibrio campbellii AND4
MQDALAVILAGGMGSRLSPLTDGRAKPAVPFGGKYRIIDFTLTNCLHSGLRKILVLTQYKSHSLQKHLRDGWSVFNPELGEYITAVPPQMRKGGAWYEGTADAIYHNMWLLSRNDAKYVVVLSGDHIYRMDYAAMLEEHKENGAKLTVACMNVPVEDASAFGVMGIKENGLVESFIEKPAKPPTLPDDPSQSLASMGIYIFDMGVLQEALKEDATLEGSNHDFGADIIPRLIDTQSVYAYKFCGSKGRVDKDCYWRDVGTIDSFYQANMDLLEPVPPMNLYQPNWAIRTYEAQYPPARTVSSATGNEGIFINSIIANGVINSGGSVQHSIIASNVRIQDSATVVDSIIFDDVEVGEGCQLVSCIIDKHVRVPPHTQIGINKIEDTKRFHVSEKGIVVIPEDYEF

SEQ ID NO: 25453 - protein, 418 aa, Ricinus communis
NAQSHDNVVSIMLDTKGPEVRSGDVPQPMLKEGQEFNPTIRRGVSTQDTVSVNYDDFVNDVVVGDILLVDGGMMSLAVKSKTSDLVKCVVVDGGELKSRRHLNVRGKSARLPSITDKDWGDIKFGVDNQVDFYAVSFVKDAKVVHELKEYLKRCNADIHVIVKIESADSIPNLHSIISASDGAMVARGDLGAELPIEEVPLLQEDIIRRCHSMQKPVIVATNMLESMINHPTPTRAEVSDIAIAVREGADAVMLSGETAHGKYPLKAVRVMHTVALRTESSSPVNTTPPAQGAYKGHMGEMFAFHATIMANTLNTPIIVFTRTGSMAVLLSHYQPASTIFAFTNEERIKQRLSLYRGVMPIYMEFSSDAEETFSRALQLLLNKGLLVEGEHVTLVQSGAQPIWRQESTHHIQVRKVQN

SEQ ID NO: 25454 - protein, 138 aa, Triticum aestivum
  misc_feature (80)..(80): Xaa can be any naturally occurring amino acid
MLRAGGRRLLAPGLRRLGLGTGASGEAGPAAAAAGVRAYHERVVDHYNNPRNVGSFDKDDPNVGTGLVGAPACGDVMKLXIRVDENSGKIVDACFKTFGCGSAIASSSVATEWVKGKPMDEVLTIKNTEIAKHLSLQQ

SEQ ID NO: 25455 - protein, 593 aa, Nicotiana tabacum
MSQALNFFVSSSSRSPATFTISRPSVFPSTGSLRLLVKKSLRTLVVEASSAAASDLDEPQSSPVLVSENGSGGVLSSATQEYGRNAAPGTDSSSIEVDTVTEAELKENGFRSTRRTKLICTIGPATCGFEQLERLAEGGMNVARINMCHGTREWHRMVIERLRRLNEEKGFAVAIMMDTEGSEIHMGDLGGASSAKAEDGEIWNFTVRSFDPPLPERTVTVNYDGFAEDVKVGDELLVDGGMVRFEVIEKIGPDVKCLCTDPGLLLPRANLTFWRDGKLVRERNAMLPTISSKDWLDIDFGIAEGVDFIAVSFVKSAEVIKHLKSYIQARARDSDISVIAKIESIDSLKNLEEIIQASDGAMVARGDLGAQIPLEQVPSEQQKIVQICRQLNRPVIVASQLLESMIEYPIPTRAEVADVSEAVRQRGDALMLSGESAMGQFPEKALTVLRSVSLRIERMWREQKRHEVIELPSIASSFSDSISEEICNSAAKMANNLEVDALFVYTKNGHMASLLSRCRPDCPIFAFTTTTSVRRRLNLQWGLMPFRLSFSDDMESNLNKTFSLLKARGMIKSGDLIIAVSDMLQSIQVMNVP

SEQ ID NO: 25456 - protein, 361 aa, Oryza sativa Japonica Group
MAAAADEEACMYALQLASSSILPMTLKNAIELGLLETLQSAAVAGGRGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 25457 - protein, 562 aa, Nicotiana tabacum
MATMNLPTGLHVAAKPASLDRLSSAKNVGDLFFSDSRHRKRVNTSNQIMAVQSLEHIHGVNNNVYANYVNFNVPSSGYSLGQESVYLNSPRKTKIVCTIGPSTSSREMIWKLAEAGMNVARLNMSHGDHASHQRTIDLVKEYNAQFEDKVIAIMLDTKGPEVISGDVPKPILLKEGQEFNFSIKRGVSTEDTVSVNYDDFINDVEAGDILLVDGGMMSLAVKSKTSDIVKCEVIDGGELKSRRHLNVRGKSATLPSITEKDWDDIKFGVNNQVDFYAVSFVKDAKVVHELKDYLKSCNADIHVIVKIESADSIPNLHSIISASDGAMVARGDLGAELPIEEVPLLQEDIIRRCQSMQKPVIVATNMLESMIDHPTPTRAEVSDISIAVREGADAVMLSGETAHGKYPLKAVKVMHIVALRTESSLQKSTSSPSQSAAYKSHMGEMFAFHSSSMANTLSTPIIVFTRTGSMAIILSHNRPSSTVFAFTNNERVKQRLALYHGVVPIYMEFSSDAEETFSRAIKLLLSKSLVKDGQYVTLVQSGAQPIWRRHSTHHIQVRKVQS

SEQ ID NO: 25458 - protein, 153 aa, Saccharomyces cerevisiae
MSQKACYVCGKIGHLAEDCDSERLCYNCNKPGHVQTDCTMPRTVEFKQCYNCGETGHVRSECTVQRCFNCNQTGHISRECPEPKKTSRFSKVSCYKCGGPNHMAKDCMKEDGISGLKCYTCGQAGHMSRDCQNDRLCYNCNETGHISKDCPKA

SEQ ID NO: 25459 - protein, 508 aa, Nicotiana tabacum
MAIENNNNGVNFCTVKRPKTKIVCTLGPASRSVPMIEKLLRAGMNVARFNFSHGSHDYHQETIDNLRQAMESTGILCAVMLDTKGPEIRTGFLKDAKPVQLKQGQEITISTDYSIKGDESMICMSYKKLAEDVKPQSVILCADGQITFTVLSCDKENGLDRCRCENTAVLGERKNVNLPGVIVDLPTLTDKDKDDILNWGVPNHIDMIALSFVRKGSDLVEVRKLLGEHAKNILLMSKVENQEGVANFDDILLNSDAFMVARGDLGMEIPIEKIFLAQKVMIYKCNIQGKPVVTATQMLESMIKSPRPTRAEATDVANAVLDGTDCVMLSGETAAGAYPDLAVGTMAKICIEAESTIDYPDVFKRIMSNAPVPMSPLESLASSAVRTANSAKAALILVLTRGGSTAKLVAKYRPGMPILSVVVPEIKTDSFDWTCSDESPARHSLIFRGLVPVLHAGSARASHEESTEEALDFALQHAKTKGLCKQGDSVVALHRVGTASVIKIVTVK

SEQ ID NO: 25460 - protein, 486 aa, Chorisia speciosa
  misc_feature (5)..(5): Xaa can be any naturally occurring amino acid
DSTLXKRNLGRISQIIGPVLDVAFPPGKMPNIYNALVVKGRDTAGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKLK

SEQ ID NO: 25461 - protein, 1501 aa, Saccharomyces kudriavzevii IFO 1802
MSSIKNTRDGSNNVATRSSSASYAASEESFSGAAHDKEKQNDTPADKLTRMLTGPARDTVSHVSATVSDMSPDVVSKVESFADALSRHTTRSGAFNMDAGGDDGFDAHAIFESFVRDADEQGIHIRKAGVTIENISAKGVDASALEGATFGNILCLPLSIFRGIKAKKHQKMREIICNVNALAEAGEMILVLGRPGAGCSSFLKVTAGEIDQFAGGVSGDIAYDGIPQKEMMKRYKADVIYNGELDVHFPYLTVKQTLDFAIACKTPALRVNNVSKEEYIASRRHLYATIFGLRHTYNTKVGNDFVRGVSGGERKRVSIAEALAAKGSIYCWDNATRGLDSSTALEYAKAIRIMTNLLKSTAFVTIYQASENIYETFDKVTVLYSGKQIYFGLINEAKPYFAKMGYLCPPRQVTAEFLTALTDPNGFHLIKPGYENKVPRTAEEFETYWLNSPEFAQLRNDIAAYNEKVNTEKTKEVYNESMAQEKSKFTRKKSYYTVSYWQQVNLCTQRGFQRIYGNKSYTVINVCAAIIQSFITGSLFYNTPSSTSGAFSRGGVLYFALLYYSLMGLANISFEHRPILQKHKGYSLYHPSAEAIGSTLAAFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCADTLVPSGGNYSSLSDDYKVCAFVGSKPGQSYVLGDDYLKNQFQYVYKHTWRNFGILWCFLIGYIVLKVVFTEYKRPVKGGGDALIFKKGSKRFVAPVDEESPDNINDIDAKEQFSSESSGANDEVFDELEAKGVFIWKDVCFTIPYEGSTRMLLDNVSGYCVPGTMTALMGESGAGKTTLLNTLAQRNVGIITGDMLVNGRPIDASFERRTGYVQQQDIHIAELTVRESLQFSARMRRPQRLPDSEKMEYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLKKGGQTVYFGDIGKNSAAILGYFEQNGARKCDHDENPAEYILEAIGAGATASVKEDWHEKWLNSPEYKQSQDKVQELINDLSKQETKSEFGDQPSKYATSYIYQFRYVLIRTSTSFWRSLNYIMSKMMLMMVGGLYIGFTFFNVGKSYVGLQNAMFAAFISIILSAPAMNQIQARAIASRELFEVRESQSNMFHWSLVLITQYLSELPYHLLFSTVFFVSSYFPLRIFFEASRSAVYFLNYCIMFQLYYVGLGLLILYMSPNLPSANVILGLCLSFMLSFCGVTQPVSLMPGFWTFMWKASPYTYFVQNLVGIMLHKKPVVCKKKELNYFNPPNGSTCGEYMKQFLEKSTGYIENPDATSDCAYCIYEVGDNYLTHISSKYSYLWRNFGIYWIYIFFNIIAMICVYYLFHVRQSSFLSPAFIIKKIKNARKKKQ

SEQ ID NO: 25462 - protein, 144 aa, Streptococcus anginosus
FKHLHKPTDNDLKKLFIRGQYTSGKVDGKKYISYRSEPNVEPESTTETFASGAFFVDSDRFRGVPFFFRTGKRLTAKGTHVNIVFKQVESIFGSSLQPNVLTIYIQPTEGFSLSMNGKEVGEQFSLAPLTLDYRTDATASGASP

SEQ ID NO: 25463 - protein, 483 aa, Durio zibethinus
  misc_feature (6)..(6): Xaa can be any naturally occurring amino acid
  misc_feature (60)..(60): Xaa can be any naturally occurring amino acid
STLEKXNLGRISQIIGPVLDVAFPPGKMPNIYNALVVKGRDTIGQQINVSCEVQQLLGNXRVRAVAMSATDGLMRGMEVINTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNKQNVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGKEHYETAQRVKQTLQRYKELQDIIAILGLDEVSEEDRLTVARARKIERFLSQPFFVAEVFTGSPGKYVGLAETIRGFQLILSGELDGLPEQAFYLVGNIDEATAKATNLEMESK

SEQ ID NO: 25464 - protein, 289 aa, Thermus thermophilus HB27
MEKVAFIGLGAMGYPMAGHLARRFPTLVWNRTFEKALRHQEEFGSEAVPLERVAEARVIFTCLPTTREVYEVAEALYPYLREGTYWVDATSGEPEASRRLAERLREKGVTYLDAPVSGGTSGAEAGTLTVMLGGPEEAVERVRPFLAYAKKVVHVGPVGAGHAVKAINNALLAVNLWAAGEGLLALVKQGVSAEKALEVINASSGRSNATENLIPQRVLTRAFPKTFALGLLVKDLGIAMGVLDGEKAPSPLLRLAREVYEMAKRELGPDADHVEALRLLERWGGVEIR

SEQ ID NO: 25465 - protein, 144 aa, Streptococcus anginosus
FKHLHKPTDNDLKKLFIRGQYTSGKVDGKKYISYRSEPNVNPESTTETFASGAFFVDSDRFRGVPFFFRTGKRLTAKGTHVNIVFKQMESIFGSSLQPNVLTIYIQPTEGFSLSMNGKEVGEQFSLAPLTLDYRTDATASGASP

SEQ ID NO: 25466 - protein, 188 aa, Staphylococcus epidermidis ATCC 12228
MILIIDNYDSFTYNLVDIVEKQCETIVKYPDDTDICNLKGITAVIISPGPGHPLDNQLLIKLIENFENLPILGVCLGAQALTCYYGGDVIQGSCVKHGKVDTLTIVNQSPLYKGIKSSFKVMRYHSLISDPCSFPESLLITGQTYDSIQSFQHKNRKHYGIQFHPESFATENGKQIIINFINIATRGS

SEQ ID NO: 25467 - protein, 286 aa, Oryza sativa Japonica Group
MNRRNTDNLVEDLLSDFEFELQPPYLLYRNAAQEVNGIWFYNQQDCDAVAGVFGRILNAYAKVPPKPKVPSTKSEFEELEAVPTSAAIDGPLEPSSSSTVLVSNAPDESLTDYFSGAVNVGNVSITPMVGRTHQPIESVASSHVPLIIPSAAPTHQMGVPSGAASAPPLPVIDTNVHSSHSTNLVTPAFFAPPSSSSASLVAPASSFMPTASPFHPTSADAHRPAYGHGTPLLQPLPPPTPPASLTPVHNDEPVISRDKVKDALLRLVQNDEFINLLYQELQNAHA

SEQ ID NO: 25468 - protein, 510 aa, Lilium longiflorum
MANIDIEGILKELPADGRVPKTKLVCTLGPSSRSVPMLEKLLRAGMNTARFNFSHGTHEYHQETLDNLRIAMQNTQILCAVVLDTKGPEIRTGFLKDGKAVQPKEGQEIIVSTDYDLKGGGNTITMSYKKLPVDMKPGGTILCADGSISLTVLSCDPDAGTVRCRCENTALLGERKNVNLPGVVVDLPTLTEKDKEDILEWGVPNNIDMIALSFVRKGSDLVNVRQVLGSHAKNIKLMSKVENQEGVVNFDEILKETDAFMVARGDLGMEIPVEKIFLAQKLMIYICNLAGKPVVTATQMLESMIKSPRPTRAEATDVANAVLDGTDCVMLSGESAAGAYLEIAVKVMAKICIEAESSLDYDAIFKEMIRSAPLPMSPLESLASSAVRTANKAKAALIVVLTRGGTTAKLVAKYRPAVPILSVVVPVLTSDSFDWNVSDESPARHSLIYRGLIPLLAEGSAKATDAESTEVILEAALKSATARRLCKPGDSIVALHRIGVASVIKICIVK

SEQ ID NO: 25469 - protein, 485 aa, Bacillus halodurans C-125
MFNIQDLNKQYIDGEWRDGKSPRVLRDRNPYNQEVLAEFQIATDSDVDAAYHAALKAQNEWATVNPYRKREILERAVTYIEEHEEEIVAIIIDELGGTRLKAAFEIGLVKNMIKEASTFPLRMEGKILPSTENGKENRLYRVPAGVVGVISPFNFPFFLSVKSVAPALGAGNGVVLKPHEETPITGGTLIAKIFEEAGVPKGLLNVVVTEIDEIGNAFVEHPIPRIISFTGSTNVGSHIGQLAVKHFKKPLLELGGNSAFLIFADADLDYAVQAATFSRFTHQGQICMSANRIFVQRDVYDEFVERYVTKVASLKVGDPRDPETVIGPVMNSRQAETLKQAIESGIAAGAKPVLHGAISGNMVEPTILIDASPEMAIAQEELFGPVVCVIPFDTEEEAVEMANDTKYGLSGAIHTANVERGVEIAKRIQTGMIHVNDITINDEPIVAFGGEKHSGLGRLNGEWSLEEFTTLKWVSVHYSQRVFPY

SEQ ID NO: 25470 - protein, 162 aa, Crocosphaera watsonii WH 8501
MSHNNSIGNYLIQRLLELGVNHVFGVPGDFVLGFNKLLENSDLEFINTCDEQGAGFAADAYARLRGLGVVCVTYCVGGLKIANTTAQCFAEKSPVVVISGSPGINERIKNPLLHHKVKEFDTQYKGFQEITVAATVLDNPDTAQVNRTIIHDYTSSFPQFGD

SEQ ID NO: 25471 - protein, 144 aa, Streptococcus anginosus
FKHLHKPTDNDLEKLFIRGQYTSGKVDGKKYISYRSEPNVDPESTTETFASGAFFVDSERFRGVPFFFRTGKRLTAKGTHVNIVFKQVESIFGSSLQPNVLTIYIQPTEGFSLSMNGKEVGEQFNLAPLTLDYRTDATASGASP

SEQ ID NO: 25472 - protein, 461 aa, Thermus thermophilus HB27
MKTYDLIVIGTGPGGYHAAIRAAQLGLKVLAVEASEVGGVCLNVGCIPTKALLHAAETLHHLKVAEGFGLKAKPELDLRKLGGWRDQVVKKLTGGVGTLLKGNGVELLRGFARLVGPKEVEVGGERYGAKSLILATGSEPLELKGFPFGEDVWDSTRALKVEEGLPKRLLVIGGGAVGLELGQVYRRLGAEVTLIEYMPEILPQGDPETAALLRRALEKEGIRVRTKTKAVGYEKKKDGLHVRLEPAEGGEGEEVVVDKVLVAVGRKPRTEGLGLEKAGVKVDERGFIRVNARMETSVPGVYAIGDAARPPLLAHKAMREGLIAAENAAGKDSAFDYQVPSVVYTSPEWAGVGLTEEEAKRAGYRVKVGKFPLAASGRALTLGGAEGMVKVVGDEETDLLLGVFIVGPQAGELIAEAALALEMGATLTDLALTIHPHPTLSESLMEAAEAFHKQAIHILNR

SEQ ID NO: 25473 - protein, 199 aa, Glycine max
  misc_feature (93)..(93): Xaa can be any naturally occurring amino acid
QKAFCSNYDIFLTRDCLAYSKIKPAVNQIETHPYFQRDSLVKFCQKHGICVTAHTPLGGAAANAEWFGTVSCLDDPSSQSELSILVSEHNIYXPTTITPRHCLSKNSFIKLINLRVYHFLLFQGLAEKYKKTAAQISLRWGIQRNTVVIPKSSKLERLKENFQVFDFELSKEDMELIGSIDRKYRTNQPAVFWGIDLYA

SEQ ID NO: 25474 - protein, 167 aa, Bacillus cereus
FKEYIDPAVGLQGFQARRIAFNINIPKELVGQAVKFMMGLYRAFIEKDCSIAEINPLVTTGDGKVMALDAKLNFDSNALYRHKDILELRDLDEEDAKEIEASKYDLNYIPLDGNIGCMVNGAGLAMATMDIIKHYHGDPANFLDVGGGATAEKVTEAFKIILSDENV

SEQ ID NO: 25475 - protein, 532 aa, Oenococcus oeni PSU-1
MSENAEGKTRRNHGLIHYANGPSLEEINGTVKVPKGRGFGETLFAYSGPGALVAVGYMDPGNWSTSITGGQNFQYLLMSTILISSLIAMLLQYMAAKLGIVSQMDLAQAIRARTSKSLGIVLWIMTELAIMATDIAEVIGAAIALYLLFHIPLVIAVFITVFDVLLLLLLTKIGFRKIEAIVVALILVILFVFVYQVALSDPNWSGVIAGLVPSAKAFATSPHIGGQTPLTGSLGIIGATVMPHNLYLHSAISQTRKIDHNDEEDVARTVRFSSWDSNIQLTAAFFVNALLLIMGVAVFKSGAVKDPSFFGLFEALSDTSTLSNGILISVAKTGILSTLFAVALLASGQNSTITGTLTGQVIMEGFVHMKMPLWLRRLVTRLISVIPVLICVSMTSGQSAINEHEALNTLMNNSQVFLAFALPFSMLPLLMFTDSDIEMGRRFKNTMWVKVLGWISVLSLTLLNLINLPGANGQIAAFFGDNATKSQLFLANIIAYALIVAIIALLVWTIVEILKGNKRYQLENHSVVGVED

SEQ ID NO: 25476 - protein, 451 aa, Thermus thermophilus HB27
MPKEILMPELAESVVEGEILKWLVEEGDYLKKDQPFVEVMTDKVTVELPSPYEGVLLKKLAKEGEVVKVHAPIALIAEPGEAVEGVKEPPPVQAVEERSIVEPGLPAKEEKEDLSLFKPDPTQVAVKNPFLSGEKPQEGARPGRVLAVPAARKLARELGIPIEEVPGSGPLGRVRVEDVRAYAERRKAPPERPEEGPQVLPAGFPPPPKYAPPKGYEHLEERVPLRGIRRTIAQGLWQSHLYTVRTLNVDEADLTELVRLRERLKPQAEAQGVKLTYLPFIVKAVVRALKKFPMLNTSLDEERQEIVYKRYYHIGLAVATERGLIVPVVRDADRKSVLELAQEIAELSQKAREGRLAPEEVTGSTFTITNIGSVGATLSFPIIHLPDAAILGVHSIRKRPWVMPDGSIRPRDIMFLSLSFDHRLVDGAEAAMFTREVIRLLENPDLLLLEM

SEQ ID NO: 25477 - protein, 716 aa, Oryza sativa Japonica Group
  misc_feature (50)..(50): Xaa can be any naturally occurring amino acid
MASHANASGGGGDEEMVEASTLRHRHGAGKDANGVGTERQLAAAAAEGEXEGPRRWSARSGQGVPSWREQLTVRAFVVSFFLSIMFSIIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKKQVKELGKFFLFSFVWGFFQWFYTAGDGCGFQSFPTLGLQAYKNRFYFDFSPTYVGVGMICPHIVNVSVLLGGILSWGIMWPLIRNKKGSWYAASLSETSLHGLQGYRVFISIALILGNGLYNFVKVLIRKTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 25478 - protein, 142 aa, Zea mays
  misc_feature (72)..(72): Xaa can be any naturally occurring amino acid
IAISACNIGGAWDNAKKYIEAGASEHARTLGPKGSDPHKAAVIGYTIGDPLKDTSGPSLNILIKLMAVESLXFAPFFAAHGFRPCFDPINSPPASEQLSPSSLISKLNPFPGMKHLDVAGGTGDVALSVLERVKSVGHRAVQ

SEQ ID NO: 25479 - protein, 468 aa, Escherichia coli
MSKQQIGVVGMAVMGRNLAPNIESRGYTVSIFNRSREKTEEVIAENPGKKLVPYYTVKEFVESLETPRRILLMVKAGAGTDAAIDSLKPYLDKGDIIIDSGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 25480 - protein, 325 aa, Populus trichocarpa
MAEEKGSIAKDITELIGKTPLVYLNNVVDGCVARIAAKLEMMEPCSSVKDRIGYSMITDAEEKGLIKAGESVLIEPTSGNTGIGLAFMAAAKGYRLIITMPASMSLERRMVLLAFGAELVLTDPARGMKGAVQKAEEISAKTPNSYILQQFENPANPKVHYETTGPEIWKGSGGKVDAFVSGIGTGGTITGAGKYLKEQNPDIKLYGVEPVESAVLSGGKPGPHKIQGIGAGFIPGVLNVDLLDETVQISSEEAIETAKLLALKEGLLVGISSGAAAAAAIKIAKRPENAGKLIVAIFPSFGERYLSSVLFESVKKEAENMVFEP

SEQ ID NO: 25481 - protein, 156 aa, Haemophilus quentini
NRSNTPVLVDGKDVMPEVNAVLTKMKDFCQRIISGEWKGYTGKAITDVVNIGIGGSDLGPYMVTEALRPYKNHLNMHFVSNVDSTHIAETLKKINPETTLFLVASKTFTTQETMTNAQSARDWLLKAAKDESAVAKHFAALSTNAKDVEKFGIDTN

SEQ ID NO: 25482 - protein, 380 aa, Bacillus subtilis subsp. subtilis str. 168
MKKQCVAMLLAGGKGSRLSGLTKNMAKPAVSFGGKYRIIDFTLSNCSNSGIDTVGILTQYQPLELNSYIGIGSAWDLDRYNGGVTVLPPYAESSEVKWYKGTASSIYENLNYLNQYDPEYVLILSGDHIYKMDYGKMLDYHIEKKADVTISVIEVGWEEASRFGIMKANPDGTITHFDEKPKFPKSNLASMGIYIFNWPLLKQYLEMDDQNPYSSHDFGKDIIPLLLEEKKKLSAYPFKGYWKDVGTVQSLWEANMDLLKEDSELKLFERKWKIYSVNPNQPPQFISSDAQVQDSLVNEGCVVYGNVSHSVLFQGVTVGKHTTVTSSVIMPDVTIGEHVVIENAIVPNGMVLPDGAVIRSEKDIEEVLLVSEEFVEKELI

SEQ ID NO: 25483 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRVDKEGVFHTEWLD

SEQ ID NO: 25484 - protein, 147 aa, Magnaporthe grisea
MALKRINKELTDLGRDPPSSCSAGPVGEDLFHWQATIMGPSDSPYAGGVFFLAIHFPTDYPFKPPKVNFTTRIYHPNINSNGSICLDILRDQWSPALTISKVLLSICSMLTDPNPDDPLVPEIAHVYRTARAQYEATAREWTPKYAI

SEQ ID NO: 25485 - protein, 206 aa, Rhodopirellula baltica SH 1
MCDQLAFASQRKPYQHMDLRHHVRDIPDYPKPGILFRDITPLLAHPEALTASVEEMAKPFLDQKIDVVAAAEARGFIFGTPLAMRLNAGFVPIRKPGKLPFDLHSFAYELEYGSDELQIHVDGIKPGQRVLIVDDLLATGGTVEACLRLLEKCDAEIVGCSFLIHLVALGGEARLSPYHVHSVLEYGGDDAEDELSIQNRPPGPSV

SEQ ID NO: 25486 - protein, 503 aa, Zea mays
MNRPSCRLRGRRRRPARRTRTPTAPAASPCTPGSSPSLPRRQARRDQIGIGRGGAGAWGPEIPFVPERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSKKEDSPLKATDFGLSDFIKPGRQFRDIVGSAYYVAPEVLKRRSGPESDVWSIGVITYILLCGRRPFWDKTEDGIFKEVLKKKPDFRRKPWSNITSSAKDFVQKLLVKDPRARLTAAQALSHDWVREGGKASEIPLDISVLHNMRQFVKYSRFKQFALRALASTLNSEEMSDLRDQFNAIDVDKNGTISLEELKQALAKDVPWRLKGPRVLEIIEAIDSNTDGLVDFEEFVAATLHVHQLVEHDTEKWKSLSQAAFDKIDVDRDGYITPDELRMHTGMKGSIDPLLEEADIDKDGKISLDEFRRLLKTASMSARNVQTPRGVRKS

SEQ ID NO: 25487 - protein, 267 aa, Oryza sativa
  misc_feature (5)..(5): Xaa can be any naturally occurring amino acid
  misc_feature (34)..(34): Xaa can be any naturally occurring amino acid
ENVRXYKEEEKNDPEFANDAFGTAHRAHASTEGXFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVSEFDKFAVGTEAIAKKLADLSGKGVTTIIGGGDSVAAVEKVGVVYVMSHISTGGGASLELLAGKDLAGVIVLDEGFAVAV

SEQ ID NO: 25488 - protein, 404 aa, Salmonella enterica subsp. enterica serovar Typhi str. CT18
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYDDAEHHSIAALAPDLLTITFNGLSKTYRVAGFRQGWMVLNGPKKHAKGYIEGLEMLASMRLCANVPAQHAIQTALGGYQSISEFILPGGRLYEQRNRAWELINDIPGVSCVKPRGALYMFPRIDAKRFNIHDDQKMVLDFLLQEKVLLVQGTAFNWPWPDHFRIVTLPREDDLEMAINRFGRFLSGYHQ

SEQ ID NO: 25489 - protein, 389 aa, Haemophilus influenzae R2846
MNLHEYQAKQLFEHYGLPVKNGAVCQSVDEVDLVLAQLSGDKWAAKCQVHAGGRGKAGGVKLVHDVEEARSFAEKWLGQRLVTFQTDKLGQPVNQIYFEETCDIDKEFYLSAVVDRASQKVVFIASPAGGMNIEEVAQNSPHLLHKVTIDPLFGGLPYQGRELAFKLGLSGTQNKQFTDIFMGLSRLFLEKDLSLVEVNPLVLTQQGNLVCLDAKISVDDNALFRHKDLLALQDLTQNDAREAEAEKFQLNYVALEGDIGCMVNGAGLAMGTMDIVKLYGGKPANFLDVGGGATQERVAEAFKIILTDPSVKVILVNIFGGIVRCDLIAEGVIAAVNEVGVRVPVVVRLEGTNAEIGRQILVESDVNILTAQSLQQAAELAVNAAKGEH

SEQ ID NO: 25490 - protein, 583 aa, Zea mays
MKDAFSPPSPPPAPAPAPAPDSAEDLADARLAPWTFSPWPAPRRDHASGGGSGSGRPNPLFTILPVSALAIGLVLLVAVAVILLAVTRRARPPKADGASGSCNGDSGKPGAPTSSCGSHVTSRCGGYAAAGTGCIYAGRLGFSAQPRSRGAQVFTYRELERATDWFSECNVVGRGASGAVFRGRLADGTTAAIKRLRLDQRRQGEREFRIERLVRLGSASAVGKDMGATVPSCHEPSDGVGLVRCAAVPWAPLAGGGTRAGPPCHGTGKVRVSRWVNPSLCLAPHGCTSDERSRVGTVAVGVTPVCTSDEVGCADVQDADVDLLSRMDSPYLVGLLGYCADQSHRLLVFEYMANGSLKSRLHHPAPAAAAAAGPPPPPPLDWQTRLGIALDCARALEFLHEHSSPAVIHRDFNCSNVLLDHNYRARVSDFGMAKVGSNRTDGQVVTRVLGTTGYLAPEYASTGKLTTKSDVYSYGVVLLELLTGRVPVDTQRPPGEHVLALPRLTNRQKLVQMVDPALKGQFALKDLIQTKAEYRPLMTDVVQSLIPIAKTTPAMSCSSTPLRPALQHVIFMGPQCGDDKASS

SEQ ID NO: 25491 - protein, 299 aa, Streptomyces avermitilis MA-4680
MYDYDLLVVGSANADLVIGVERRPAAGETVLGSDLVVHPGGKGANQAVAAARLGARTALLARVGDDAHGRLLLDSQRRAGVDTVGVLVGGAPTGVALITVDPSGDNSIVVSPGANGRLAPRDVRAADSLLRSAAVVSAQLEIPLESVVEVVRNLAPGTRFVLNPSPPRPLPEEVLAACDPLIVNEHEARVIAGGELDGSPEDWAAALLALGPRSVVVTLGAEGALVASAEGTARVPSVRVDAVDTTGAGDAFTAALAWRLGLGESLVRAAAYAARVGASAVTRSGAQASFPTAEEVAAL

SEQ ID NO: 25492 - protein, 482 aa, Thermotoga sp. RQ2
MKEALTFDDVLLVPQYSEVLPKDVKIDTRLTRQIRINIPLVSAAMDTVTEAALAKALAREGGIGIIHKNLTPDEQARQVSIVKKTENGIIYDPITVTPDMTVKEAIDLMAEYKIGGLPVVDEEGRLVGLLTNRDVRFEKNLSKKIKDLMTPREKLIVAPPDISLEKAKEILHQHRIEKLPLVSKDNKLVGLITIKDIMSVIEHPNAARDEKGRLLVGAAVGTSPETMERVEKLVKAGVDVIVIDTAHGHSRRVIETLEMIKADYPDLPVVAGNVATPEGTEALIKAGADAVKVGVGPGSICTTRVVAGVGVPQLTAVMECSEVARKYDVPIIADGGIRYSGDIVKALAAGAESVMVGSIFAGTEEAPGETILYQGRKYKAYRGMGSLGAMRSGSADRYGQEGENKFVPEGIEGMVPYKGTVKDVVHQLVGGLRSGMGYVGARTIKELQEKAVFVKITPAGVKESHPHDIIITKESPNYWVQA

SEQ ID NO: 25493 - protein, 416 aa, Vibrio campbellii AND4
MSVNFADLGIAQQLVDTLSGMNIVTPTPVQEKSIPHILEGKDLLAAAQTGTGKTAAFGLPIIQSVQQNKRDGAPKALILVPTRELAQQVMDNLIQYSANTNLNIVCVYGGTSIGVQKKKLEEGADILIATPGRLLDHLFNGNVIIAKTGILVLDEADRMLDMGFWPDLQRILRRLPQDKQTMLFSATFEERIKTIAYKLMDTPIEVEVSPANTTAENVKQMVYPVDKKRKRELLAYLIGSRNWQQVLVFTKTKQGSDELVKELKLDGIKAVSINGDKSQGARQRALDDFKEGKVRALIATDVAARGLDIQALEQVVNFDLPFKAEDYVHRIGRTGRAGKSGLAVSLMSHDEEYLLTAIENLLDKRLPQEWLEGFEPSLIEEVEPERNSGGRKSRSSEKRKMKAKLAIHKNRGKKRN

SEQ ID NO: 25494 - protein, 437 aa, Oryza sativa Japonica Group
MMAAAKRPYCKPPPPTTTTTAITSSSGQNHKRLRPSLPAAAAMDGGMEEEAVAPPPPTTMTTTTPPQPLLPGLPDHLAQLCLSPLPPRLLHAVCRPWRRLMYAPSFPPFLSLYALLDDADADAGVSFAAYDPLAGRWDALPSPPMPSPPPMLWHPSFLARRLPLQSVAAAGRLVLVSGSTQSLHPALSRPLVFDPAAPTPRWQLGPRIPLSPRRWCAAGAARGRVFVAGGVGAGYDPAVARSGATWDPAASPPPAAAWEPIPPLRDGRFSRDAAEAVCSGGKVCMVNLRTPGAKEGAVFDLRAGRWEDMPPGMLAGWKGPAAASPPDDGETIYVVDEERGALTAYDWGADRWRTVAESDRLKGAAEMTVAGGKACVVAPGGGKVLIVDVTPPPPPPPAARRESWAAPPPPPRMWEVAAPGGKRVVSLHVLPRMTRPE

SEQ ID NO: 25495 - protein, 517 aa, Triticum aestivum
MSGGSDVSSPSSGRISTSSLSDLKDLDLSSESGCLSIVVLGASGDLAKKKTFPALFNLFQQGFIQSGEVHIFGYARSDMSDDGLRERIRGYLKGASDEHLSQFLQLIKYVSGSYDSGEGFEVLNKTISENETSENNQPGNSRRLFYLALPPSVYPSVCKMIRSYCMTPSSHTGWTRVIVEKPFGKDLDSAEELSAQLGELFDEEQLYRIDHYLGKELVQNLLVLRFANRFFLPLWNRDNIDNVQIVFREDFGTDGRGGYFDQYGIIRDIIQNHLLQVFCLVAMEKPVSLSPEHIRDEKVKVLQSVSCINHDEVVLGQYDGYKDDPTVPNESNTPTFASVVLRVHNERWDGVPFVLKAGKALSSKKAEIRVQFKDAPGDIFRCKKQGRNEFVIRLQPSEAMYMKLTVKKPGLEMATEQSELDLSYGLRYQDVKIPEAYERLILDTIRGDQQHFVRRDELKAAWEIFTPLLHDIDAGRLKALPYQPGTRGPLEADELSKRMGYVPTLGYVWAPPTLAKF

SEQ ID NO: 25496 - protein, 421 aa, Triticum aestivum
HYRTSLYKKAGWYRSGIPGISSTHASENLRFVDLSSNLLTGSLPGCLLAAPGKSVLFSANCLSTAGDDSQSQHPSPFCRNQALAVGIVPEQGHKKSGAKAGVVAGIVLVGALVVSAAVVFVVRKASAPKARPARRLVENASSAYPSNLLADARYISQTVKLGALGIPAYRSFSLVELEAATDNFQVSSLMGQDAHGQMYRGRLSNGTPVTIRSLKVNKSQSFTRHIEMISKLRHRHLVSALGHCFQYNLDDSTVTHLYLVFEYVHNGNLRGRISQGTQGRRLSWGQRISTTIGVAKGIQFLHGGIIPGLFANNLKITNILMDQNQVPKIGSYNIPILSETMKSEMQGGAGSKYPPDRVPNGDKIDMYDFGVILLEVISGRPISSIYEVEIMKEQLQSALTAQGPSQRSNLVDPGRGPARPS

SEQ ID NO: 25497 - protein, 311 aa, Saccharomyces kudriavzevii IFO 1802
MLRTTVRTLRQRAFFHRSFVHVNLPELHSAIQDAQTTCYCQSINARLPSTTDPLDPQIKLPHRTPNYNKHVLLVSPGDKLAQPWKIAWNHNLDTNLNRPYNAIGKLRSYLRNSPGILINAVHLQNEFVPRPKEGDKWLFFFVIPDMKLYKIRETDLEEFASFLDEGVVQAPRLSFQDYLIGKAKVPQETQQVHHKNLTKFQGDIFLRDWSLVCGHYKRDAKCGEMGPDIIAAFQDEKLLTDNNLGLISHVGGHVFAGNVIFYKLFKAENALNKLDSLWFGKVYPHNLKLLCENLENGKIIDEMYRGGISMN

SEQ ID NO: 25498 - protein, 273 aa, Dioscorea alata
MSSSTLFHLFLLSSLLFSCFSNARLDGDDDFSYIEGSPNGPENWGNLRPEWKTCGYGMEQSPINLCDDRVIRTPTLGKLRTSYQAARATVKNNGHDIMVYFKSDAGTQFINQVEYQLKRIHFHSPSEHALSGERYDLEVQMVHESQDQRRAVIAIMFRFGRSDPFLPDLEDFISQISRRETNEVDAGVVDPRQLLQFDDPAYYRYMGSYTAPPCTEDITWTVIKKLGTVSPKQVLMLKQAVNENSMNNARPLQPLKFRTVFFYPRQKSDHVAI

SEQ ID NO: 25499 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 25500 - protein, 137 aa, Thermus thermophilus HB27
MRLRVVAVGRPRLAYARLGVEEYARRMRRYAPLDLVFVRKGEELLPKAEGHRKVVLDERGRLLTTEELYRRLLVWEGERVAFLVGGAEGHPEAVREEADLLLSLSPLTLQHELALLVLMEQLYRVLTLRAGHPYHRP

SEQ ID NO: 25501 - protein, 469 aa, Lactococcus lactis subsp. lactis Il1403
MSSGKITQIIGPVVDVEFGSDAKLPEINNALIVYKDVNGLKTKITLEVALELGDGAVRTIAMESTDGLTRGLEVLDTGKAVSVPVGEATLGRVFNVLGDVIDGGEEFAADAERNPIHKKAPTFDELSTANEVLVTGIKVVDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVQGQDVLLFIDNIFRFTQAGSEVSALLGRMPSAVGYQPTLATEMGQLQERITSTKKGSVTSIQAIYVPADDYTDPAPATAFAHLDATTNLERRLTQMGIYPAVDPLASSSRALTPEIVGEEHYEVAMEVQRVLQRYKELQDIIAILGMDELSDDEKILVGRARRIQFFLSQNFHVAEQFTGQPGSYVPIDKTVHDFKEILEGKYDEVPEDAFRGVGPIEDVLEKAKSMGY

SEQ ID NO: 25502 - protein, 583 aa, Triticum aestivum
  misc_feature (299)..(299): Xaa can be any naturally occurring amino acid
MDTHIGSVDGPSPAAVNGAVGCPASAPGCPIMSSHPVVFAVPGDFNLTLLDHLVDEPGLRLVGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATALRESKPVYLSISCNLPGLPHPTFTRDPVPFFLAPRMSNKMGLEAAVEATVEFLNKAVKPVLVAGPKLRVAKAGKAFVDLVDASGYAYAIMPSAKGFVPETHPHFLGTYWGAVSTAFCAEIVESADAXYLFAGPIFNDYSSVGYSFLLKKDKAIIVQPERVIVGNGPAFGCVMMKEYLSALAKRVQKNNTAYENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 25503 - protein, 607 aa, Physcomitrella patens subsp. patens
ELASGLDVINNLGLDTLTFLGATVLIVPAFKAIKQSPILGFLLAGVVLNQLELIRSVTDVKALAELGILFLLFEMGLELSLARLKALAKFAFGIGLAQVVLSTLAFTAFELPPNKAIGTQILEFLFHARPDLVNIRTVDEAVVIGAALSLSSSAFVLQLLAEKGELPTRFGSATLGILLLQDIAVVPLLVILPILETGNIADSNLWPVLASESLKALLGLGLISLGGRIFLRRLFEIVANSRSAEAFVAMCLLTVTGTSLLTQKLGFSDTLGAFLAGALLAETNYRTQVEADIRPFRGLLLGLFFVTTGTSIDIQLLVREWPNVLALLGGLIAIKTAIITAIGPRVGLTLSESVRTGLLLSQGGEFAFVVFSLANRLGVLPLELNRLLIIVVVLSMALTPLLNEVGRKLAEYIEREFEDSSPTESGVKNFQAKEPVVIIGFGQMGQVLANFLSTPLATGLGGDAAGWPYVAFDLDPGRVKAACKLGFPVLYGDGSRPAVLQTAGIAQPKAVMVMYTGRQKSVQSVERLRQAFPQVPIYARAQDLQHLLELKHAGITDCILENAETSLQLGSVLLRGLGVMSDDVRFLRRMMRESMELRAQETVEKKE

SEQ ID NO: 25504 - protein, 193 aa, Brassica napus
MTLESYNGDVHTVPQSENSPIETEKEREIFVPPLNFAMVDNGIFRSGFPEPVSFSFLQSLRLRSIIYLCPEPYPEVNVEFAKSNAIQVFQFGIERCKEPFVNIPDQVIREALQVLLDTENHPVLIHCKSGKHRTGCLVGCVRKIQRWCLSSIFDEYQRFAASKARISDQRFMELFDISNLRHSPLSFSCSNRC

SEQ ID NO: 25505 - protein, 348 aa, Thermus thermophilus HB27
MKGLILAAGRGTRLRPLTHTRPKPAIRVAGRPIIHYAVENLLEAGVREIGVVVSPETERDLKVALEGYPVRYVLQEEPQGLAHAVDVARDFLGESPFVLYLGDNLFQKGIRRFLEAFKPGVSAVIALVRVEDPRQFGVAVLEGNRVVRLLEKPKDPPSDLAVAGVYVFSPEVLEVVRGLKPSARGEYEITDAIQGLIDRGKTVVGVEVEGWWKDTGRHQDLLDANRLLLEELTPKVEGDVVESQLTGRVVVEKGAKVVRSTVIGPAHIGAGAVVEEAFVGPFTSVGPRARVVRSEVEYSLLEEEAVVEEVRLRLQECILGVRAEVKSRDGLPRAHRLILGDLSQVELA

SEQ ID NO: 25506 - protein, 460 aa, Frankia sp. CcI3
MANSAAGPVDLVILGGGSGGYAAALRAAELDLSVVLIEKDKLGGTCLHRGCIPTKALLHSAEIVDNINESEAFGVRSTLDGIDMAAVNSYKDSVIAGLFKGLTGLIKSRGIEVVEGFGRLVSPTAVAVGDRVIEGRHVLLATGSYSKTLPGLDIDHDKVITSDDALTLDHVPASAVVLGAGAIGCEFASVWRSYGAEVTIVEALPHLVPLEDESSSKLLERAFRKRGIKQHLGARFSGVKSTDQGVTVSLENGTTIEAELLLVAVGRGPVSEGLGYEEVGIATDRGYVLVDRQLRTNIPTVSALGDLRPGLQLAHVGFAEGIFVAEQLAGLGPVPVDYDNVPRVTYSHPEVASVGLTAAVARERYGEIKTVTYNLAGNGKSQILRTSGAVTVIAVPDGPVVGVHMVGDRVGELIAEAQLITNWEAFPAEVAQLIHPHPTLSEALGEAHLALAGKPLHVHG

SEQ ID NO: 25507 - protein, 487 aa, Frankia sp. CcI3
MSVSVTMPRLGESVSEGTVTRWLKQEGERVEADEPLLEVSTDKVDTEIPAPASGVVSSIKVAEDETVEVGVELAVIDDGSAGGGTAPAQATQAPAAPEPEPEPAPEPVKPAAAAPPPPPTPTPAPAPTPAPAPTPAPAPTPAPAPAFARQPELTPVPAQTPAAANGNGGGIGRYVTPLVRKMAAELGVDLGTVAGTGPGGRVTKQDIQDAARPRDAAPAAQETPATPPTAPTAPAVAPTVAPTGAAPVRGQTEKLSRLRALVARRMVESLQISAQLTTVVEADVTRIARLRDRAKSGFQAREGIKLSFLPFFALATCAALREFPQLNSSIDVEAGTVTYHGEENLGIAVDSERGLVVPVIHNAGDLNLIGLARKIDDLASRTRANRISPDELGGGTFTLTNTGSRGALFDTPIINQPQVGILGTGIVTKKPAVVDDPELGEIIAVRSTVYLSLTYDHRIVDGADAARFLAFTKHRLENGAFEAELGL

SEQ ID NO: 25508 - protein, 468 aa, Escherichia coli
MSKQQIGVVGMAVMGRNLALNIESRGYTVSIFNRPREKTEEVIAENPGKKLVPYYTVKEFVESLETPRRILLMVKAGAGTDAAIDSLRPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEFNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 25509 - protein, 434 aa, Bacillus cereus ATCC 14579
MSRLLMNENEKWNKFIETPLYTKVGKVHSVQEQFFVAKGPKAKIGDVCFVGEHNVLCEVIAIEKENNMLLPFEQTEKVCYGDSVTLVSEDVVVPRGNHLLGKVLSANGEVLNEEAENIPLQKIKLDAPPIHAFEREEITDVFETGIKSIDSMLTIGIGQKIGIFAGSGVGKSTLLGMIAKNAKADINVISLVGERGREVKDFIRKELGEEGMRKSVVVVATSDESHLMQLRAAKLATSIAEYFRDQGNNVLLMMDSVTRFADARRSVDIAVKELPIGGKTLLMESYMKKLLERSGKTQKGSITGIYTVLVDGDDLNGPVPDLARGILDGHIVLKRELATLSHYPAISVLDSVSRIMEEIVSPHHWQLANEMRKILSIYKENELYFKLGTIQENEENAYIFECKNKVEGINTFLKQGRSDSFQFDDIVEAIQHIV

SEQ ID NO: 25510 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFLDTIRRNRELSAEGFNFIGTGVSGGEGGALKGPSIMPGGQKEAYELVAPILTKIAAVAEDGEPCVTYIGADGAGHYVEMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 25511 - protein, 490 aa, Bacillus subtilis subsp. subtilis str. 168
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 25512 - protein, 398 aa, Clostridium difficile 630
MEDLTRYRNEIDNIDKELIQLFEKRMNTVLEIARHKMKNNTTILQKDREEKVLSRAVDNLDNKAYSQETVQFFNSIMEISRGLQKRLIDNDGEQKIEFGLDSSNKNFDLSNVNKYKSLKDELNKKNILVGFPGKSGSFTEEALNKFFNKKISKKQFKEFEDVFIALKNKEINYGIIPIENSSTGAISETYDLLRKYGFYIVGEECIKIDQNLIGIKDTKLEDIKEIYSHPQGIGQCSEFLKQNSTWKLIPFNNTATSAELVRKLQDKTKAAIASKKAASIYGLEIISPCINDIANNYTRFVVISNQIHIEEESNKMSVVFSVEHEAGKLYKVLGYFAKNNINMTKIESRPMKNASWRYFFYIDFECSIYNAKVYDLLELIEHNTAYFKFMGVYKNKTE

SEQ ID NO: 25513 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFLDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 25514 - protein, 278 aa, Ostreococcus tauri
MSTVSRAVRFRPCIDIHNGKVKQIVGSTLRDGTRPGDAASETPATNFETEIPSTAYAEMYKRDGIYGGHAILLSKDEATTRAAMEATRAFPGGLQIGGGVNPSNAKQFLDAGASHVIVTSYVFRDGMLNEDALSEMVRAVGPDKLVLDLSCRLDASDGQYKVVTDRWQKWTDLAVDSATLERLAKCCDEFLVHGVDVEGMKLGIDLKLVELLGAFCPIPVTYAGGARSLEDLELVKASGRGVVDITVGSALDCFGGALKYDDVVAWHNAQKELVVEQK

SEQ ID NO: 25515 - protein, 256 aa, Monilinia fructigena
AYMLKYDSTHGQFKGDVKVLPDGLEVNGKKVKFYTERDPANIPWAESEAYYVVESTGVFTTTEKAKAHLKGGAKKVVISAPSADAPMYVMGVNNETYTGDADVISNASCTTNCLAPLAKVINDEFTIIEGLMTTIHSYTATQKTVDGPSAKDWRGGRTAAQNIIPSSTGAAKAVGKVIPELNGKLTGMAMRVPTANVSVVDLTCRIEKGATYEEIKAVVKKAAEGPLKGILGYTEDDVVSTDLNGDNHSSIFDAKA

SEQ ID NO: 25516 - protein, 572 aa, Ostreococcus tauri
MTTDDMITATVTERTPVGMKHWKFHDVPSTMGKSDEEAMAAYASHAFRASATTESETEALTSCYSRDGMLFACANADKVDVYDASVEPHALKGTMMLRGATALSFSPGQKYLSIYQKQTATGAAKDEKNLTVWNVKEMCSGTAPSKVYEVFQRQFLKAEWPYFQFSEDDSTAVRCVSNEIQIIRPDAGFEKHVRLRVPSVAVAKISPGPTPRVACFVPEVKGAPGSVRIYELAQHTEEGVIENPTPVARKSFFRVTEVDLMWAPDGSAVLILGSSEVDATNKSYYGESCLHYLKADGSFEGAVPLSKEGPVHDAQWSPCSDEFGVVYGYMPAKATIYKAAKCEPKYELGAGPHNTLRWNPFGRFIALAGFGNLPGDIKFFQKMKDGKYKPVGSTRAACSVTLEWSPDGRRLLTSTVAPRLNVDNGWKIWRYNGDLLLHEERAKIYEAFWRPVPKGTFQDRPISPASKRVETASQQASTAKPAGAYKPPHAAKTAYRPPHATSGSGNFSLAKASEEEMKAGKYKPAGAATKSVEDSGPPGAGGQLSVAAAKNAKKRAAKKRAAAAAKEIEQKL

SEQ ID NO: 25517 - protein, 714 aa, Salmonella enterica subsp. enterica serovar Typhi str. CT18
MSRIIMLIPTGTSVGLTSVSLGVIRAMERKGVRLSVFKPIAQPRAGGDAPDQTTTIVRANSTLPAAEPLKMSHVESLLSSNQKDVLMEEIIANYHANTKDAEVVLVEGLVPTRKHQFAQSLNYEIAKTLNAEIVFVMSQGTDTPEQLNERIELTRSSFGGAKNTNITGVIINKLNAPVDEQGRTRPDLSEIFDDSSKAQVIKIDPAKLQESSPLPVLGAVPWSFDLIATRAIDMARHLNATIINEGDIKTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYVNADWIESLTATSERSRRLSPPAFRYQLTELARKAGKRVVLPEGDEPRTVKAAAICAERGIATCVLLGNPDEINRVAASQGVELGAGIEIVDPEVVRESYVARLVELRKSKGMTEPVAREQLEDNVVLGTLMLEQDEVDGLVSGAVHTTANTIRPPLQLIKTAPGSSLVSSVFFMLLPEQVYVYGDCAINPDPTAEQLAEIAIQSADSAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQASQQQQ

SEQ ID NO: 25518 - protein, 98 aa, Allium cepa
RITGCPNGCARPYMAELGFVGDGPNSYQIWLGGTPNQSTLAKCFMNKVKIQKFESVLEPLFNDWKVNRKTEESFGEFTNRIGFEKLLEVVEQWDSSKN

SEQ ID NO: 25519 - protein, 256 aa, Sclerotinia sclerotiorum
AYMLKYDSTHGQFKGDIKVLSDGLEVNGKKVKFYTERDPANIPWAESEAYYVLESTGVFTTTEKAKAHLKGGAKKVVISAPSADAPMYVMGVNNETYNGEADVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKAASYDEIKEVIKKAANGPLKGILAYTEDDVVSTDMNGDNHSSIFDAKA

SEQ ID NO: 25520 - protein, 444 aa, Bordetella bronchiseptica
MRQYHYITEMMRVALQDLSTLRIKGRVVQVVGTIIKAVVPMVKIGEVCLLRNPGEDFEMHGEVVGFVRDAALLTPIGDMYGISSATEVIPTGRTHMVPVGPGLLGRVLDGLGRPLDVAESGPLHAHKFYPVFADAPDPLTRRIIHAPLELGVRVLDGLLTCGEGQRLGIFAAAGGGKSTLLGMLVKGAAVDVTVVALIGERGREVREFLEHELGPEGRRKSVIVCATSDKSSMERAKAAYVATAIAEYFRDQGQRVLFRMDSVTRFARAQREIGLAAGDPPTRRGYPPSVFATLPKLMERAGMNQTGSITALYTVLVEGDDMNEPVADETRSILDGHIVLSRKLGAANHYPAVDVLASASRVMNAVVSPRHKYLAGRMRELMAKYQDVELLVKIGEYKQGADASTDEAIQKIGQINAFLRQLTDEREAFEDTVLRMAEIIGPES

SEQ ID NO: 25521 - protein, 475 aa, Photobacterium sp. SKA34
MFKQQAFINGQWSDAFSGKTANITNPATNEVIGHVPLMGVEETNIAIDAADKAYRLWSKTTAKHRSMILRQWYELIVSHSDELANILTAEQGKPLAEAKGEIAYAASFVEWYAEEAKRLNGEIIPSHKEDARILVSRQPVGVVAAITPWNFPAAMITRKCGPAFAAGCSVVLKPAPDTPYTAFALAELAHRAGIPAGLFNVITGDAVKIGAELMSNKRVRKVSFTGSTAIGKLLMAQSAATVKKVSLELGGNAPFIVFNDADLSRAIDGVMVSKFRNAGQTCVCTNRIYVHSDVYQQFVEKLAEKVSALTVGNGVDNGVTIGPLINRAAVEKVEKHINDAMMKGANLVIGTRKPSISCFVQPTVLSDVTDNMLVANEETFGPLSAVFKFTDEQDVITRANNTDSGLAAYVYTQSLSRVFRVSEALEYGMVGVNEGLISTELAPFGGIKESGIGREGAHQGLEEYTEMKYTLMGGL

SEQ ID NO: 25522 - protein, 317 aa, Salmonella enterica subsp. enterica serovar Typhi str. CT18
MIKLAPAGLKDDIEMRKVYAGFVAGQIEAGSPIIALEADLMSSMAMDSVARDYPQHVINCGIMEANVIGTAAGLALTGRKPFVHTFTAFASRRCFDQLFMALDYQRNNVKVIASDAGVTACHNGGTHMSFEDMGIVRGLAHSVVLEVTDAVMFANILRQLMDLDGFYWLRTIRKQATSIYAPGSTFTIGKGNVLREGDDITLIANGIMVAEALEAARQLEQEGVSAAVIDMFTLKPIDRMLVKNYAEKTRRIVTCENHSIHNGLGSAVAEVLVENCPVPMRRVGVKERYGQVGTQDFLQQEYGLTAAAIVEAAKSLL

SEQ ID NO: 25523 - protein, 828 aa, Ustilago maydis 521
MASHSSSAHGATAEAARVPSLSAPSQYRPMSSFSLSSSFSSSISSYASSDIRDRPDTPPQASKSNGGLRLPRFSLWGRNTSSTLISNSNNSSAPSSNTEPDLTQLRISQRRPESPKSPSRDRSRQAASESELPSRPSSPTSVSPMPTLAVNAPLNAPPISLPKLSSVWRMSAGLFTSSSYPANSHDPRLARPHTAESTTPRDFINASPASQFAAWSDFMHSPTPPDRTATFSSNSSASCNSCSRPNMKKIRSQESIRSSTSAVPFDAENSTSSHHSTIPVPKVIKVKLRSKSKANQEPEFDNVFLAQELRCSSTSSAPGSSLNRKVSQARSPSLALEDLPANRGAESRRKRSSWAARRPTSPQTFLDRHYANHPNNAVRSSDDREDDESLYIRPPKVNRQFSTSSYLTTASSTTTSSSNAGEAVAPRSPRMPSEVDEAGRVKRTKSTMPKRKTYALQFSLDGRYLAAAGSDHLIRVYEVISSPADRADEIELAQMHRAEQAWQKKMSSACPQGPQGVCGSMRSNTKMDVRAATPELVPVFKSTPIHIFQGHAGDVLDLSWSKNNFLLSSSTDKTAKLWHPNRSECLCTFSTSATVSSVDFHPTDDRFFVSGGLDGKLRLWNIAARRVQSINDVPGVITAVAFSSSGSSVCVGTHSGSMLTFSCTDSLTFVNAVTVKSAAASKTALASKITSIQPIKLDVTATTDSAAPPSAREYMTVTSNDSRIRIYSIVSRRIVSRFKSTSYINRSSQIRATSSSDSQFLVSGSEDAWIHVWSLASNASLFAALFAGMKRNKSTLRSPAQARASDAGDNSTYRSWQAGAGSHTTPWS

SEQ ID NO: 25524 - protein, 1328 aa, Ostreococcus tauri
MASDATARDGALASFVDHLDRDARARGVPPKVEVRLNDFACTLELDAKKASREIRTVPKVFADAIVSPMRALASAVRGSEDGAKAKTKLEVLRGCGGTFQPGSLTLVLAPPGHGKTTLLKSIAGVNPIASTGSITYSGLTKDELEASGTSLQRLCEYVTQLDEHLPYLTVDETVRFSHENACVVPNGEGKKSHDEKVDKVIELLSLESCRDTIIGNDLIRGVSGGEKRRVTIAEALVKNAQVLCMDEISTGLDAAVTYNIIAGLKQWATRTQGTCIVALLQPTPEVVSLFDEVLLLKEGAPVYHGPIDQVKSYFSGLGFTPPSEKGADLADWLISLLVSPREVLKNVGTKITPEIPTTVDAMVTSWRQSPAYDVKMKSTCTPTDIELKSPFAKSQYSLSYPRSFADHFKSVFVRQYKVTRRNTLFLNARIFGACVTSLILGSVWFDLPLERGFENSACSFSLTFSVEQKYVAFKHLDSKLFPELTYLASWAMVHLPIAIVETLIFSCVLYPMVGLNLAFRNWAFFYLQLVLVNVAMASFFRVIALLAPNMEIAQTYPGPFIAVMILFAGFLISPDKMGGLKFMYWISIFAYCLRSLCQNEFLSSSYDTLVPVDTVAAASFITSNPSYESTSMNDLCTQGLSGFPACGNMGEIILDTIGITSDTSYKWAGPGFCVGFFGLTFLIGLRTLYTVRIQRNIGSSRIEEKAENEDAVIHMGIDVTAAQKAMEFTPMAISWKNLCYTVQVAAATPQSGDKSEDKPDGDKKYNKREKTVSKQLLHNITSAAQPGRMLALMGSSGAGKTTLLDVIAGRKNTGVTTGEVKLNGHEVQKETMIGTAGSDTGLAPGQRKVLTVAVELVSNAPVFFLDEPTSGLDARSALIVMKEVKKVAALGRTVISTIHQPSTEIFMMFDDMLLLQRGGYQVYFGELGQEGSSMVNYLQSLNMSIPLPAGMNPASWMLDVLGGSDSSGTANKSDKQAIINGKGNMRRSSSGIALDGMMLDKKFLESSEGKKAMTLVNEISERGANDPMFSFSSPYARSFKTQLSAILVRTNNAQLRDIGYNCGRIGILTVLYILFGVIYLDLDTSDEAGVQSMVACVFMTTIFTGIICMNSVMPVRVRERAVAFRERSSFMYDAVPFSLAQALIEVPWLIVVSLCTVIPMYFLVGMIPTAERLFFHILINFMVSFTFLSFGQAVACLCSTIETAQAGTSAFIPICFLFGGLYLPLPQIPVYWQWAYYINPVSYSIQAVVAPQFERRGCTGPYPGGNCPTIQAFRGTYFEKIDTLSYVEQKYDIKFSERWIACGYLGIFMFGMQFLHSFFFKTSNVVKR

SEQ ID NO: 25525 - protein, 207 aa, Borrelia burgdorferi B31
MMAKIIGISGGSGSGKTTVVSKISEFIPEFVLISQDNYYKSVGDYEHEFSKVNFDHPDAFDNNLFYEHLKNLKKNSPIDMPLYDFINHKRQLKTVLVVPTPVVIVEGIMIFVEERVRNLIDLKIYIDTPNDIRFIRRLRRDISKRGRTVESVIDQYLNTTRWGYYRFIEPTKEYADLIIPEGGHNDKALYVLSTFLKSLSKEGLDFT

SEQ ID NO: 25526 - protein, 153 aa, Glycine max
MAAPSSLASSHLSRLAAAAPAPQHHHQNHQLRLGCSRRRAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDE

SEQ ID NO: 25527 - protein, 363 aa, Aspergillus nidulans FGSC A4
MFAARNFATPARQCLRSTRVAPNLASTRLQGKYTVTLIEGDGIGPEISQSVKDIFSAANAPIKWESVDVTPILKDGKTAIPDAAIDSVRKNYVALKGPLATPVGKGHVSLNLTLRRTFNLFANLRPCRSVAGYKTPYDNVDTVLIRENTEGEYSGIEHVVVDGVVQSIKLITREASERVLRFAFQYARSINKKKVRVVHKATIMKMSDGLFLNTAREVAKDFPDVEFDAELLDNSCLKITTDPTPYNDKVLVMPNLYGDILSDMCAGLIGGLGLTPSGNIGDECSIFEAVHGSAPDIAGKGLANPTALLLSSIMMLQHMGLNEHASRIQKAIFDTLAEGKTLTGDLGGKAKTHEYADAIIKRL

SEQ ID NO: 25528 - protein, 347 aa, Streptomyces avermitilis MA-4680
MRAVVFERFGEPAEVREVADPEPSEHGVVVRVEATGLCRSDWHGWVGHDPDITLPHVPGHELAGVVEAVGTRVSGWRPGDRVTVPFVCACGSCAACAAGDQQVCERQAQPGFTHWGSFAQYVALEHADVNLVAMPDELSFGTAAALGCRFATAFRAVVAQGRVAAGEWVAVHGCGGVGLSAVMIAAASGARVVAVDVSPQALDLARKFGAAASVDASRVEDTAAAVRELTGGGAHLSLDALGSPVTCVASVNGLRRRGRHVQVGLLPSSTGSTPVPMARVIGLELEVLGSHGMAAHAYPPMLELVRAGVLRPDLLVTSAIPLDTAPIALAAMGTAPGAGVTVIEPWR

SEQ ID NO: 25529 - protein, 137 aa, Mycobacterium smegmatis str. MC2 155
MTRTRRSDATARRYYHFRRMLFSLHQNASAQGSSMTAEPVPTAEPGGKVTILFERERVSVPRRPNETLLESARRAGMTPPFSCEAGNCGTCMAKLLEGTATMRVNDALDDDEVAEGYVLTCQAVPDCDTVTVSYDDD

SEQ ID NO: 25530 - protein, 142 aa, Triticum aestivum
  misc_feature (87)..(87): Xaa can be any naturally occurring amino acid
  misc_feature (92)..(92): Xaa can be any naturally occurring amino acid
  misc_feature (104)..(104): Xaa can be any naturally occurring amino acid
  misc_feature (122)..(122): Xaa can be any naturally occurring amino acid
  misc_feature (125)..(125): Xaa can be any naturally occurring amino acid
  misc_feature (134)..(134): Xaa can be any naturally occurring amino acid
  misc_feature (141)..(141): Xaa can be any naturally occurring amino acid
MAPAVMASSATTVAPFQGLKSTAGLPVGRRSSGSLSSVSNGGRIRCMQVWPIEGIKNSETLSYLPPLSTGGLPGNRSDYLDSAQKWXPCLRXNKVGSSPVEHNXSPRGTNDGRYWDMLELPXFRXTGPTQVLNXVEESKKXT

SEQ ID NO: 25531 - protein, 392 aa, Mycobacterium sp. MCS
MRAVTWQGRRKVSVDNVPDPIIKEPTDAVIRVTSTNICGSDLHLYETLSAFMSPGDIIGHEAMGVVEEVGTQTGDLKVGDRVVIPFNISCGTCWMCDHGLQSQCETTQNRDQGTGAALFGFSKLYGEVAGGQAEYLRVPQAQYTHIKIPEDGPDERFVYLSDVLPTAWQGVEYANVPDGGTLVVVGLGPIGSMACRIAAHRNNCRVIGIDLVEERLDRARPYCAEVIDLRTQDADAVVAELTQGRGADSVIDAVGMEAHGSPVAEAAQTASGFLPSSIGRVVMKHAGVDRLAALNSAIALVRRGGTVSLSGVYGGAADPINMMTLFDKQVTLRMGQANVKRWVPDILPLLTADDPLGVENFATHRLPLAEAPGAYETFQKKQDGMVKVVLTP

SEQ ID NO: 25532 - protein, 484 aa, Escherichia coli
MSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 25533 - protein, 481 aa, Escherichia coli
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 25534 - protein, 448 aa, Escherichia coli
MEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 25535 - protein, 559 aa, Sulfitobacter sp. EE-36
MRADMNAAAGQVYVRYHRTHMTKFSDLNLNPKVLKAIDEAGYETPTPIQAGAIPPALEGKDVLGIAQTGTGKTASFTLPMITLLARGRARARMPRSLVLCPTRELAAQVAENFDTYTKHLKLTKALLIGGVSFGEQDKLIDKGVDVLIATPGRLIDHFERGKLILSDVKIMVVDEADRMLDMGFIPDIERIFQMTPFTRQTLFFSATMAPEIERITNTFLSAPERIEVARQATTSENIEQGVLMFKASRKDREATEKRKVLRALIDAEGDKCTNAIIFCNRKMDVDTVAKSLKKYGYDAAPIHGDLDQSQRTKTLEGFRNGDLRFLVASDVAARGLDVPSVSHVYNYDVPSHAEDYVHRIGRTGRAGRDGKAIMICVPRDEKNLEDVERLVQREIPRLDNPLGGSEAKAAPAAEAKTADAPAAKSDDAAKSEKPKRTRTRSRKKPDAAKVDAEQTETAQADSPKADKSDAKADAKSDAKPQDKKSDKPAKESADKAPAQKADAAQDDKPNNRRGGRGGRGDNNRGDNNRQQNNRNDNRVVGLGDHTPEFIGLSFAERRE

SEQ ID NO: 25536 - protein, 607 aa, Glycine max
  misc_feature (382)..(382): Xaa can be any naturally occurring amino acid
MDSKTSSRALPKHHQKTAGIQTLEAKDTGSSLQKGEKTELAAPVDLSMYAANASKQNTGETAEIKKLGGLTLKGSADSMSIKSGSGASSSVLDKVVHAANENIGSQESSIDLDKKTSEDGSVKNSSVSAKVSDGASSLAKTSGSAKISNRADFVESGKSSICRGSTSSDVSDESTCSSFSSTINKPHKANDLRWEAIQAVRSRDGVLGLGHFRLLKRLGCGDIGSVYLSELSGTKCYFAMKVMDKGSLASRKKLLRAQTEREILQSLDHPFLPTLYTHFETEKFSCLVMEFCPGGDLHTLRQKQPGKHFPEQAVKFYVAEVLLALEYLHMLGIVYRDLKPENVLVRDDGHIMLSDFDLSLRCAVSPTLVKTSSTDSEPLRKXAYCVQPACIEPPSCIQPSCVAPTTCFSPRLFSSKSKKDRKPKTEIGNQVSPLPELIAEPTDARSMSFVGTHEYLAPEIIKGEGHGSAVDWWTFGIFLYELLFGKTPFKGSGNRATLFNVVGQPLRFPEAPVVSFAARDLIRGLLVKEPQHRLAYKRGATEIKQHPFFEGVNWALIRCATPPEIPKAVEFEKIPSPASSSGGEKAANHISIANQKGSDNYLEFDFF

SEQ ID NO: 25537 - protein, 636 aa, Pseudomonas fluorescens PfO-1
MIRLQNLTLQRGPQRLLEDAELTLHAGHKAGLIGANGAGKSSLFALLRGELHPDSGDCLLPADWRIAHMRQEVDTLERLAVDYVLDGDLRLREVQRELAAAEEAHDGTALARLHAELDSADGYTADARARKLLAGLGFTNEQMDRQVGDFSGGWRMRLNLAQALMCPSDLLLLDEPTNHLDLDAIIWLEEWLKSYPGTLLLISHDRDFLDEVVDHVAHVDQRKLTLYRGGYTAFERARAERLAQQQQAYEKQQAQRAHMESYIARFKAQATKARQAQSRIKALERMEELSAAHVDSPFDFVFRESTKISSPLIDLSDARLGYGEKTVLEKVKLQLTPGARIGLLGPNGAGKSTLIKNLAGELSPLAGRLTRGENTVVGYFAQHQLDSLDSKASPLLHLQRLAPTEREQTLRDFLGGFDFRGARIDEPVLNFSGGEKARLALALIAWERPNLLLLDEPTNHLDLEMRLALTMALQEFSGAVLVVSHDRHLLKSTTDNFFLVADSKVEEFDGDLEDYARWLVEYRQRNAPVSNTPVNPDKTDKKAQRQAAAALRQQLAPHKREADKLEAELGKLHEKLAKVDASLGDSDLYEPARKNELRDLLAEQAKLKVREGELEEAWMQALETLESMQAELEALS

SEQ ID NO: 25538 - protein, 393 aa, Spinacia oleracea
MASASLLKTSPVLDNPEFLKGQTLRIPSVAGVRFTPSGSSSLTVRASSYADELVKTAKTVASPGRGILAMDESNATCGKRLASIGLENTEANRQAYRTLLISAPGLGQYVSGAILFEETLYQSTTDGKKMVDVLIEQGIVPGIKVDKGWLPLPGSNDESWCQGLDGLACRSAAYYQQGARFAKWRTVVSIPNGPSALAVKEAAWGLARYAAITQDNGLDPILEPEIMLDGEHGIDRTFRVAQQVWAEVFFNLAENNVLLRDPLKPSMVGPGALSARKGPPEQVADYPLKLLHRRRGPVVPGIMVLSGGQSEVEATLNLNAMNQSPNPWHVSFSYARALQNTCLKTWVEGQENVKAQDFACAKSNSLAQLGKYTGEGESEERKKDMFVKATLTY

SEQ ID NO: 25539 - protein, 812 aa, Ostreococcus tauri
MTDRRPVALEEGWGRMQDGIMKLRRILDTDDAEPFTSEEYMNLYTYVSKSAGRPEIHDTSDDDIPYSDSHFSLNTLVDYFSALSDASSGFWLQLRSAALRVTSSFNLCTRSTIYNMCTQKAPYDFSEQLYERYEAAFNQYINAKVLPTLVEKKGEYMLKSLVMRWENHKIMVRWLSKFFNYLDRYYVQRHHFPPLKDVGVNCFRRLVYDEIKLSVKTAVLELIDKEREGEKTDRTLIKNITSIFVEMGLGTMDAYQNDFEADLLAHTASFYSRKALQWIAEDSCPAYLIKAEECLNSERERVQLYLHQTTESKLISKVEQQLLEQYENELLEKENSGCAALLVEDKTEDLARMYRLFRAVPSGLKPIAEIFKAHVKKDGMNLVSVAEQTASNMKSKKPDKDAASTSVEQVFTRSAIELYDKYSTYVNECFDSSALFNRALTEAFENFCNKGIAGNSTAQLLADFSDKLLRKGGSEKLSDEKMEETLEKVVKLLAFISDKDMFGEFYRKKLARRLLTDSSASQDYERSILSKLKTQCGAQFTGKMEGMLNDLQSARETQDTFERWMEEDAANRKPPLDFSVTILTHGFWPQHKPVEFQLNDELAKCVDTFRSFYDKRMGQRKLTWIHHLGTATVVGKFETKSIEMLMQTTQCAVLLLFGAKTELTMQNVIDLTKLPPDDAKRALYSLSCAKYKILNKSPEGKTIGPDDVFAFNEKFTDRSRRIKIGLPPVDEKKVTIEHVEHDRRHAIDAAIVRTMKARKSLAYNQLIIEVVSQLKQKFVPEPKQIKIRVEELINKEFIERDKENPQVFKYMA

SEQ ID NO: 25540 - protein, 376 aa, Shewanella oneidensis MR-1
MTAQILKSKAAVAWAVGEPLSIEIVDVMPPQKGEVRVKMIATGVCHTDAFTLSGDDPEGIFPCILGHEGGGIVESIGEGVTSVQVGDHVIPLYTPECGECKFCKSGKTNLCQKIRETQGKGLMPDGTSRFSKDGQIIYHYMGTSTFSEYTVLPEISLAKVNPDAPLEEVCLLGCGVTTGMGAVMNTAKVEEGATVAIFGMGGIGLSAVIGATMAKASRIIVIDINESKFELAGKLGATDFINPKDYDKPIQDVIVELTDGGVDYSFECIGNVNVMRSALECCHKGWGESVVIGVAGAGQEISTRPFQLVTGRVWKGSAFGGVKGRSELPEYVERYLAGEFKLSDFITHTMSLEQVNDAFDLMHQGKSIRTVIHFDK

SEQ ID NO: 25541 - protein, 316 aa, Streptomyces avermitilis MA-4680
MAYDLITMGRIGVDLYPLQTGVPLPQVTSFGKFLGGSATNVAVAAARLGRSTAVVTRTGDDPFGTYIHEALRGFGVDDRWVTQVAGLPTPVTFCEIFPPDDFPLYFYRQPKAPDLEIDAHELDLDEIRAARIFWMTGTGLSEEPSRTATLAALAHRAKSGTTVFDLDWRPMFWADPAQARPFYTEALRHTTVAVGNVDEVEIATGERDPHSAARALLAAGVELAVVKQGPKGVLAVHRDGTTAEVPPLPVKVLNGLGAGDAFGGSLCHGLLDGWDLERLMRYANAAGAIVASRLECSSAMPTPAEVEDALTAGAVL

SEQ ID NO: 25542 - protein, 202 aa, Zea mays
MLSLYSSSTIKASFHSSFPPLRSSPPPLSVGSHIRLVKRDHSVAAASGGVSMSTNRDSHGSSSQVAEPFFRSVLGQMETDYLNRNPTPRSVLELVRSVDDEQLCYDHLAFRTFGIGGYGIDSLASFFLDYGYTQMDELRFPAKKLRALWFAPPHASAVPGGSGVDGPLPRVFISQLLVEQMSTQTQDVIRRYTETNTNGRKY

SEQ ID NO: 25543 - protein, 638 aa, Haemophilus influenzae R2846
MIIFSNLSLKRGQTELLENASATINPKQKVGLVGKNGCGKSSLFALLKKELTPEGGEVNYPSNWRVSWVNQETPALDISAINYVIQGDREYCRLQQELEQANERNDGNAIARIHGQLEMLDAWTIQSRAASLLHGLGFSQEETTQPVKAFSGGWRMRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFEFRPPQSLPNPLVMIEQASAGYGCGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHDKKVEEFKGDLEDYQKWLNEQNSTSENKVSEKVGDNENSVQNRKEQKRREAELRQQTAPLRKKITQLEEKMNKFSSELANIENQLADAELYNAENKEKLTALLAQQVDVKKALDDVETEWMTAQEELEEMLQA

SEQ ID NO: 25544 - protein, 500 aa, Streptomyces avermitilis MA-4680
MTKIVNHWIGGKTVEGASGTYGPVTDPATGAVTTKVAFATVDEVDAAVAAAKDAYATWGQSSLAKRSTILFKFRALLDANRDAIAELITAEHGKVHSDALGEVARGLEIVDLACGITVQLKGELSTEVASRVDVSSIRQPLGVVAGITPFNFPAMVPMWMFPLAIACGNTFVLKPSEKDPSAALKLAELLAEAGLPDGVFNVVHGDKVAVDRLLEHPDVKAVSFVGSTPIARYIHTTASAKGKRVQALGGAKNHMLVLPDADLDAAADAAVSAAYGSAGERCMAISAVVAVGAIGDELVEKIRERAEKIKIGPGNDPASEMGPLITKAHRDKVASYVAGAAAQGSEVVLDGTGHTVDGFEDGHWIGLSLLDKVPTSADAYRDEIFGPVLCVLRVDSYEEGLALINDSPFGNGTAIFTRDGGAARRFQLEVEAGMVGVNVPIPVPVGYHSFGGWKDSLFGDHHIYGNDGTHFYTRGKVVTTRWPDPSEAPAGVDLGFPRNH

SEQ ID NO: 25545 - protein, 535 aa, Staphylococcus epidermidis ATCC 12228
MLQVTDVSLRFGDRKLFEDVNIKFTEGNCYGLIGANGAGKSTFLKILSGEIDSQTGHVSLGKDERLAVLKQDHFAYEDERVLDVVIKGHERLYQVMKEKDEIYMKPDFSDEDGIRAAELEGEFAEMNGWNAEADAANLLSGLGIEPDLHDKNMSELENNQKVKVLLAQSLFGDPDVLLLDEPTNGLDIPAISWLEDFLINFENTVIVVSHDRHFLNNVCTHIADLDFGKIKLYVGNYDFWYQSSQLAQKMAQEQNKKKEEKMKELQDFIARFSANASKSKQATSRKKQLEKIELDDIQPSSRRYPYVKFTPEREIGNDLLTVENLSKTIDGEKVLDNVSFTMNPNDKAILVGDSEIAKTTLLKILAGEMEPDEGTFKWGVTTSLSYFPKDNSEFFDGVDMNLVEWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNQAGALSKEVPYEEYLQEIGVLQNN

SEQ ID NO: 25546 - protein, 410 aa, Staphylococcus epidermidis ATCC 12228
MSPLIIGGLKLNRSVLKFGGSSVSDFKKIKNIAEMLKTRIEDGEELIVVVSAMGKTTDQLMNNVSSLTPTPKDQELALLLTTGEQQTVSYLSMVLNDIGVNAKAMTGYQAGIKTVGHHLKSKIAEINPNIFNEAFKNHDILVVAGFQGINEDFELTTLGRGGSDTTAVALAASNQTPCEIYTDVDGVYATDPRILNEAKRLEYVSYEEMMEMSALGAGVLETRSVELAKNYDIPLYLGRTLSNVKGTWIMSKSDLLEKKAVTGVALDTHMMHVTISYPLPDNQLLTQLFTALEEESVNVDMISQIVNLEGLQLSFSIKDSDAHQISSILENLSTHFSALDYKINEAYVKISLIGSGMRDMSGVASKAFTTLINSDIPFYQTTTSEISISYVIDEENGEKAVEELYHAFEI

SEQ ID NO: 25547 - protein, 433 aa, Escherichia coli
MVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 25548 - protein, 439 aa, Zea mays
MAKHLAAMCRCSLLVLVLLCLGSQLAQSQVLFQGFNWESWKKQGGWYNYLLGRVDDIAATGATHVWLPPPSHSVAPQGYMPGRLYDLDASKYGTHAELKSLTAAFHAKGVQCVADVVINHRCADYKDGRGIYCVFEGGTPDSRLDWGPDMICSDDTQYSNGRGHRDTGADFAAAPDIDHLNPRVQQELSDWLNWLKSDLGFDGWRLDFAKGYSAAVAKVYVDSTAPTFVVAEIWSSLHYDGNGEPSSNQDADRQELVNWAQAVGGPAAAFDFTTKGVLQAAVQGELWRMKDGNGKAPGMIGWLPEKAVTFVDNHDTGSTQNSWPFPSDKVMQGYAYILTHPGTPCIFYDHVFDWNLKQEISALSAVRSRNGIHPGSELNILAADGDLYVAKIDDKVIVKIGSRYDVGNLIPSDFHAVAHGNNYCVWEKHGLRVPAGRHH

SEQ ID NO: 25549 - protein, 318 aa, Bacteroides fragilis NCTC 9343
MKKFTCVQDIGDLKSALAESFEIKKDRFKYVELGRNKTLLMIFFNSSLRTRLSTQKAALNLGMNVIVLDINQGAWKLETERGVIMDGDKPEHLLEAIPVMGCYCDIIGVRSFARFENREYDYNEVIINQFIQHSGRPVFSMEAATRHPLQSFADLITIEEYKKTARPKVVMTWAPHPRPLPQAVPNSFAEWMNATDYEFVITHPEGYELDPKFVGNARVEYDQMKAFEGADFIYAKNWAAYTGDNYGQILSTDRNWTVGDRQMAVTNNAYFMHCLPVRRNMIVTDDVIESPQSIVIPEAANREISATVVLKRLLENLP

SEQ ID NO: 25550 - protein, 434 aa, Bacillus halodurans C-125
MKKNDETSRNLIGLDQQHFIHPTSSMQQQQQHGPAHIFVRGKGVYLYDHDGKAYLDGMSSLWNVNVGHGRRELGEVAKKQMDTLAFSSCFATFSNKPAIELAAKLARVSPPSLRATFFTSGGSEANDTAFKLARHYWKVKDQPKKRKIIARMKSYHGVAMGATSATGLKPFRDFAPSLAPDFLHVDHMSIEALRALIDREGPETIAAFVCEPIQGAGGVHVAPDSYLCDIRSICDEYELLFIADEVITGFGRTGAYFGCDHANISPDMMCIAKGITSGYAPLGGVMLSKSLHEQLTAHSHGTLLHGYTYSGHPTSCAVALKNIQIIEEENLIDHAATMGEKLLLGFRTIQEQYSEIHDARGRGLMAALAFSHNGKNEPLAPKVVQAADQRGLILRAVTFDQQDVLVCAPPLIINEEELNQLLSILESSVQAVVS

SEQ ID NO: 25551 - protein, 135 aa, Glycine max
  misc_feature (28)..(28): Xaa can be any naturally occurring amino acid
  misc_feature (41)..(41): Xaa can be any naturally occurring amino acid
  misc_feature (66)..(66): Xaa can be any naturally occurring amino acid
VPLFRVVVTRLCFEGIEARGFIFGSPIXGAKFVPLRKPKKXPGKVISQEHILEYGRDCLEMHVGLXAVEPGEHALVVDDLIATGGTLCAAMDLLERVGPKVVESGCVIELPELKGRERLNGKPLHVLVECFESCE

SEQ ID NO: 25552 - protein, 513 aa, Vibrio angustum S14
MSAKKPLALVILDGWGYREDNADNAIANAQTPVMDGLLAQNPNTLISASGIDVGLPDGQMGNSEVGHTNIGAGRVVYQDLTRITKAISDGEFFENEALVTAIDKAVNAGKAVHILGLLSPGGVHSHEDHIAAAIEMAAKRGAEKIYLHAFLDGRDTPPRSAKNSLVRFNELFAKLGKGRTASLIGRYYAMDRDNNWDRVEKAYDLITAAKAEFTVANAVDGLAAAYERDENDEFVQATEVRAEGQEAAIVADGDSVIFMNYRADRAREITRAFEPGFTDFARAQFPQLSDFVMLTQYAADIELTTAFKPASLDNTLGEWLSKKGKKQLRISETEKYAHVTFFFNGGKEDEFDGESRQLVASPKVATYDLQPEMSAPELTDKLVAAIKGGEFDMIICNYPNGDMVGHTGVYDAAVKACEALDTCLGKVVAAIKEMDGQLLITADHGNAEMMVDPSTGGIHTAHTNLPVPLIYVGSKDLELKSGGKLSDLAPTMLSLTDMEIPAEMSGQVLYNLK

SEQ ID NO: 25553 - protein, 129 aa, Shigella flexneri
GDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 25554 - protein, 345 aa, Zea mays
MPLGDDAAADFALPDELLAALPRDPYEQLDLARRITALAVAGRVSGLEREAGRLRAEAAGKDRESAELRERVALLDAALQETNARLRAALEDNIKLSKERDSLAQTSKKLARDLHKLESFKRHLMQSLRDDSSSTQETVDITTCDQPVASKASSSAGYRYGGSVSNPATNIFTESLDVGSTNRDGTAARPPIQKYSLTTHITPRLTPEATPKIMSTSASPRRMSTTGTPKLMSGSTSPSKTRIEAHMSMTPWYPSSKQSSAANSPPRGRSNPGRTPRIDGKEFFRQARSRLSYEQFGAFLANIKELNAHKQSREETLKKAEEIFGPDNKDLYLSFQGLLNRSMVA

SEQ ID NO: 25555 - protein, 468 aa, Escherichia coli
MSKQQIGVIGMAVMGRNLALSIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 25556 - protein, 220 aa, Triticum aestivum
  misc_feature (85)..(85): Xaa can be any naturally occurring amino acid
  misc_feature (104)..(104): Xaa can be any naturally occurring amino acid
MGSAASPPRALDAATQEDLKRVSAHRAVDMVESGMTLGLGTGSTAAHALDRLGALLRTGALGGGPGVPTSPQREPPPGRLGIPLXGLPDPAKIPLSIKGPKDVXPEPNPLKGRGGSLFREKLWGARPPFGFFCGRVQALPRPGCGGSRPGGVLPFGGGLKGGLYRVGVRKLGGFPARVRARNIYGGGMEGGGFSPGRGAPGGEVFWGGGIWGTRGKIRHG

SEQ ID NO: 25557 - protein, 312 aa, Rhizobium leguminosarum
MLKNHGDGTHICYWRFPLYIGIPKTAFLPATRRAAMVAKTDIRAFETGHPLKVMDPIWDSLREEARLAAERDPVLAAFLYSTVINYHSLEECVIHRICERLDHPDMQANLLRQTFEEMLLDWPDWSSILRVDIQAIYDRDPACLRFMEAVLYFKGFHALQTHRLAHWLLNRGRRDFALYLQSRSSSVFQTDINPAARIGKGIFLDHATGLVVGETAVIGDNVSILHGVTLGGTGKEGADRHPKIGSGVMIGAGAKILGNIEIGYCSRVAAGSVVLKAVPPKKTVAGVPAKVVGEAGCSEPSRNMDQVIGADI

SEQ ID NO: 25558 - protein, 429 aa, Salmonella enterica subsp. enterica serovar Typhi str. CT18
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVCMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGT

SEQ ID NO: 25559 - protein, 142 aa, Brassica napus
  misc_feature (80)..(80): Xaa can be any naturally occurring amino acid
MQKLNELFSGGGDGEGANDSFLEDGSEGLCSLSTTQRMYGFAASLAAGLLLMFLSMIVFAIPIKFALLFTFGNVLAIGSXFLMGPEQQINMMLDPVRIYATSIYGGCVLLALICALLIHSKILTVIAILCETCALIWLQPQL

SEQ ID NO: 25560 - protein, 179 aa, Glycine max
  misc_feature (9)..(9): Xaa can be any naturally occurring amino acid
ALIVNWRAXLKIGPNEPCELAIHENAYGLARYAVICQENGLVPIVEPEILVDGPHDINKCAEVTERVLAACYKALNDHHVLLEGTLLKPNMVTPGSESKKVTPEVIAQYTVTALQRTVPAAVPAIVFLSGGKDENIKKAQDALFARCNANSHATLGTYKGDATLAEGASESLHVKDYKY

SEQ ID NO: 25561 - protein, 627 aa, Burkholderia pseudomallei K96243
MTDRIRPRPFRSRAGAIAAAFFAVAAAGCANAPGPGAQNAAAPASAASTPPAAPSAEAPAAPAELSSWVDKPGWTAQRDMIAAAHPLAAQAGQAMLKAGGTAVDAAIAAQMVLMLVEPQASGIGGGAFLLHANGKTIEAYDGRETAPAAATDRLFLDANGKPLPRAALGARTVGAPGALRMLELAHRAHGKLPWRRLFQPAIRLAEQGFPLGPRLAAALANEPSLARDPAARAYFYDRNGAPKPAGTTLKNPQLAATLRLVAAHGANAFYTGAIARDIVATVRQAPNPGVLSMQDLAQYRAKTREPLCADYRKWTVCGMPPPSAGGLVVAQILGLLEAQPDWRQIGAQKPVRNAVGVEPTPFAAHLFSEAGRLAYADRAQYVADPDFVAPPGGSWKRLVERRYVAERARLIGDASAGEASAGSPSGLPPATAADRGAEPPSGSQITVVDRYGNAVSMASTLDERFGSRLMVRGFLLNSQLLDFSPASAEHGKPVANRVQPGKRARSTLAPELVFEKGSSRLMMALGSAGGASTANDVAKTLVGMIDWGMTMQQAIALPNFGSRNGPTELEQGRVSDALAGALKARGHDVRVVELGSSLQGIQRINVEGQSVWFGGSDPRRDGIVAGD

SEQ ID NO: 25562 - protein, 437 aa, Candida albicans SC5314
MYKTQLIKSSTQARFLAVRQLSSTSQLLKWNDIPLAPPDKILGISEAYNNDSNPQKVNLGVGAYRDNSGKPIIFPSVKKAEEILLGKETEKEYTAIVGSKNFQSIVKNFIFNNSNKDANGKQLIDDGRIVTAQTISGTGSLRVIADFLNRFYSNKKILVPKPTWANHVAVFKDAGLEPEFYSYYETSKNDLDYANLKKSLTAAPEGSIVLLHACCHNPTGMDLTSEQWDEVLQIVQDKKFFPLVDMAYQGFASGKPFEDIGLIRKLTKLANENKIPSFALCQSFAKNMGLYGERTGSISIINSSGEASKAVESQLKKLIRPIYSSPPIHGSKIVEVIFDESSGLLPQWLDELDKVVGRLNTVRSKLYEKLDKSNYNWDHLLKQRGMFVYTGLSPEQVIRLRNEYSVYATEDGRFSISGINDNNVDYLANAINEVIKN

SEQ ID NO: 25563 - protein, 708 aa, Burkholderia pseudomallei K96243
MNQQAFPATGTVTRERRDKVLVVTIDHPPVNALSADVRRGLVDALDAADADAAVGAVLIVGAGRNFIAGADIREFGKLPVPPLLPDVCNRIETSGKPVVVALHGAALGGGLEVALAAHYRLAVPGAKLGLPEVQLGLLPGAGGTQRTPRLIGAKAALELMLSGRHASAEEALALGLVDRLAHSDDTLAEGLAYVHELLAAGAGVRRTRDAQGLADRAAAEAALDAARADVARHSRGLFSPARIVDAVAAALAQPFDEGLRTERRLFVECLDSPQRAGLVHAFFAQREAAKSPETRRGAPRAIERIGVVGGGTMGAGIAVAALDAGFPVTMIERDDASLERGRAHVEKVYAGLVAKGRMTPAAQAARLARFKGGTSYEALAQADVVIEAVFEDMAVKKAVFAELARACKPGAVLATNTSYLDIDELAASVERAPDVIGLHFFSPANIMKLLEVVVPAKVSADVVATAFELARKLGKIPVRAGVCDGFIGNRVLAVYRTAADYMMEDGASPYQIDRAIREFGFPMGPYQVVDLAGGDIGWATRKRRAPTRDPRLRYVEIGDRLCERGWFGQKTGRGYYLYPDGARVGTPDPEVEAIIAQARAAKGVSPRAFTDEEIVRRYLAAMINEGANVVHEKIALRPLDVDAVFLHGYGFPRHRGGPMHYADTVGLANVLADIRAFAGEDPVFWKPSPLLVDLVARGETFASLNRID

SEQ ID NO: 25564 - protein, 170 aa, Fusobacterium nucleatum subsp. nucleatum ATCC 25586
MDLKNYVASIENYPKEGIIFRDITPLMNDGEAYKYATEKIVEFAKDHHIDIVVGPEARGFIFGCPVSYALGVGFVPVRKPGKLPREVIEYAYDLEYGSNKLCLHKDSIKPGQKVLVVDDLLATGGTVEATIKLVEELGGVVAGLAFLIELVDLKGRERLDKYPMITLMQY

SEQ ID NO: 25565 - protein, 325 aa, Zea mays
  misc_feature (258)..(258): Xaa can be any naturally occurring amino acid
ARDHYLEHPNRKDLIPYPCAAHLPFPAWSSHSLAPFFPSPDLPIPEITPDTPHPRTPRPHLAMGSAAASPPPSGKLTQEELKRVAAHRAVEFVEPGMTLGLGTGSTAAHALDRLGDLLRAGALPGVAGVPTSLKTEAHAARAGIPLLPLPGARIALSIDGADEVDPDLNLVKGRGGSLLREKMIEGAGARFVVIVDESKLVPRLGCTGAIPVEVIPFGALHTLGLIRGLFDGLPGFHARLRTVPAAPRQGGRRLGLGXEQPFVTDNGNYIVEMFFEDGIRGDLRDISDRLLRITGVVEHGMFLGMATTVIVANKDGTVSVMDRKK

SEQ ID NO: 25566 - protein, 405 aa, Lactococcus lactis subsp. lactis Il1403
MLEGIKKDFPVLNQIVNDEPLVYLDNAATTQKPLKVLAAIKDYYENDNANVHRGVHTLAERATEKYEAAREKVRQFINAKSTKEVLFTRGTTTSINWVAQFAGQILKTGDEIVISIMEHHSNIVPWQEVAKKTGAILKFVYLKDGQLDMDDLRKKITNQTKFVSIAHVSNVLGTINPVEEITKIAHEHGAYMAVDGAQSTPHMAIDLQKMDVDFFAFSGHKMMGPTGIGVLYGKEELLNQFEPVEFGGEMIDFVYESHSTWTELPWKFEAGTPNIAGAIALGAAIDYIQELGIDQIHQHEIELIDYLMPKLQEIEGLKIYGPKDNVKRGGLIAFNIEGLHPHDVATALDMEGVAVRAGHHCAQPLLNYLETPATARASFYLYNTKADCDKLVEALKKTKEFFNLD

SEQ ID NO: 25567 - protein, 327 aa, Haemophilus influenzae R2846
MPQNLPHFYRGRFSVAPMLDWTTRHCRYFHRQFSKHALLYTEMVTAPAIIHAKYDHLDFDLQENPVALQLGGSDPEQLKYCAKLAEERGYHEINLNVGCPSDRVQNGMFGACLMAKADLVADCVEQMQSAVKIPVTVKTRTGIDELDSYEFLCDFIEKVQGKGCQEFIIHARKAWLSGLSAKENREIPPLDYARVYQLKRDFPHLTIAINGGIKTIEEMKQHLQYVDGVMVGREAYQNPSLLGQIDQALFDPNAPIVTAHEAVQSMLPYIEQQLNQGIHLNHIVRHMLGAFQNCKGARQWRRYLSENAFKQGAGVEVIETALSFVEH

SEQ ID NO: 25568 - protein, 467 aa, Oryza sativa Japonica Group
MAALLHLQSSATAAAAPSFLLLRRRGGGVTAPAGSSRRRRACFRVEAKIREIFMPALSSTMTEGKIVSWTASEGDRLAKGDPVVVVESDKADMDVETFHDGFLAAVLVPAGESAPVGSAIALLAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSGTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 25569 - protein, 167 aa, Zea mays
  misc_feature (16)..(16): Xaa can be any naturally occurring amino acid
  misc_feature (39)..(39): Xaa can be any naturally occurring amino acid
  misc_feature (86)..(86): Xaa can be any naturally occurring amino acid
  misc_feature (154)..(154): Xaa can be any naturally occurring amino acid
AGDAEGSSLILGGGMXYTFYKVQGILVKNLSCKTINIEXATSLIEEANAKAVPVLLPTDMAFADNEPGDAESKNVPGTAIPADWQXRDDDPDAKKTFNESLDTTKTGIWNGPMTTVLSSPRVVSGTEANAKKLTELTTTNGVTTIIGGGDSVRXVKKAGLAAKMSHI

SEQ ID NO: 25570 - protein, 118 aa, Thermus thermophilus HB27
MGEIALLGLEFYGRHGVMPEEGRLGARFVVDLWLSVPFEGKGDRLEETVDYAAVYALVEEAVRHRRFYLIEALADHLAEELLKAFPRLQAVRVRVHKPHAPIPGVFRDVYAETQKSRS

SEQ ID NO: 25571 - protein, 334 aa, Vibrio angustum S14
MKYLITGVAGFIGSAITERLCAQGHQVIGIDNLNDYYDVSLKQARLARIAHPSFTFIELDLADREGIANLFAEQQFNRVIHLAAQAGVRYSIDNPLAYADSNLVGNLTILEGCRHNKVEHLVYASSSSVYGLNHKTPFNTADSVDHPISLYAATKKSNELMAHTYSHLYGVPTTGLRFFTVYGPWGRPDMALFKFTNAIMEGKEIDVYNHGDMRRDFTYIDDIVEGVMRIQDVIPQPNADWTVEAGSPATSSAPYRVYNIGHGSPVKLMDYIEALEEALGIEAKKNFMDMQPGDVYMTYADTEDLFKATGYKPEVKVKEGVKAFVDWYREFYQK

SEQ ID NO: 25572 - protein, 177 aa, Triticum aestivum
KRSPAPRVPWVTPCDTRKGGGFDGQTPAELFGGDGFHSTSAQGFHGRCLRLVQLWSQREGGIHHVCCPLNRPNPVANNFKGWTQLVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 25573 - protein, 340 aa, Frankia sp. CcI3
MTVRHFLLDTDLTPAEQTALLDLADGFKARRRVTRLTERPLAGRSVALLFEKPSTRTRLSFDVGVAELGGHPVVIDAASAQLGRGETIEDTAAVLSRYVDAIVVRTFAQERLERLAAAATVPVINALSDHAHPCQALADLQTIRERRGRLAGLTLTYLGDGNNVAHSLLLAGASAGMRVHVASPPGYEPFEQVVRHANEIGMVTGGEALVMHDALEAAAGADVLYTDVWASMGQESESDSRALVFQPYRLDEKAVEAASPDVIVMHCLPAHRELEITTSVIDGPRSVVFDQAENRLHAQKALLSILLSEGVGPTGTAGSASGVGGASSVGGASSVGGTGR

SEQ ID NO: 25574 - protein, 444 aa, Frankia sp. CcI3
MNAEIAENPVNPVNPVNAEIAKDADLIARRDAVVMATYGRPAISLARGAGSRVWDHDGREYLDLVGGVAVSVLGHCHPAVRDAVVGQLGALGHVSNLYANEPQVLLAERLVELLRVGAPSPGLPPEGAKVFFCNSGAEANEAAIKIARRTGRPEIIATEGSFHGRTLGALSITGQPAKRAPFEPLLPGVRFVPYGDGAALRAAVSEATAAVFLEPTLGEGGVVPPPTGYLAAARAVCDSAGALLVLDEVQSGIGRTGSWFAHQAEGVLPDVITLAKGLGGGLPVGACVGIGAAGTLLRPGDHGSTFGGGPIVCAAALAVLDTIAAEGLLEHASRLGERLAAAIRAAGVPGVAGVRGQGLWRAIELDGPFAPAVEKAAREAGYLVNAVAPDAIRLAPPLILTAAEVDAFVAALPGIVGDALAARVPSAQSASAQSASAPGSRVSA

SEQ ID NO: 25575 - protein, 196 aa, Phaseolus lunatus
IIDSHTVDVNGKQHSAKHILVAVGGRPFIPDIPGKEYAIDSDVALDLPSKPGKIAIVGGGYIALEFAGIFSGLQSEVHVFIRQKKVLRGFDEEIRDFVTEQMSLRGIEFHNEETPQAITKSADGSFSLKTNKDTVDGFSHIMFATGRRPNTKNLGLETVGVKLAKDGAIEVDEYSQTSVPSIWAVGDVTNRINLTP

SEQ ID NO: 25576 - protein, 166 aa, Brassica napus
EGVPFILKAGKAMSSKKADIRIQFKDVPGDIFKCQKQGRNEFVIRLQPSEAMYMKLTVKQPGLEMQTVQSELDLSYKQRYQDVSIPEAYERLILDTIKGDQQHFVRRDELKAAWEIFTPLLHRIEKGEVKSIPYKPGSRGPTEADQLLEKAGYLQTHGYIWIPPTL

SEQ ID NO: 25577 - protein, 362 aa, Frankia sp. CcI3
MNAPTRTPPPSNGGHGSTGSTGSTGDAAPGGGTGRGPAATARGHAALAKTQVLIEALPWLSRFQGATIVVKYGGNAMTEPALREAFAADVVFLRHSGLRVVVVHGGGPQITAHLERLGVPSTFVGGLRVTTPQTMDVVRMVLLGQVNRDVVGLVNDHGPFAVGLSGEDANLFTARRRPAIVDGREVDVGLVGDIVEVRPETINALLGSGKVPVVASVARGVDGGVYNVNADTAAAELAVALGATKLVVLTDVEGLYADWPASDEVISELSITELEQLLPSLTAGMIPKMEACRRAVRGGVPQAHVLDGRVPHAVLLEIFTDDGIGTLIMAESGTSPEPGTPPAPAARPAGIVPAGEPTGGTP

SEQ ID NO: 25578 - protein, 405 aa, Magnetospirillum magnetotacticum MS-1
MFRTIDSFDVKGKRVLVRADLNVPAKDGKVTDTTRIDRSAATLKELAGKGAKVIVLTHFGRPKGRDAKYSQKLLVEPLARAVGQPVLWADDCIGVEVEQMIAKMKDGEIALLENVRFYENEEENDIGFAKMLAGLGDIYVNDAFSTAHRAHASTEGVAHLLPCAAGRLMQAELEALGKALEHPEKPVAAIVGGAKVSTKLDLLGNLVARVDYLIIGGGMANTFLFAQGKQVGKSLCEKDLADTAREILEKAKAAHCHIVLPVDAVVAGEFAENAANQVVSVDAVPADKMILDAGPASAEAIIDRLGGCKTLVWNGPLGAFEIAPFDKATNAVAQWAAERTVQGKLLTVGGGGDTVSALAKAGVEDKFSYISTAGGAFLEWLEGKVLPGVAALEVKNCGSGCGCGG

SEQ ID NO: 25579 - protein, 255 aa, Glycine max
MAAKISLAIGLRTLFTVLGLLMLAVFLYTAFTDGLGVRFLKELVRPWMVATLVCFYINIVAFAVWIAYKESNLISSILWIVLIALLGSIFTSAYIVVQFLKLSSQESSQDPMYYVLLRHPNKNGTAPQRQRSSVVTLRIIFSILGVVMLGTLVYTLVTNGSPFRKGVLTPWLATTLVDIYFHIVIYAVWVAYKESSWISAVFWIILLICFSSMATCLYITWQLFQISCQDPAYLVLVHHGDRAENEYTGISGEAT

SEQ ID NO: 25580 - protein, 394 aa, Oryza sativa Japonica Group
MGSFGRLARRAVETEAPVMVKMQELLRGNKDVMSLAQGVVYWQPPEAAMNKIKEIVWEPSISKYGSDDGLPELREALLEKLRRENKLTKSSIMVTSGANQAFVNVVLTLCDAGDAVVMFAPYYFNSYMSFQMTGVTDILVGASNPETLHPDVDWLEKVLQENNPIPKLVSVVNPGNPSGAFIPKPMLERISELCRNAGAWLVVDNTYEYFMYDGMEHYCLEGNHIVNLFSFSKAYGMMGWRVGYIAHPNEADGLHAQLLKVQDNIPICASIIGQRLALYALEAGPEWIRERVRDLVKNRELLMEAMSPLGKDSVKGGEGAIYLWAKLPEKCSDDFEVVRWLANKHGVAVIPGSASGGPGYIRVSFGGLKESDTRLAAERLRRGLQELVTEGMVQ

SEQ ID NO: 25581 - protein, 307 aa, Ustilago maydis 521
MAGYTLAIIGCGTMGVAILSGVLDSQRSQQAIASSMASSVSSLHDSTTCDDLSELPTRYIATVNRLESVRRLKKTFSQYPDIQIHAGQNVAAAREADVILLGCKPQMVQDIIAECGMKEALDGKLVISICAGLRISQIVEWVTPATKVVRAMPNTPCKIREGMTILTPLPSTLPNAELDRNILLSIFSAVGRCRFLDEKHFDACTALAGSGPAFACVFLEAMADGGVMMGLPRQEALELAAQTMQGAARMVMQSGMHPAAIKDSVTTPGGCTIAGLLNLEDGKVRSTVARTIQAAAEHASGLGQNRK

SEQ ID NO: 25582 - protein, 378 aa, Arabidopsis thaliana
MKGISSVSQSINYNPYIEFNRPQLQISTVNPNPAQSRFSRPRSLRVLSLSADPSANRNPKSAVDAHAPPLVVVGSANADIYVEIERLPKEGETISAKTGQTLAGGKGANQAACGAKLMYPTYFVGRLGEDAHGKLIAEALGDDGCGVHLDYVRSVNNEPTGHAVVMLQSDGQNSIIIVGGANMKAWPEIMSDDDLEIVRNAGIVLLQREIPDSINIQVAKAVKKAGVPVILDVGGMDTPIPNELLDSIDILSPNETELSRLTGMPTETFEQISQAVAKCHKLGVKQVLVKLGSKGSALFIQGEKPIQQSIIPAAQVVDTTGAGDTFTAAFAVAMVEGKSHEECLRFAAAAASLCVQVKGAIPSMPDRKSVLKLLKFSI

SEQ ID NO: 25583 - protein, 240 aa, Debaryomyces hansenii CBS767
MFRVKTFTVPSIFSRRFLSFKTLETPNPNALKFISPECQILPIPSKTFEFTSTLQAIHSPLALKLFKLHGVRSIMLGEDFLTVNKQDHINWAQLRPEVVDLLDGFLTSKKESVVTKELIEESEREIESSEDDLEIVSMIKELIETRIRPAIQDDGGDIEFKGFDEETGNVFLKLQGACKTCSSSEDTLKNGIEQMMKHYIDGVQEVIQILDPEEEIALKEFDRLEQKIKQKSQDSPPPSL

SEQ ID NO: 25584 - protein, 445 aa, Physcomitrella patens subsp. patens
MNGNNNRMRVGKYELGKTLGEGTFAKVKFAKNLDTGESVAIKVLDKDKILKHKMVQQIKREISTMKLVKHPYIVQLLEVMASKTKIYIVLEYVTGGELFDKIVSTWSRLIENDARRYFQQLIDAVDYCHSRNVYHRDLKPENLLVDANGNLKISDFGLSALPQQCRADGLLHTTCGTPNYVAPEVINDKGYHGATADLWSCGVILFVLMAGYLPFDEQNLMTLYKKIYRAEFTCPSFFSSGARRLIMKILDPNPKTRITAAQIYQNDWFKKGYSPAKFDKDMDINLDDIDAVFSESTDYMVTEERGVKPPAMNAFELISLSRGLNLSGLFETREQDRGPQKESRFTSTKPANEIISTIEKAAKPLGFNVQKRDYKMKLQADKHGRKGHLSVATEVFEVAPSLFMVELRKKGGDTLEYHNFYRDLSKGLQDIVWRSEKDGNSSPIK

SEQ ID NO: 25585 - protein, 563 aa, Physcomitrella patens subsp. patens
MVTNDVLGVAHSLLLKTPDLRDDHMHVVSICLFVFLLCACIVFGHLLEENRWMNESITALLLGLCTGVVVLISSNGQSSHVLKFDEELFFIYLLPPIIFNAGFQVKKKEFFRNFIAIMLFGVIGVFISFAVISTGSWYLFPKLGLNLSMRDILAIGVIFSATDSVCTLQVLNQDETPLLYSLVFGEGVVNDATSVVLFRAVQSYNFDRFSPLEDLQIGCNFLYLFSSSCILGIASGLISAYIIKTMYFGRHSTDREIAIMILMAYLSYILAELFYLSGILSVFFCGIVMSHYTWHNVTENSRTTTRHSFATMSFIAETFIFLYVGMDALDLDKWKTTQSSFKESAGLFGSLMCLILLGRAAFVFPLSALSNYSTKSPGAKINLRQMIIIWWAGLMRGAVSIALAFNQFTQGGDAKTSKQATSMVTTINIVLFSTIVFGTATKPLISWLLPPHLRSNYGDSAGLSPKVSLDVDFHMPLLMDTEHDGNGTNDRTVISQILHGLPRPQSIGMLLTAPRSTIHYVWRKFDDAYMRPMFGGRGYVRLMSRRSMDIPEENEDLEDEDQN

SEQ ID NO: 25586 - protein, 495 aa, Bacillus subtilis subsp. subtilis str. 168
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 25587 - protein, 231 aa, Triticum aestivum
  misc_feature (122)..(122): Xaa can be any naturally occurring amino acid
  misc_feature (133)..(133): Xaa can be any naturally occurring amino acid
MGGKVLLISSVLVGLVSLSSCRSLGELHEQKTHYGGSPTPTHGSGGGYNPTPTPTYGTTPTPTYGTTPTPSYGTTPTPSYGTTPTPSYGTTPTPSYGTTPSTPSTPSHDVPASPKKHGFIGXSCDYWKNHPDXIVAAIGSLGNIGKTFGAACSMIGGKKLGNMHDALSNTRTDGIGALIREGAAAYLNSIVNKKFPFTTQQVKDCIVVAVTSDGAASAQAGVFKKANEFHY

SEQ ID NO: 25588 - protein, 88 aa, Brucella abortus
MVANGGSLYLQSLIILGGAIIAAPLFKRLGLGTVLGYLAAGITIGPVARLIADGEEFLHFSELGVVFLLFIIGLELNPSRLWSLRHSI

SEQ ID NO: 25589 - protein, 321 aa, Bacillus subtilis subsp. subtilis str. 168
MDIIRKISHFAGQTFGIWVIVFAVLGFSFPSLFTWISSYITIFLGIIMFGMGLTLQADDFKELVRKPWQVIIGVIAQYTIMPLVAFGLAFGLHLPAEIAVGVILVGCCPGGTASNVMTFLAKGNTALSVAVTTISTLLAPVVTPLLIMLFAKEWLPVSPGSLFISILQAVLFPIIAGLIVKMFFRKQVAKAVHALPLVSVIGIVAIVSAVVSGNRENLLQSGLLIFSVVILHNGIGYLLGFLCAKLLKMDYPSQKAIAIEVGMQNSGLGAALATAHFSPLSAVPSAIFSVWHNLSGSMLATYWSKKVKKKQAGSKSSNLSL

SEQ ID NO: 25590 - protein, 417 aa, Bacillus subtilis subsp. subtilis str. 168
MAEIKVPELAESISEGTIAQWLKQPGDYVEQGEYLLELETDKVNVELTAEESGVLQEVLKDSGDTVQVGEIIGTISEGAGESSAPAPTEKTESKESVKEEKQAEPAAQEVSEEAQSEAKSRTIASPSARKLAREKGIDLSQVPTGDPLGRVRKQDVEAYEKPASKPAPQQKQQPQAQKAQQSFDKPVEVQKMSRRRQTIAKRLVEVQQTSAMLTTFNEVDMTAVMNLRKRRKDQFFEQNEVKLGFMSFFTKAVVAALKKYPLLNAEIQGDELIVKKFYDIGIAVAAVEGLVVPVVRDADRLTFAGIEKEIGELAKKARNNKLTLSELEGGSFTITNGGTFGSLMSTPILNSPQVGILGMHKIQLRPVAIDEERFENRPMMYIALSYDHRIVDGKEAVGFLVTIKNLLEDPEQLLLEG

SEQ ID NO: 25591 - protein, 190 aa, Acidovorax sp. JS42
MTRVLMVDNYDSFTYNIVQYFGELGAEVEVFRNDEITLEGIAARAPDRLVISPGPCSPAEAGISVAAIQHFASKLPILGVCLGHQSIGAAFGGKIIRAQQLMHGKTSVITTTQTGVFAGLPKQFTVNRYHSLSIERASCPEVLEVTAWTDDGEIMGIRHRELAIEGVQFHPESILTEHGHAMLKNFLDQK

SEQ ID NO: 25592 - protein, 351 aa, Vitis vinifera
MVMCQLSCQFLATPLQVGKSLPTSLHLPRFLKSESFPGASTGVLRCSTETEVSESRNRMFILGMGFVGQFFAQDLKNHGWVVSGTCTSAFKKKKLEERGFNIYLFDANEPELGVLNALKYSTHLLVSIPPVVGIGDPILQHDKFLKSRIMDGDLQWLCYLSSTSVYGNCGGELVDEDYPASPASESAKLRLAAEKGWSSLGSELGLSTQIFRLGGIYGPGRSAVDTIIKQGPLTEGQRKRISRQYTSRVHVADICQALKATIQIPSVGKIYNIVDDDPAPRAQVFAFARDLIEKKWPNHIKESVFPGSARQAEKRVSNARMKKELGVTLLHPTYRSGLQSIIDNMENPISK

SEQ ID NO: 25593 - protein, 340 aa, Lactococcus lactis subsp. lactis Il1403
MKAAVVRHNPDGYADLVEKELRAIKPNEALLDMEYCGVCHTDLHVAAGDYGNKAGTVLGHEGIGIVKEIGTDVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVIINSGDVNPVDEIKKITGGLGAQSAIVCAVARIAFEQAVASLKPMGKMVAVALPNTEMTLSVPTVVFDGVEVAGSLVGTRLDLAEAFQFGAEGKVKPIVATRKLEEINDIIDEMKAGKIEGRMVIDFTK

SEQ ID NO: 25594 - protein, 238 aa, Zea mays
MAAPAAAPLDEGKAKKVLRQVEFYFSDSNLPRDKFLRETVEQSDDGLVSLPLICSFSRMKSHLGLDADVKPETVPEETVLAVAEVLRPSPALRVSEDGKKIGRASELLKPDEIIEQVDSRTIAVSPLPCNVKQEDVQSFFTNYAKVNSVRLPRNIANKKHFCGTALVEFSEEEEAKRIMETALVFAGANLEIRPKKEFDAEQKSKKEAYEKTHLKKDNQYEGYQKGLIVAFQLEKATA

SEQ ID NO: 25595 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEAEQAF

SEQ ID NO: 25596 - protein, 630 aa, Chlamydomonas reinhardtii
MAVIIQKLGQNEELPEVIFRALHHVDSRAVALLLKDLSRLGKDRRAMELFDWLRSANERSPLRQLCDVYSYTATISLCIYSQDVDRAMELMNEMRQRNIERNVHTFTALMNVCIKCGKLPLALEIYNNMRAANCMPNVVTYNTLVDVYGKLGRWERAIHVLDLMKQEGVEPVLRTYNTLIIACNMCNQPREALAVYQRLLSDGYTPNSTTYNALISAYGKTMQLGKALEVYQEMLRQNMERSVITYSSLISACEKAGQWETALRIFNEMQQDNCVPNTVTYNSLVTACAQGGQWEKATEVFEQMTAHGCTPDVVTYTALISAYERGGQWQKALQAFGKMCMQGCKPDAIVYNAIIDTLWETGIIWAQGRALQLFLTAVQQGHFRQEPVVRRAGRVEVNLHAMTAGVAMVCLYCWLLEIKRIAAEKGLAGLPQTLAIVTDMGKASREQGNCIVKEAVAAMMSFWDAPFRLVQDGAYASVLEATSAQVVEWVTSMPFSAQLASLFPITDSSKMTEDMYAVREQQVLQECQEAFAAVQHFENTHGLVLSNMSTGYVQQRPVLISRLLDLSSKLGLRDEVVHDAVLLMDRTASQAKQVAEDVLPLVGVAALVIAAKQGDSSDRVPTNAEIEQIT

SEQ ID NO: 25597 - protein, 466 aa, Vibrio angustum S14
MALHEVTRKTGNDPIYGSDTIHNVAATTKLPQQEQAPNVIYQMIRDELYLDGNARQNLATFCQTWEEDEVHKLMDLSIDKNMIDKDEYPQSAEIEGRCVHILADLWNSPESVTTVGTSTTGSSEACMLGGLAALWRWREKRRALGQPTDKPNMVCGPVQVCWEKFARYWDIEMRETKMADGHYCMTPEDMLELVDANTIMVVPTFGQTFTGLYERVKPLSDALDTYEHDTGNSIDIHVDGASGAMLAPFCAPEIDPWDFRLERVKSISTSGHKFGLAPLGCGWVVWRSKEDLPEGLVFHVNYLGGDMPTFALNFSRPAGQIIAQYYNFLRLGYEGYKRIHDASYDVCEYLVKELNKFNLFEFLFDGNREKGIPAISWRLKNDADVSFSLYDLADRLRTRGWLVPAYSLPANAQVLVVQRILVKQGLTIDLANLLIADFKRSIDFLNTHAQAKCTAEDVKTFDHSGR

SEQ ID NO: 25598 - protein, 314 aa, Vibrio angustum S14
MSCCKKDVAAIMQQAFDLHKGNKDGANASYIPFLASVPSDLCGLAFVSVTGEVIKIQDVDYKYAIESISKIMTLGLALEQSGADAIHSKVGAEPTGLPFNSVMALELHNGKPLTPLVNAGAMATVSLIEADDKEQRWQKILAFQSALAGANIELSEDVNQSEQTTNAHNRAIALLLESSNRIYSDPLEACDVYTRQCSTLFNTVELATVGATYANGGKNPISGQQLVSPENASHILAEMMMEGLYDTSGDWAYDVGLPGKSGVGGGLVTIIPNVGALAAFSPRIDQFGNSVRGQLMIKHVAQTMGWNLFNSKQH

SEQ ID NO: 25599 - protein, 402 aa, Legionella pneumophila str. Lens
MKHSLATIEEAVATLKAGKMIILMDDEDRENEGDLVIAAEHATPEAINFMSRLGCGLICLPMAEELIDKLELPMMARHNKSPYGTAFTVSIEAANGVSTGISARDRARTIQVAIDPKSGPSDIISPGHVFPLRARKRGVLERPGQTEGSVDLVKLAGLTPAAVICEIINEDGTMSRRDELALFSKKHQIPLVTIKDLIQYRVRHENLIHPVATTQIPLEENGVFTMTVFENQIDSCEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVEALRLLTNNPLKIASLERYGMKITQRIPLEIEPSRENHSYLKTKKIKLGHLLAID

SEQ ID NO: 25600 - protein, 659 aa, Rhodopirellula baltica SH 1
MIGLSTGSPSLPASIPPNENASSDVSVPGTSSGRRRKTSHLKEVPETLAMRESLRDRCAQVAAKLDRSHPMTKDEMEQISRRMLEEADLPESYLGWVMVMISSEFWADALASVPPERRLFLLPHCLKHAEGCPAEYDQFGMNCKECGACSIADFRSIAEDMGYRVLVAEGSPVVMKIIVGGYVDAVVGVACLNVLEKAIDKVLLAGIPCMAVPLLSSDCRNTKVDEPWVEQMIRTPYKPAAAKTKSYVHLMRAAGLLFEDTLFERLAPRQRESHLGGEGGNAYSPGTRMLGATPSENGARPAVTPEQLEGIDPIAATETIALDFLARGGKHSRPFITLAAYDAMMGGDGTGADGEDVLNRVPDAVRRAALSIETFHKASLVHDDIEDGDAFRYGQPAVHQRFGTATAINVGDYLIGLGYRLLSRNMMGDDVDAGTRVDLLDSLAAAHVRLSEGQGAELLWRDAKDRRLTPLDALKIYALKTSPAFEAALYSGVRMAGDASALIDPIRKFSRNLGVAFQIINDLNDWAGDDSNKLTAGADVIGGRPTLLWALALQHLDDEDKQTLLALAEPDCELSDRERLTTVRRLYEKANVFEMSLQLIDKHQARAEQVADEIENESLRRLLYFLVDTVLERPESAGSSEEAEQSSSPAVVKIGVVAR

SEQ ID NO: 25601 - protein, 155 aa, Legionella pneumophila str. Lens
MREIKTIVSDGVTFPIALVVSTFNEPITSALKKGALDRLTELGFKSEDITLVEVPGAVEIPFVAQLLAKKQKVEVIVALGAVIRGETSHYDYVCDQVSQGCQRVMLDYNIPVIFGVLTTENDEQALARVGGTHGHKGRDAIDCAVSMRSIKQQLQ

SEQ ID NO: 25602 - protein, 476 aa, Oryza sativa Japonica Group
MPPDVEVIRHEHIDHPSSTRDRSVVVSSNSLSNTVSAYTDMKNTSSLCLLLLVVLCSLTCNSGQAQVLFQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAAGMIGWLPEKAVTFVDNHDTGSTQKLWPFPSDKVMQGYAYILTHPGVPCIFYDHMFDWNLKQEITALAAIRERNGINAGSKLRIVVADADAYVAVVDEKVMVKIGTRYDVGNAVPSDFHQTVHGKDYSVWEKGSLRVPAGRHL

SEQ ID NO: 25603 - protein, 129 aa, Debaryomyces hansenii CBS767
MTKSEEEWKAILSPQQFRVLRQQGTEAPYTGEYNSKPATKAGVYECVGCGNPLYKSLTKFDSNCGWPAFYEAIPDSLKILKDLSHGMVREEMRCNKCDGHLGHIFRGEGYKNPTDERHCVNSVCLKFKE

SEQ ID NO: 25604 - protein, 205 aa, Griffithsia japonica
MTIVQVQTPFTEMPTLKRVHKWVYSFGEGKADGDKSMRELLGGKGAGLAEMSGLGLPVPPGFTISTSVCTVFSNNAGQYPVGLLSQVKQALSVVEKQMGASFGGKDHPLLVSVRSGSRASMPGMMDTVLNLGLNDQTVKGLATHSGNPRFAYDCYRRFIQMYSNVVLGVDIDHFEEILESHKRKNGVKLDTELTYDNLKEVIIDY

SEQ ID NO: 25605 - protein, 518 aa, Debaryomyces hansenii CBS767
MIDNDIFQSKIQRSGQIIRKYASFIGPGIMVSVAYMDPGNYSTAVSSGAMYEYKLLFIIFMSNLFAVVLQCLCVKLGTVTGLDLAEMCRMNLPYALNLSLYACAELAIIATDLAEVVGTAIALEILFNIPLVYGVLITVIDVLIVLMAYHKDGTMRQTRLFEIMVTVLVLATCMCFILELFKCDFEEGAVGSIIKGFLPMNMEIFREKNALFLSCGIVGSTVMPHSLFLGSALVQSRLKEYDIQNGILIEQDEVDGELIDVQPELPATTSKFRSISDGSSLAGKYRPSYRAIQYCLNYSYIELVLSLFLIAVFVNSAILIVAGSTLYGKPDAEDADLLSIYEMLSYYISPAAGLIFALSMLFAGQSAGIVCTMAGQIVSEGFINWTIKPWIRRIITRILAIIPVLVVIIILGREGISKIMNSSQVVLSFILPVVSAPLIWFTCKKEFMVVYDTSDLNQLANENTALLNTDESYPQSVHVRKITFENGHFLTIAAGLTWLIISFLNLYLIYAFANGADI

SEQ ID NO: 25606 - protein, 256 aa, Thermotoga sp. RQ2
MDRLDFSIKLLRKVGHLLMIHWGRVDNVEKKTGFKDIVTEIDREAQRMIVDEIRKFFPDENIMAEEGIFEKGDRLWIIDPIDGTINFVHGLPNFSISLAYVENGEVKMGVVHAPALNETLYAEEGSGAFFNGERIRVSENASLEECVGSTGSYVDFTGKFIERMEKRTRRIRILGSAALNAAYVGAGRVDFFVTWRINPWDIAAGLIIVKEAGGMVTDFSGKEANAFSKNFIFSNGLIHDEVLKVVNEVVEEIGGK

SEQ ID NO: 25607 - protein, 590 aa, Burkholderia pseudomallei K96243
MSFTLHGIPVSRGIAIGRAYLIAPAALDVAHYLIEAERIEAEIERFRTALGAVRRELDVLRADLTDDTPTEVAAFIDVHAMILGDAMLVQETIDLIRTRRYNVEWALTEQLDVLAGHFDDIEDEYLRERKADIEQVVERVLKALAGAPSAAQALDRAAGNGRDEMIVVAHDIAPADMMQFKTQSFQAFVTDLGGRTSHTAIVARSLGIPAAVGVQHASALIRQDDLIIVDGDQGIVIVDPAPIVLEEYSYRQSEKALEQRKLQRLKFSPAQTLCGTKIDLLANIELPDDAKAAVDAGAVGVGLFRTEFLFMSKVRMPEEEEQFAAYKRAVELMHGMPVTIRTIDVGADKPLDVHDEGYETAPNPALGLRAIRWSLSEPQMFLTQLRAILRASAFGQVKILVPMLAHAQEIDQTLDLINEAKRQLDAAGLAYDPNVRVGAMIEIPAAAIALPLFLKRVDFLSIGTNDLIQYTLAIDRADNAVAHLYDPLHPAVLHLIAFTLREAKRAGVPVSVCGEMAGDPALTRLLLGMGLTEFSMHPSQLLVVKQEILRAHLKALEKPTADVLASFEPEEVQAALARLASAEPRADVAA

SEQ ID NO: 25608 - protein, 469 aa, Shigella boydii
MILPVIMAGGSGSRLWPLSRTHYPKQFHNLLGKSSLLIDTITRLDNIKHQPPLVICNEDHRFLVAEQFRKHSLSTSGIILEPIGKNTCPAIALAAFQAVKTNEDPYLLVLAADHSIGDRDSFQKAIHQAYETAKTGSLVTFGIIPTSPETGYGYIKKGKSLNKYAYYVDGFKEKPNIILANEYINSGHYLWNSGMFLFKASSFLKELKKFEPKIYRLCEESIDNSTHDLDFIRIDSDAFSNCKSQSVDFAIMEQTKNCAVVPMNADWSDVGSWSALWELSKKDDRNNYFYGDVVAIDCDSNFIRTDEKLTVTLGVKDLIVINTKDALLVAERSCAQKVKDVVAKLNVDYRNEISHYSNEFRSWGEIEKVDSDNKYIVNRIIIKPGAKISKQIHYHRSEHWIVVSGTASIVIDGKESVLTENESTFIKVGQEHSIMNPGLVPLIIIEIQSGSYVSEDDIIRVKEIYNDEC

SEQ ID NO: 25609 - protein, 294 aa, Triticum aestivum
  misc_feature (73)..(73): Xaa can be any naturally occurring amino acid
MPYSIIEIVMKSVYFLCRAILSYLQEIGEKLSEIGGRLDYPLLNKELVQDVRKLWEDQAIQETYSCGSVLQVXLTCAHYFMDNLDRLAEADYVPTKEDVLHARVRTNGVVEIQFSPLGESKRGGEVYRLYDVGGQRNERRKWIHLFEGVDAVIFCAAISEYDQLLFEDETQNRMMETKELFDWVLKQRCFEKTSFMLFLNKFDIFERKIQKVPLTVCEWFKDYEPIAPGKQDVEHAYEFVKKKFEEVYFQSSKPERVDRVFKIYRTTALDQKLVKKTFKLMDESMRRSREGTGT

SEQ ID NO: 25610 - protein, 486 aa, Bordetella pertussis Tohama I
MEDLRNHEFKNYIGGQWVACAAGKTYPNVNPADTDDIVGRFQASQAEDAAAAVAAAQAAFDGWRNLAVSKRAALMQRAADYLEAHAEQFGRELTREEGKALNLAKDEVLRSAQTIRFYAAEGQSFSGETFVNDDPDMVVYSQREPLGVVTVISPWNFPVSIPARKIAPALITGNTVVFKPSSDAPLSGLRLVEAFEQAGLPPGVLNLVTGSASAIGAAITQASQVRAVSFTGSTAAGEQIHRSVDMTTRTQMELGGKNPLIVMADADLDRAVDLVVKGGFSLSGQACTGTSRVLVDAPVKAAFTEKLLAKVKALKVGNSLEGSFDLGPLATARQLESVMRYIEVGKQEARLLCGGERLEGPGYERGYYLTPAVFADVTQQMRIAREEIFGPVIALIEVNGYEDAIAKANDTEYGLAAAIATTNAQYAHRFARDIQAGTVKINRTTTGNLINAPFGGLKRSSTSTFRESGRIGLEFYTQIKTVYRAG

SEQ ID NO: 25611 - protein, 160 aa, Xanthomonas campestris pv. campestris str. ATCC 33913
MTIQVGDRIPEVVLKHLREGIEAVDTHTLFTGRKVVLFAVPGAFTPTCSAKHLPGYVEQFEAFRKRGIEVLCTAVNDPFVMQAWGRSQLVPDGLHLVPDGNAELARALGLEIDASGSGMGLRSRRYALYADDGVVKALFVEEPGEFKVSAADYVLQHLPD

SEQ ID NO: 25612 - protein, 157 aa, Fusobacterium nucleatum subsp. nucleatum ATCC 25586
MEEKMKVFEGKFNGKGTKIAIVAARFNEFITSKLIGGAEDILKRHEVQDDDINLFWVPGAFEIPLIAKKLAQSKKYDAVITLGAVIKGSTPHFDYVCAEVSKGVAHVSLESEVPVIFGVLTTNSIEEAIERAGTKAGNKGADAAMTAIEMINLIKGI

SEQ ID NO: 25613 - protein, 346 aa, Arabidopsis thaliana
MEAKEETPWSSILVPSVQEMVKDKMITTVPPRYVRYDQDKTEVVVHDSGLISEIPIIDMNRLCSSTAVDSELVNHGIDPSFLDKIKSEIQDFFNLPMEEKKKLWQTPAVMEGFGQAFVVSEDQKLDWADLFFLIMQPVQLRKRHLFPKLPLPFRDTLDMYSTRVKSIAKILLAKMAKALQIKPEEVEEIFGDDMMQSMRMNYYPPCPQPNLVTGLIPHSDAVGLTILLQVNEVDGLQIKKNGKWFFVKPLQNAFIVNVGDVLEIITNGTYRSIEHRAMVNLEKERLSIATFHNTGMDKEIGPARSLVQRQEAAKFRSLKTKDYLNGLFSRELKGKAYLDAMRIEGK

SEQ ID NO: 25614 - protein, 534 aa, Sulfitobacter sp. EE-36
MKLISQALPSSESFKANEAAHLAALQTIREAADAAELGGGEKSRARHVSRGKMLPRERVANLLDPGSPFLEVGALAAHGLYGGAAPAAGVIAGVGKVQGIDCMIVCNDATVKGGTYFPMSVKKHLRAQEIAEENHLPCIYLVDSGGANLPNQDEVFPDRDHFGRIFYNQARMSGKGIPQIAVVMGSCTAGGAYVPAMSDVSIIVKEQGTIFLAGPPLVKAATGEVVSAEDLGGGDVHTRLSGVADYLAEDDAHALALARRAVAGLNRAAPMNVQWQPAEDPAYDPAEMLGVVPADLRTPYDIREVIMRLVDGSRFDEFKARFGETLVCGFAHVKGCPVGIIANNGVLFSESAQKGAHFVELCSQRKIPLVFLQNITGFMVGRKYENEGIARHGAKMVTAVASTNVPKITMLVGGSFGAGNYGMAGRAYSPRFMWTWPNSRISVMGGAQAAGVLATVKRDAIERAGDSWTEEEETAFKQPTIDMFEEQSHPLYATARLWDDGVIDPRHSREVLSLSLRASLNAPIEDTKFGVFRM

SEQ ID NO: 25615 - protein, 264 aa, Zea mays
MLPGRHPARRADATGTGPLLPDATRAVVAEFVATAMFVFAAEGSVYGLWKLYKDTATPGGLLAVAIAHTLALVAAVAVASNASGGHVNPAVTFGLLVGRRISFGRAAVYWLAQMLGAVVASLLLTLVSGGTRPVGFGLVRGVHERHALLLEAVMTFGLMYAVYATAVDHRSRGGAVAIAPLAIGFVLGANILAGGPFDGAAMNPARAFGPALVGWSWRHHWVYWVGPLIGAGLAGGLYEFVMVEQEPEAPLAAVPRMPVASEDY

SEQ ID NO: 25616 - protein, 288 aa, Acidovorax sp. JS42
MPPDLIASPPHPMTASASPLPPIAFIGGGNMASAIIGGLLQRGLPAGQIEVVEPFEPARAALREKFGITAQPAAGDALARAALVVWAVKPQTFKEAAAATRAHTATALHLSVAAGIPTDSIARWLDTQHIVRAMPNTPALVGKGITGLFARPQVDPQGKALVERVIATTGQFVWVEAEEQLDAVTALSGSGPAYVFLFLEAMTQAGVDMGLPPAQAYQLAVATFQGASELAARSPESAEVLRQRVTSKGGTTHAAITHLQAAQVPAHFIAAMRAAEARAKELAAEFGA

SEQ ID NO: 25617 - protein, 623 aa, Vitis vinifera
MSGPLDRFARPCFEGANHDERRERKSDFENSEDDRRTRIGNLKKKAINASSKFKHSLKKKGRRKSHDHLLSVSIKDVRDVEELQAVEAFRQALISDDLLPDRHDDYHMLLRFLKARKFDMEKAKHMWTEMIHWRKNFGTDTILEDFEFKELNEVLKYYPQGYHGVDKEGRPVYIERLGKVDSNKLVQVTTLDRYVKYHVQEFEKCFAFKFPACSVAAKRHIDSNTTLLDVQGVGFKNLTKNARDLIMRLQKIDGDNYPETLCQMFIINAGPGFRLLWNTVKTFLDPKTTSKIHVLGNKYQSKLLEIIDASELPEFLGGSCICADQGGCLKSDKGPWKDPNILKMVLSGEAQFSRRIVTVSNSDGRVITKEKPIYSVIKSSDTSTAESGSEVEEFTSPEVTRGYLHPRLTPVREEVRMAGKVNSAGGFSEYDEVPMVDKAVDAEWKKQLSLQDPCDSRGILSLPRAEKTPEGLCAKIWGVLITFFLALATLFHSVASRVTKKLPDSVSNSGHNIPNLTLEPISEEELRPPSPAPRLTEADLFSSVLKRVGELEEKVDLLQAKPFKMPHEKEELLNAAVCRVDALEAELIATKKALHEALMRQEELLAYIDRQEEAKSQKKKFCW

SEQ ID NO: 25618 - protein, 465 aa, Spiroplasma citri
MEKNGKVVQVLGPVVDVRFTEEYLPELYNAITVNNNGTKLVLEVVQHIGDDTVRAIALGPTEGMVRGMDVIDTKAPITVPVGEEVLGRMFNVLGEAIDEKPQPKTKLMRPIHREAPSYEEQQTTAAILETGIKVVDLLVPFAKGGKIGLFGGAGVGKTVLVQELINNVAKAHGGISVFAGVGERTREGNDLYYEMIEAGVIDKTALVFGQMNETPGARMRVALTGLTIAEYFRDDKNQDVLLFIDNIFRFTQAGSEVSALLGRMPSAVGYQPTLATEMGALQERITSTKKGSITSIQAVYVPSDDLTDPAPATTFAHLDAKVVLDREIAALGIYPAVDPLGSSSRLLDPLVVGEEHYEVARGVQEILQKFKELQSIIAILGMDELSDEDKLAVARARKIRNFLSQSFFVAEKFSGKTGKYVPVVETIRAFKEILTGKYDDLPEQAFLYVGTIDEVVKVAEALKHN

SEQ ID NO: 25619 - protein, 211 aa, Staphylococcus aureus
PSADMLFEPSFVNDIDVNENDIVHFCSVDLVDSPMRDAHYQLITKTLNANGTVVFDPNVRLPLWDNAEDLRQTIHTVLPLAHIVKVSDEELEFITGIHDENEAIQSLFTGNVTVVIYTMGADGAAVYLKNGINHYHSGYKVKPVDTTGAGDAFIGAVISRILATDVLNLTQLFENEGEEILEFSNRVAAIVTTKYGAINSLPTLQEVEQAF

SEQ ID NO: 25620 - protein, 160 aa, Frankia sp. CcI3
MSGLGAPAEVLPPVAGMRLAVVATRWHAEITDALLAGALRAAKDAGLAAAPAVVRVSGAVELPVIAAALAARHDAVVALGVVIRGGTPHFDYVCQFVTAGLARVTLDARVPVGFGVLTCDTVEQARDRAGLPGSSEDKGREATLAALDTAAVLRDLELAG

SEQ ID NO: 25621 - protein, 506 aa, Frankia sp. CcI3
MTTSAAGASSTATLPAGALPAGYADVRFAAIEDALAEIAAGRPLVVVDDADRENEGDLIFAAEAATPELVAFMTRYTSGVICVPMDAADTDRLELDQMVPHNTERMGTAFTITVDARDGVSTGISAADRARTIRLLADPRTTPGDLSRPGHIFPLRAKDGGVLRRPGHTEAAVDLARLAGLRPAGAICEIVNDDGTMARLPRLAEFAREHGLLLISIADLIAYRRRTEKQVVRVAEASLPTRYGAFRAVGFRNILDGVEHIALIRGELGDGADVLVRVHSECLTGDVFGSRRCDCGTQLDAALRIIATEGRGVVLYMRGHEGRGIGLMHKLRAYQLQDAGHDTVDANLALGLPADARDYGTGAQILVDLGVRGIRLLSNNPTKRAGLEGYGLRIVELIGMPVTQTPENLRYLTTKRDRMGHVIPGLPSIPGLPSIPGPPGLPGPPGLPGPPGLSDLPRAVGEDEPAGSRWIPGAPRAPRVPVTSGCTAVAGPGTSAGVDCAEGEGL

SEQ ID NO: 25622 - protein, 240 aa, Zea mays
  misc_feature (87)..(87): Xaa can be any naturally occurring amino acid
MKLNISYPANGSQKLIDIEDERKVRVFMDKRMGAEVPGDSVGDEFKGYIFRITGGNDKQGFPMKQGVMHPTRVRLLLSEGHSCYRPXRRTGERKRKSVRGCIVAMDLSVLALSIVKQGDADIPGLTDVVHPKRLGPKRATKIRKFFGLTKDDDVRKYVIRREVQPKGEGKSPYTKAPRIQRLVTPQRLQHKRHRAALKRRQAEKVKDEANEYAQVLAKRIAEAKVNKADARKRRARPMRK

SEQ ID NO: 25623 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPPAKVIHDKYTIIEGLMTTIHSYTATQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVVSTDMNGDLHSSIFDAKAGISLNINFVKLVSWYDNEWGYSRRVLDLLAYMAKVDGNA

SEQ ID NO: 25624 - protein, 236 aa, Frankia sp. CcI3
MATAQIYPSLLAADFGRIADAALAVEGQADWLHVDVMDYHFVPNLAFAPDTVTALRAVTDTPLDCHLMIDDPDRWAAGYAERGAANVTIHAEAVSDLPRTTRAIRAAGARTGLAVKPNTPVEHYLDDLHRFDLLLLMTIEPGFGGQTFMTEVLPKIEAARRLLDARGLDLWLQIDGGVNAGTIERAAVAGVDVFVAGTAVFGAADPGQAVERLREQALRAAPRLSPPAPRSAVGPA

SEQ ID NO: 25625 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKTEVVSNASCTTNCLAPLAKVIHDKYTIIEGLMTTIHSYTATQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVVSTDMNGDLHSSIFDAKAGISLNNNFVKLVSWYDNEWGYSRRVLDLLAYMAKVDGNA

SEQ ID NO: 25626 - protein, 835 aa, Oryza sativa Japonica Group
MASSSPLCCYLLLFVVVVVLTGSCRARDTVVPGRPLAANETLVSGGDANFVLGFFTPPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKGKLEDGQEIAVKTLSKTSVQGLDEFKNEVMLIAKLQHRNLVRLLGFSISGQERILVYEYMANKSLDYFLFARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 25627 - protein, 131 aa, Triticum aestivum
AAARAGECFKWIKERHGGPNVRFCAVGDGPEERSAASIMKWPFVKIEIRPDAPHRFPGLSLSTIHGIMDAVYQSSAATTLDLRCARRRICLEASIAVDAEASQVIVQGNRIVEIPSIEAYCPPCLEDSETL

SEQ ID NO: 25628 - protein, 378 aa, Zea mays
MAKPPRAPRPKLQTPRAPARRLLGLGGLGVAAAAYVGVDYLRHLSPAWHGRLQPALWAVLALAAAARAPFYRHWSAELRAALPFLGSIAFMLAAFLCEAISVRFVSAVMGLHWHRSLLLILPRLPSPSDGLLLWVLFDCIKAPGLGIATRYMFTMAIGRKYYVPYASDSNAIRRVITQDMAYAAVQAYPDEYKPDWGRMSFLVDILRPTPGEGPSWYHLLKKASGGCNDLMYSGHMLVAVLTAMAWTEAYGGWISVAIWLLVLHSAQREVRERHHYSVDCVAAIYVGVLLWRMTGFIWSARDLARARRLAKLEEVQSRLVHAAKDSDIDEIRGLLKEVELSGQERQGFSQRAILAFAAGTIIFTLSCVLIAFTATSDG

SEQ ID NO: 25629 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVITKYGAINSLPTLQEVEQAF

SEQ ID NO: 25630 - protein, 458 aa, Zea mays
FLAPPPPTTAAAVGAARRELSAASLAVVDGEARYLVGTYKRSRVVFEHGRGCKLYDTDGREYLDMAAGIAVTALGHADPDVCATIAEQAGKVVHVSNVFLHQTPGWCSCSLRSSLPRFPRHVFDALLRPARFSLVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLAKPLANGIPIGVVLVKEKIAAAINYGDHGTTFGGGPLACQTAITVFDKITRPGFLAEVSRKGESFKQLLRAKLSGNPHVREVRGVGLLVGVELDVPAGPLVDACLDAGVVVLTAGKGNVVRLVPPLIVSEKELEHAADVIRDCLPALDVVAAA

SEQ ID NO: 25631 - protein, 390 aa, Legionella pneumophila str. Lens
MKAKVILVNGKQNTVLRGHPWIFPKAIAQYSGKLITGELVEIIGSEGESLGFGAYNEHSLYRVRVLALSNEQINSFDYKSLITHRIKQASLVRRCLDLPNEQTNAYRLFNSEADGLSGLTIDCFNDYCVIASSAYWVELNKSIIVHVLQELLPHNHIIWLPQNKPLSQDGWKEIHTEKSQGSTQVLEEGVLYHVEFAQTQKTGLFLDQRENHKRIAKLSRGKRVLDLYTFTGGFALHAAKAGALHVTAVDSSAQAIEQAKNNAVLNHLNTIEFIKADAREYLKMAGEYDVVILDPPKLVPSQKHLQQAKNYYRFLHREAFKYMKPGSLLMTCNCSSALSSQDFCSLVSAQAVAMGKQARILGVYGPASCHPTLAAFPEGNYLTAVLLALV

SEQ ID NO: 25632 - protein, 346 aa, Rhodopirellula baltica SH 1
MKALLLTEYKNMQVTDVDEPEVGPDDVLVQVEACGICGSDIHGYDGSTGRRIPPLVMGHEAAGVVVQVGENVRDLELGARVTFDSMVSCGNCEFCREGHGNLCDNRMVLGVSCGDYRRHGAFAERISVPRRIVYRLPDTLPFEHAALVEAVSVAVHAAEVTPIKLGDTAVVVGAGMIGLLAVQAVRAAGATQVIAVDLNDKRLETAGTLGADVLLRADQVDVPEKVRELTGGRGADVALEVVGATPTVKTAIESVRKGGAVTLVGNVSPTIELPLQSVVTREIRLQGTCGCNGEYPQCIDLMNRGVINVEPLITAKISLADGPKWFDRLHAGDAEQMKVLVCPRSE

SEQ ID NO: 25633 - protein, 800 aa, Arabidopsis thaliana
MDEDVEQASLMSFNDRPRAFPNMRSKTYSPLIFRIIRKLNVRVLSIILLFCFGAIFYMGASTSPIIVFVFTVCIISFLLSIYLTKWVLAKDEGPPEMVEISDAIRDGAEGFFRTQYSTISKMAILLAFVILCIYLFRSLTPQQEAAGLGRAMSAYITVAAFLLGALCSGIAGYVGMWVSVRANVRVSSAARRSAREALQIAVRAGGFSALVVVGMAVIGIAILYSTFYVWLGVGSPGSMNVTDLPLLLVGYGFGASFVALFAQLGGGIYTKGADVGADLVGKVEQGIPEDDPRNPAVIADLVGDNVGDCAARGADLFESIAAEIISAMILGGTMAKKCKIEDPSGFILFPLVVHSFDLIISSIGILSIKGTRDASVKSPVEDPMAVLQKGYSLTIILAVITFGASTRWLLYTEQAPSAWFNFALCGLVGIITAYIFVWISKYYTDYKHEPVRTLALASSTGHGTNIIAGVSLGLESTALPVLTISVAIISAYWLGNTSGLVDENGIPTGGLFGTAVATMGMLSTAAYVLTMDMFGPIADNAGGIVEMSQQPESVREITDLLDAVGNTTKATTKGFAIGSAALASFLLFSAYMDEVSAFANVSFKEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 25634 - protein, 249 aa, Burkholderia pseudomallei K96243
MYKLVLIRHGESTWNKENRFTGWVDVDLTEQGNREARQAGQLLKEAGYTFDIAYTSVLKRAIRTLWHVQDQMDLMYVPVVHSWRLNERHYGALSGLNKAETAAKYGDEQVLVWRRSYDTPPPALEPGDERAPYADPRYAKVPREQLPLTECLKDTVARVLPLWNESIAPAVKAGKQVLIAAHGNSLRALIKYLDGISDADIVGLNIPNGVPLVYELDESLTPIRHYYLGDQEAIAKAQAAVAQQGKSAA

SEQ ID NO: 25635 - protein, 206 aa, Rhodopirellula baltica SH 1
MTTNDTESKPTAKPSASNASDRIRREAVVTVEPDQQLIDPSAFIAPNATVLGEVYIAADVSIWFGAVMRGDTEKIVIGRESNVQDQCVLHCDPGMPCLIGERVTVGHSAIVHGATVEDDALIGIGAIVLNGATIGKGAIVAAGALVTEGTVIPPGMLAVGAPAKPIKEVSDSLRERSREGAQHYVKLGGRYRDEFAGTNVTSGKVD

SEQ ID NO: 25636 - protein, 356 aa, Ustilago maydis 521
MSTASTSSSSKKHKVVIVGSGNWGSAIARIAGQNTQRHSDTFQREVQMYVFEEDYNGKPLSQVINETHENPKYLPGCKLPDNVIANPNPVDAVKDATLLVFVLPHQFIRSVCKQLKGHVNPDAHAISMIKGVEVKDGKISIFADVIQEALGVSCSALSGANIANEVAQDKFSETTIGHRPDAKGRENAELFFKLFDTPTFKVGIIEDVAGVSLCGALKNVVAIAAGFTDGLGWGDNAKAAVMRIGLMEMKRFSEEFFEGIKPETFTETSAGVADLITTCLGGRNRKCAEAFVKTGKPFDQLEKELLNGQKLQGTETAREVHELLAARGKVDDYPLFKAVYSIAYEGIDAHDLTSRL

SEQ ID NO: 25637 - protein, 399 aa, Fusobacterium nucleatum subsp. nucleatum ATCC 25586
MIYKIEDVLEDIKNGIPLIIVDDENRENEGDLFVAAEKATYESINLMATFARGLTCTPMTSEYAIRLGLDPMTARNTDAKCTAFTVSVDAKEGTTTGISIADRLTTIKKLANKNSVPSDFTKPGHIFPLIAKDKGVLEREGHTEATVDLCKICGLTPVSVICEILKDDGTMARMDDLEIFAKEHNLKIITIADLIKYRKKTEQLMKIDVVANMPTDSGTFKIVGFDNLIDGKEHIALVKGDVAGKENVTVRIHSECFTGDILGSLRCDCGSQLKTAMRRIDKLGEGIILYLRQEGRGIGLLNKLRAYNLQEEGMDTLDANLHLGFGADMRDYAVAAQMLKALGVKSIKLLTNNPLKINGLEEYGIPVVKREEIEIEANKINKVYLKTKKERMGHLLKIK

SEQ ID NO: 25638 - protein, 638 aa, Ustilago maydis 521
MAPKAYTLLTAQPSNVATTVQSKAAKAKATKPASKPASKEIAKKPTANGAKAESAKRGTKRAKDAEEEEDELQEDDAEAKDTAAPLPDLKKRNGKGRAASAEPISDVDMADGAARPIKRSRRAATPAGPINSVPRPIQPVHADDVTEGIAVEVSTGIRATSGKGAVLPRKLFVWGSGDAGQFGVGPPEDDKPNKLNKPKPFGNKEISMQIDDGDFGEGGIELIVGGGMHSVLIDNLGRILTSGAEDYGTLGRKYRGDSDDAEEAYFNFAPVEGLSPTGKGINPIDGKKGSVEKYRATRVASADAAGAVLDDQGRLRSWGYFKDGEGRVCFADSDAPGRNREQWYPIALPGIENETFAAVAAGENHFLALSLNGKVYSWGTNTCYQLGRSSNPRRVAQKFSKGEPPKECDLTPTPMVGLAECKRIFCGLTNGFAVEKSGKVVGWGLNTKGQTGTGLKAIKVATPHVIAALSPARHNGAEVVQIVGGNFHTVFLLANGEVYICGDSDEGKLGLPAGHPALKGATAANPVVVREPTLVPFPAPPSWAPKSAKTEDGKTKIVALSAGMRFTLALAADGTLYSWGTTSDDALGHPAEDVGGNQSKDTPTAIAMPGQPGAWRIMAAATAGQHSLAIAIKPPQDD

SEQ ID NO: 25639 - protein, 332 aa, Burkholderia pseudomallei K96243
MKVAVLGAGAWGTALAAHLAVRHDTLLWARDAALVAELAARRENARYLGGVALPPGLRYEADLATALSHAQADDALCVIAAPVAGLRALCRAMRDARRVPAHFVWVCKGFEADTRRLPHQMVAEELPDHASYGVLSGPSFAREVAQGLPVALTVASASAACRERTLAAFHHGAMRIYTGDDVVGVEVGGAVKNVLAIATGIADGLGLGLNARAALVTRGLAEMSRLGVALGGRAETFTGLTGLGDLILTATGDLSRNRSVGLQLAAGRSLDDILAALGHVAEGVRCARAVLSIARERGVDMPITEAVCAVLFDGVAPRDAVSGLLRRDAKAE

SEQ ID NO: 25640 - protein, 447 aa, Bordetella pertussis Tohama I
MKLQSLDDFLRRVAARDPQQAEFMQAVQEVMLSLWPFIEKHPHYAEHALLERLVEPERVIQFRVCWTDDQGQAQVNRAFRIQHSSAIGPFKGGMRFHPTVNLSVLKFLAFEQTLKNALTTLPMGGGKGGSDFDPKGKSDAEVMRFCQALMLELHRHLGPDTDVPAGDIGVGAREVGFMAGMMKKLSNSAASVFTGKGLCFGGSLIRPEATGYGTVYFAQEMLQRAGLSFDGMRVSVSGSGNVAQYAIEKAMALGAKVVTISDSCGTVIDEAGFTHEKLLALMHIKNDLRGRLDTYASQFGLRYEAGVRPWHVPVDVALPCATQNELDENDARTLIRNGVKCVAEGANMPATLDAAKAFIAAEVLYAPGKASNAGGVAVSGLEMSQNSARLPWTREQVNARLHAIMRDIHENCVRHGHGAGNYVNYVDGANIAGFVKVADAMRQQGLY

SEQ ID NO: 25641 - protein, 271 aa, Physcomitrella patens subsp. patens
MEEGPTLLEAHNVRAIGMGEEVVVLGHGFGTDQSVWKHVIPHLVDEYRVILFDNMGAGTTDPEYFSFSRYSTLHGYADDLLSILEELEVESCIYVGHSVSGMVGFLASLERPEIFSKIITISASPRYLNDMDYFGGFEQDDLNQLFEAMQSNFEAWVSGFAPLAVGADIDSMAVQEFGRTLFNIRPDIAFSVAKTIFQSDLRIVLPNVTVPCHILQSSKDLAVPIVVADYLHHTLGGPTIVEVLQTEGHLPQLSSPEIVIPVLKRHLAGSL

SEQ ID NO: 25642 - protein, 382 aa, Candida albicans
MDPNLISHYNNTNTRRFKNYQIENQGQSNFIYFLGGRLHTIKTKYPINLITLSLIIIPGILYIIFELSWQWRNFSPIIVIIFLYIWIISIFHFFKLSTGDAGKLPKNIHLPKKLITITTTTTTTNDNEIDHRNNYKVRGSPPDEYFNTVTLPYWKTNNDNNDNTKISKLANAYHSHGVQVKYCGTCHIWRPSRTSHCNTCQQCILNHDHHCIFLNNCIGQRNYKFFLWFLLYIVIACLYLLIISILQLCHYKFASHKESEIITTFNQSIKTHPISLLLLIYSCLAICYPGLLLAFHIFLTSQNITTREYLNFVYKKPSKSTDGGDGTRGFVNVYNTHSIWENLYINWLGKSNGVSLTFPRDYYHQGDIRFANIEPLGTFTNK

SEQ ID NO: 25643 - protein, 178 aa, Thermosynechococcus elongatus BP-1
MAVFEGTYQVLGTPRFGIVISRFNDLITTKLLEGCQDCLRRHGVDPNPHGSQVDYAWVPGSFEIPLVAAQLAATRRYAAIICLGAVIRGQTPHFDYVAAEVTKGIATASMQTGVPIIYGILTTDTMQQALERAGIKSNKGWEYALNALEMANLMQTLPSAINPPTTKLSSSTRILTDG

SEQ ID NO: 25644 - protein, 374 aa, Bacteroides fragilis NCTC 9343
MNLFDVYPLFDINIIKGKGCHVWDENGTEYLDLYGGHAVISIGHAHPHYVDMISKQVATLGFYSNSVINKLQQQVAERLGKISGYEDYSLFLINSGAEANENALKLASFHNGRTKVISFGKAFHGRTSLAVEATDNPKIIAPINANGHITYLPLNDIEAAKTELAKEDICAVIIEGIQGVGGIKIPTPEFLQELRKACTEHGTILILDEIQSGYGRSGKFFAHQYAGIKPDIITVAKGIGNGFPMAGVLISPMFTPVYGMLGTTFGGNHLACSAALAVMDVIEQENLVENAANIGSYLLEELKKFNEIKEVRGCGLMIGMEFDQPVKEIRSRLIHEQKVFTGASGTNVIRLLPPLCLSKEEADEFLARLRKVLG

SEQ ID NO: 25645 - protein, 386 aa, Arabidopsis thaliana
MTTISDLPYDLLPEILSRLPTKSIPKLKTTCKKWYALFKDPKFVEKKLGKAARETVFLMNHEVNSISVDIHGIPKGYSVSMDFTGTLTIPEGSDLEIFRIHHCNGLFLCATMNCRLVVWNPCTGQITWIIPRTRYDSDDIYALGCGDDKSSSLHSYKILRCCDDNQKKPVSEIYDFSSSSWRVLDGVTANCFIECNGVALKESAYWYASDKRETPKGKFILRFDFATERFARLCLPLNFQRDRDNKSVVVSVVGEEKLALLQQFDHRVHGLKYSKIKIWVTDTKIGEGKDLSWSNILVEELADDNLPSVTSFLLDEEKKVAVCSDAVCSDTDTEDEDRRRIYIVGEGVDEFVYDEVSTETSHNWPFLVSYVPNLVHIEKDAPIVEV

SEQ ID NO: 25646 - protein, 151 aa, Physcomitrella patens subsp. patens
MDLERTFIAIKPDGVQRGLISEIIGRFERKGYKLVAIKLIVPTKEFAAQHYDDLSSRPFFNGLCDFLSSGPVVAMVWEGQGVIKYGRKLIGATSPQASEPGTIRGDLCVQVSRNIIHGSDGPETAVNEIGLWFKPEELVSYTKNDEKWLYE

SEQ ID NO: 25647 - protein, 532 aa, Acidovorax sp. JS42
MTSDTSTPLATVRADLLARLAQPVTYDLAVVGGGATGLGVALDAAARGFSVVLLESHDFAKGTSSRATKLVHGGVRYLAQGNIALVREALHERTTLLRNAPHLAQPLAFVMPSYKVWETPFYGVGLKMYDALAGKAGLGPTEFLGRMETLRCLPTAMADGLKGGVKYWDGQFDDARLALALARTAAQRGALLLNYCPVDDLLYDGGKVAGVVCQDAETGRRYEVRARCVVNATGVWVDALRQRDGDVSGQPVKPMVAPSQGVHIVVDREFLPSDHALMVPKTADGRVLFAVPWLGKVILGTTDSPRQDLAREPQAMREEVAFILGESARYLRRAPQASDVRSIWVGLRPLVKPSDEDAAATKSISREHTVLASRSGLVTVTGGKWTTYRAMAEDVLLKCMDEHLLPRRPGGITVALPLVGAGATRERQGMNAPQGLHSYGDEAARVQALPGSQVQLAEGLSEAMVRFAARHEYARTVEDVLARRSRVLFLDARLAAALAPRVADILREEIPGQDPQLPAFLELAAHYATVPA

SEQ ID NO: 25648 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPLAKVIHDKYTIIEGLMTTIHSYTATQKTVDGPSAKDWRGGRTAAQNIIPSGTGAAKAVGKVIPDLNGKLTGMSMRVPTANVSVVDLTVRIEKGASYDEIKATIKAASEGELKGILGYTEDEVVSTDMNGDLHSSIFDAKAGISLNNNFVKLVSWYDNEWGYSRRVLDLLAYMAKVDGNA

SEQ ID NO: 25649 - protein, 265 aa, Chlamydomonas reinhardtii
MQALQMRSSSKAVGARSAKPSRASAVRVQATSRVDKCKKSDIIVSPSILSADFSRLGDEVRAIDQAGCDWVHIDVMDGRFVPNITIGPLVVEALRPVTDKVLDVHLMIVEPELRIPDFAKAGADIISVHAEQSSTIHLHRTLNMVKDLGCKAGVVLNPGTSLSTIEEVLDVVDLILIMSVNPGFGGQKFIESQVAKIRNLKRMCNEKGVNPWIEVDGGVTPENAYKVIDAGANALVAGSAVFKAKSYRDAIHGIKVSKAPANVMA

SEQ ID NO: 25650 - protein, 519 aa, Vitis vinifera
MDSCCAKVKGNVHPVPVRNRGSGFWGERIGTSLWSSSFSNRQWKSLRKERKAKTINRAVLTPDVDQENLIFEGPVFEKQHADPSSVAAIILGGGAGTRLFPLTSRRAKPAVPIGGCYRLIDVPMSNCINSGIRKIFILTQFNSASLNRHIARIYNFGNGVNFGDGFVEVLAATQTPGEAGQKWFQGTADAVRQFIWVFEDAKNKNVEHILILSGDHLYRMDYMDFVQKHIDSNADITVSCVPMDDSRASDYGLMKIDNTGRIIQFSEKPKGPNLKAMKVNTTLLGLSEKEAEKCPYIASMGVYVFRTDVLLKLLTRKYLSCNDFGSEIIPLAVKDHNVQAYLFNDYWEDIGTIKSFFDANLALTEQPPKFEFYDPKTPFYTSPRFLPPTKVEECRILDAIISHGCFLRECSVQRSIVGVRSRLEYGVELKDTMMMGADYYQTESEIASLLAEGKVPIGVGQNTRIRNCIIDKNAKIGRDVVIANADGVQEADRPSEGFYIRSGITVILKNATINDGTII

SEQ ID NO: 25651 - protein, 528 aa, Xanthomonas oryzae pv. oryzae KACC10331
MTTHAATTQGKFHKRLSLTDLTFIGLGSIFGSGWLFSASHVSSIAGPAGIVSWILGGIAVLLLGLVYCELGAALPRAGGVVRYPEYSHGALLGALTGFITLIAFSSLIAIEVEAARQYAAAWFPSLSQANSTHPSVWGWLVQLALLVLFFLLNYFSVKTFALANNIVSIFKFLVPILVIVLLMRHFNADNLTVHGVAPSGMAGVEAAISAGGIIFAYLGLTPIVSVASEVRDPQRNIPIALILSVALSTVIYVLLQLAFLGSIPAGQIAQGWTGIDKAFSLPYHDIALALGMAWLATLVICDAVVSPSGTGNIYMNATPRVVYGWARSGGFLPGLTRVHPVSGIPRPALWLSLGLSIFWTLPFPSWETLIGVVSAALVLSYAVAPVAVAALRRSAPALPRPFFVRGLTVLGPLSFMVAALIVYWSTWPTLSWLLGLQVLAFALYVLYRLPSREGRTRLLRQVCASLWLIVFFVLVMLVSWAGTFGGHGWIAYPFDTLSVAAIAFFIYHWGARSGLRSDELALEEDDGE

SEQ ID NO: 25652 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPLAKVIHDKYTIIEGLMTTIHSYTAAQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVLSTDMNGDLHSSIFDAKAGISLNNNFVKLVSWYDNEWGYSRRVLDLLAYMAKVDGNA

SEQ ID NO: 25653 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADVPMFVMGVNEKTYDPKIEVVSNASCTTNCLAPLAKVIHDKYTIIEGLMTTIHSYTATQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVASTDMNGDLHSSIFDAKAGISLNNNFVKLVSWYDNEWGYSRRVLDLLAYMAKVDGNA

SEQ ID NO: 25654 - protein, 269 aa, Vibrio angustum S14
MREIDTPASDSYNQRFGGTRRLYGNSEVDILRAAHVCVIGIGGVGSWAAEALARSGIGELTLIDMDDVCVTNINRQIHAMTGTVGKSKIEVMAERIHLINPECKVNLIDDFITPENQAEYLSKDFDYVLDAIDSMKPKAALLSYCKSNKIKVITTGGAGGQMDPTQIQIADLTKTIQDPLAKKLRDTLRRHHNFPKNPKRKFGIDCVFSTEHLKYPQADGSVCAVKATAEGPKRMDCASGFGAATVVTATFGFVAVSQILRKLIEKHKP

SEQ ID NO: 25655 - protein, 328 aa, Venturia inaequalis
FGRIGRIVFRNAIEHGDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPLAKVIHDKYTIIEGLMTTIHSYTATQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVVSTDMNGDLHSSIFDAKAGISLNNNFVKLVSWYDNEWGYSRRVLDLLAYMAKVDGNA

SEQ ID NO: 25656 - protein, 406 aa, Vibrio angustum S14
MTTQFDISTILAQFPALQHIDGELPPVYLDSAATAQKPAVVIDTITEYYHGYNANVHRGSHSLTADATLRFEQARETVQHFIGAAHSKEIIWTRGATEALNLIAQTYARANLTAGDEILVSELEHHANIVPWQMIAAETGARVIKIPMRDNCTLDLDAFYSLLSDKTKIVAVAHITNVTGTRNPIEEIIHAAHQHNAIAVIDGAQGIAHEDIDVIALDADFYVFSGHKIYAPAGIGVLYGKQALLEAMPPWHGGGKMVEKVSFEGTTFAALPGKFEAGTPNVAGCLALAAAINWLKQLDRQGAEAHIENLRHKAIEGIKNIDGLRIIGLQPKASLFSFVVDGVHHQDIATLLDQQNIALRAGHHCAHPMLDALGLTGTLRVSLALYNTEQDVERFIAALHKACDLL

SEQ ID NO: 25657 - protein, 421 aa, Frankia sp. CcI3
MSTPTTTPTRAVLMLEDGRSFVGEAYGAIGETFGEAVFSTGMTGYQETLSDPSFHGQVVIMTAPHIGNTGVNDEDYESERIQVAGFVVRDPARRASNWRARGTLDDELAAAGVVGISGIDTRALTRHLRELGSMRCGISSVLDADADADADGGPVGPGPGSGADGERAAALDALLDRVRASPEMLGADLAPRVSTPTPYVVEAVAGAALFKVAALDLGIKRATPAAMAALGCEVHVLPARTTGEQLLALEPDGVFLSNGPGDPAAADYAVDALRTVLRAGVPVFGICFGHQLLARALGFETYKLTYGHRGVNQPVGDMATGRIAVTSQNHGFAVRAPLTGVTDTPFGRVVVSHRGLNDNVVEGLECLDVPAFSVQFHPEAAPGPHDASPLFERFRALMADTREGGRERSERSVREAGHAEA

SEQ ID NO: 25658 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPLAKVIHDKYTIIEGLMTTIHSYTATQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVVSTDMNGDLHSSIFDAKAGISLNNNFVKLVSWYDNEWGYSRRVLDLLAYMAKVDGNA

SEQ ID NO: 25659 - protein, 508 aa, Arabidopsis thaliana
MASVSLLDVAIAIICLFFFYYMYFKKPHGQVFRNWPVIGMLPGFLMVLHRIYNFGVEALEMSHLTFLFKGPWFAEMDMLFTVDPANIHYILSSNFSNYTKGADFKEVFDVFGEMIFSSDSELWKNQRKAAQFMLNHQGFQKLSLSATRSKLYDGLVPLFNQCCEEEKVVDLQQVFQRFTFDTTFFIVTGFDPKSLSIEMPEVEYAKALDDLGEGIFYRHIKPKFFWKLQNRFGLGQEKRMTEADATFDRVSAKYILAKREEIRSQGIDHHANGESEDLLTSHIKLDTTKYELLNPSDDKFLRDTILAFNLAGRDTTSSALSWFFWLLSENPQVVTKIRKEIIDKNISKDGRNGQENLDKLVYLHAALYESMRLYPPVAFQRKSPIKPDVLPSGHKVEANSVIIIFLFALGRMRAVWGEDATEFKPERWVSESGGLRHAPSFKFLSFNAGPRTCPGKQLAMTLMKTVVVEILQNYDIDVIKGQKIEPEPGLMLHMKHGLRVTITKRCSA

SEQ ID NO: 25660 - protein, 483 aa, Ehrlichia ruminantium str. Gardel
MSIPVTVAYGDGIGPEIMEAVLLILSEAKSGLVIETIELGHNLYKKEWSCGIAPSSWDSIHRTKVLLKSPTMTPQGQGHKSLNVTLRKKLGLYANVRPCISYHPVIKTKYPNLNVVIIRENEEDTYTGIEHRLTSDTYQCLKVITRSGSERICNYAFQYAITHNRKKVTCLVKDNIMKMTDGIFHKSFSKIAEGYPSIISDHYIVDIGMARVATNPENFDVIVTTNLYGDIISDIVAELSGSIGLAGSANIGDNYAMFEAVHGSAPDIAGKNIANPSGLLSAAIQMLVYLKKFNEAELIHNAFLKTLEDGIHTADIYQDNISKEKVSTMDFAKAVVENFGQSPCNIQKPVLSIMNSTSGTTSVPYVYQPSYTDKILVGVDVTIGCDVIDLNLNQLIVDLRNIKHDQLELVLVHSKGLEIWPDESSTVNLSYVDQICCRFYMKCKSEIIHDHVNQLLLELDKKKINVVKMEKLYLYDDQPGFFT

SEQ ID NO: 25661 - protein, 284 aa, Physcomitrella patens subsp. patens
MSGANPPAVTLLQNIARAAIALGAGGSLLNTSLYTVDGGHRAVLFDRFRGVLDETASEGTHFLIPILQKPYIFDVRTRPRNITTVTGTKDLQMVNLTLRVLSKPDPERLPTIFKTLGTDYDDRVLPSIGNEVLKAVVAQFNADQLLTERPYVSALVRDALIKRAKDFNLLLDDVAITHLSYGAEFSRAVEQKQVAQQEAERSKFIVMKADQERRAAIVRAEGESEAAKLISDATASAGGGLIELRRIEASREIAATLAKSRNVVYLPSGNNMLLGINPSISNSS

SEQ ID NO: 25662 - protein, 278 aa, Triticum aestivum
MSFCRLEPRDNGVFVLTLASADEHNYLTDEAITELAEELEKVRNSPEVKGLVTTCEVGTFCAGLDYDHHAESEEQAENLAKRVAKVIRLLLELPVPTVAAVRGDARSVGLALVLAHDHLFVWDQAVLGLPEAQRGRPLPDYVPTLLRDKLSHARLRKLLMLNSQTCTGKELTGTWLSTDGADGNRQVVLDKAIDLLHDLQVGDGANFAKARQMLCAETCAAVGITHAELGSHKAADPSWTLFRTKMDDLVLKEEEEEEEEEEEQEQRSYSTRSCSMGS

SEQ ID NO: 25663 - protein, 601 aa, Emericella nidulans
MAFQFSNNPESNETTNNPAPHVLGLPRPPSVGGISSRVTDMSEDGDQSQTNTMSSHVPHRHSVSRRGPPPARSSIASTSQITNRPGSSASRLSRTHIPSLAASGFFRPMSSQRLQAHRGRPATNHTVSTEDWGDQMNQNRRSLISNSTFPNSLSAADQEVPPSRGTEFTDPIIPDRIHSNASPTANTTTVRSESANLIRDRERPPHLNLKVDYKGTNENETPERSPLSFLSLQNRNAPADNRDSRAHARLSSADSSPQSIEKKPELAKSRNKGRNYEYFVGNTIFLGGGRFQNSRDKPVNIATGLLVLVPTGLFFGFSGPWLWHNISPAIPVLFAYVFYLCFSSFIHASVVDPGVIPRNLHQMPPVDPSQDPLAIGPPTNDWVMVKLATSDVAAMDVPVKYCKTCSIWRPPRCYHCRVCDNCIETLDHHCVWLNNCVGRRNYRYFFAFVSTSTLLALFLLGASLAHILVYRSREGISFSDAIDKWRVPFAMVIYGALAAPYPASLWAYHLFLVGRGETTREYLNSHKFAKADRHRPFTQGNVIRNWIAVFGRPRPPTYMQFKEYYQEGDQRLSTVKRRFLPRNTEPQNDIEMQHVPPPNSA

SEQ ID NO: 25664 - protein, 143 aa, Ehrlichia ruminantium str. Gardel
MLERTLSILKPDVVKRNIAGQVNSYIENSGLKIIIQKMCLLTRYQAEKFYEIHKSQVFFVPLINFMISGPVVVQVLEGENAISLYREVMGATDPKKANSGTIRGDFAENIDANCVHGSDSLENAIREIRFFFSEYELLSLYEC

SEQ ID NO: 25665 - protein, 408 aa, Yarrowia lipolytica
MDFYTPPTTAGPPTRGSPESVPTTAASTFPLRKRTRAHLRARDKSDGPAPSSRGTSDRLWSWVFLKQPLSLPEHNYQAHLGNNVFLIGGRFLSARQKPLNIAVLCVILILGGLYYGFVAPWTWNHISPAIPAVFTYIFLLCVASFLRASFSDPGILPRNIHLTDRIADGSIPNEYSVEPGIDAFDPRKNTTSLSCFKQPESSENLVYLKYCSTCKIWRPPRASHCSDCDNCVDFHDHHCIWLNNCVGRKNYRYFVAFVMTGGLCGLYIVGNSIAHVICYKRHMHMTIAESLRHRPMPLVMIFLGFLGAGYPLALVGFHLWIASRGESTHEFVSMNPVTKHVVDGHVGVTLSKCKVMGSHDGFKRFSDAVLAVVCARLCAHVSPHSNPVTKQTTPQGVQKSTFRHWKRF

SEQ ID NO: 25666 - protein, 154 aa, Glycine max
MEDEINRELDLLPSSRSESSLLRLRSAVSSSSTTDCGGGGGGGATPSLDLQLSISVRPPAAVLMCDGVDALKWQAAEQIRLAAMEKAYAERVRELTRREMEMAQSEFARARQMWERAREEVERAERIKERATRKVDSTCMEITCHSCRQRFRPA

SEQ ID NO: 25667 - protein, 415 aa, Magnetospirillum magnetotacticum MS-1
MSGSSHRLVVIGANHRSASLSLRDALFVDDAGATTFLEGLKRAGLAEAMVLATCDRVEIWAEDRDPVHAAKLVGEALAAKAGLEPSVLAPHLYTLSGGEAVRHGFSVTASLDSLVIGEPHVTGQVKAAHRLARDAGCCGGELDHFLQAAFAVAKRVRSETSIGEGPVSIAAAAVQTARDVHGDLGGLRALLVGTGEMGELVAESLLAAGLKDISVTAPRAARAEAVAKSLEGHVLAFEDLRDGLASFDVVLTCVGARTVSVTSEMVTNALRKRRRKPVFLVDAGIPGDIEPAVNRVDGAFLYDLADLEKVALEGRATREAAARAARDIVEAEAQGFLRGRAARAAVPAIVALRARFDETRELVLAEAGHDAAEATRLLINRLLHAPSEAMKDKASEGAEWRAMEKTLRILFRLDE

SEQ ID NO: 25668 - protein, 492 aa, Oryza sativa Japonica Group
MVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 25669 - protein, 756 aa, Magnetospirillum magnetotacticum MS-1
MQSAGMTSVSRRLLGRLRDVMAGSGSAQDRLDKVVKLIAADMVAEVCSCYVMRAGEVLELFSTEGLKKESVHQTRLRVGEGLVGDIAAHARPLALADAQIHPNFVFRPETGEEIFHSLMGVPIIRGSRVVGVLVVQNRTMRHYTDEEIETLETVAMVLAELLVSGELVNRAELVPVDGNALLPLRMEGVKLNGGVGVGVAVLHRPRITIQRLVAEDPDAELERLKKALTGIKLALEELFSRPEMRDGEHRDVLETYRMFAEDKGWLNRISEAIRTGLTAEAAVQKVHDDTRARMNQITDPYLRERMHDFEDLANRLLQHLAGGDDQRPGAADLPEGAILIGRNLGPMELFDYDPKRLRGLVLEEGSATSHVAIVARALDIPVVGRVKDVLDKIEPLDPVICDGDNGQVFIRPPDDIRETYIDAISQRQMRLAVYARLREMPAVTRQGVRIGIHMNAGLLLDLQHLHDSGADGIGLYRTELPFMARSSLPDVAAQTLLYKKILDQAEGKPVVFRTLDVGGDKVLPYWNPYEEDNPALGWRSIRITLDRPAVMRSQLRALLRAAQGRELSVMFPMIAEVSEFVQARHILDKELEHERQIGNPLPSKLKVGTMLEVPALALQLDALLPMVDFVSIGSNDLTQFLFAVDRGNPRIAERYDSLAPAMIRFMRYVSVKCAQYKVSLSVCGEMAGRPLEAMALIGAGIRHLSLSAPNIGPVKTMVRSLDIAALEAYLNSLLKSPDHSLRNKLKTFALDHGVVL

SEQ ID NO: 25670 - protein, 545 aa, Physcomitrella patens subsp. patens
SAEREDYVDFVEERKKEAELNATRANGTAPSSRDQGSIAEAFDKLLEKEFPDKEDPQEASEGLVGSSFNNSVNNQQAELETVARVTHDKPKKNDTLEVNGTAKSFQLQDLISMESGESGVEETPRLIDKKDNVFVISNPRESSMVLQQDVRFISDLVIVIVSAAGGGILFACLGQPVITGYLLAGSAIGPGGLDLVSELVQVETVAQFGVVFLLFALGLEFSTTKLRVVRAVAIFGGFLQIALFMCLSAITAVFCGARASEGIFVGAFLSMSSTAVVLKFLMDRNTTNSLHGQVTIGTLILQDCCVGLLFALLPVLGGSGSVISGLMSMSRSLFVLAAFLLFAAILARTLVPQFLRLMVRLSRQTNELYQLTAVAFCLLIAWISDRLGLSLELGAFVAGVMISTTDLAEHTLEQVDPIRNLFASLFLASIGMLINVQFLWTHMDILLSSLILVISSKTIVITLVVRAFGYNNKNAFLVGMSLAQIGEFAFVLLSRASNLHLIQKKLYLLLLGTTALSLITTPLLFRAIPAVLHIGSLMHWLPQDT

SEQ ID NO: 25671 - protein, 188 aa, Nocardioides sp. JS614
MAPMVCFEFEGKQPTVHPEAFVAPTATLIGDVTVERGASVWYGAVLRADICTIVVREGANVQDNSVLHAAPGETLVIGRDATIGHGCVVHCREVGEQALVGNGSTLLDRAVVGPRTLVAAGSVVTPGTELPGGMVAAGVPARPTKPIEGTSSEFWVEQNPPYYRELAQRHLAGVAVVEPEPVVREVES

SEQ ID NO: 25672 - protein, 118 aa, Physcomitrella patens subsp. patens
MSLEEPVELKFRLYDGTDIGPNKYPPATTVANIKESILNHWPKEKQNGPKSIHDLKLINAGKILENSKTLADSRVLLGEIPGCVITMHVVIRPPTNDKASGKQQSETPKNKPCCCTIL

SEQ ID NO: 25673 - protein, 165 aa, Thermosynechococcus elongatus BP-1
MTPVHWLSIPELLRLPAQTYEWQVDTHFPDLPTLTPVQGMVAATHRHTYLELRASVQTIVTLSCDRCLQYYNHRLECTTSELIWLAESPASQPDDDLVETAPATGRIDLGDWLYQQLCLALPYPKYCDPNCGGIHPPTPAEPSVDHRWAMLAQLQSALEGAEPSP

SEQ ID NO: 25674 - protein, 173 aa, Oryza sativa Japonica Group
MAAEGEKKMITLKSSDGEEFEVEEAVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 25675 - protein, 327 aa, Triticum aestivum
  misc_feature (98)..(98): Xaa can be any naturally occurring amino acid
TSLYKKAGWYRSGIPGISSTHASACDVINPDEIDVEFESVGGLDEVKQALYELVILPLRRPELFVYGKLLSPQKGVLLYGPPGTGKTMLAKAIAKESXGAVFINVRISNLMSKWFGDAQKLVSAVFSLANKLQPAIIFIDEVDSFLGQRRNTDHEALTNMKTEFMSLWDGFTTDQNARVMVLAATNRPSELDEAILRRFTQIFEIGVPSRSERSKILEVILKGENIESNIDYDYIASLCEGFTGSDILELCKQAAFYPIREILNSEKDGTRANSPRPLRQSDLEKALSTSRKGKKAASGAASGLQSPEWIRPSDPEDDQISEKSAVE

SEQ ID NO: 25676 - protein, 243 aa, Oryza sativa
  misc_feature (99)..(99): Xaa can be any naturally occurring amino acid
MLLLRAARASPAMAAVVRCKPTRLTPIAGLSSSSGGGRRKKAGRRGEAKPPPPPPPQLRGGETKKKKKPDARTAAEAAQGLQRHEVERRKKPPPPPPPXQEKAKRVVRWKCAAGCGACCKLDKGPDFPSPEEIFAEHPEDLKLYKSMIGADGWCINYDKSTRTCNIYEERPVFCRVEPKVFEEYFGVPSRPSTFDREACSACVDTIKMVYGEESAELTNFKRVIREESKKHEASLNQDKLLDT

SEQ ID NO: 25677 - protein, 659 aa, Oryza sativa
  misc_feature (128)..(128): Xaa can be any naturally occurring amino acid
  misc_feature (252)..(252): Xaa can be any naturally occurring amino acid
MDFTNLLITVLLLLSPLKYESDVATASDDEDFFKTCSSQRCSKHGPEIRYPFRLSTQPPSCGAPGMQLSCSGQDTILDHPVLGSCKVTMIYYRHVIMNAIPLVDSLPHCPLQKLVSVNQSTAVYKPHXTSEVASVVGCSRDSIDTNQYGSIVGPTSCPSLANNASQFWYLAYPYTYMSILPLGCTIVSKDIPMPYSYDKNGPNFDISIFTETAKRVISTGETVFTWYTSNVTSICQQCEREGRRCGFSSQRXSSILPASYVNRVETRTYPSYTTLVRKLCTCIFPAMLCKIIESGPRVTIIAATSSVGTFIVLSLIVATALYISLKSRYNEEIHLKVEMFLKTYGTSKPMRYTFSEVKKITRRFKNKLGHGGFGTVYKGELPNGVPVAVKMLENSLGEGEEFINEVATIGRIHHANIVRLLGFCSEGTRRALIYEFMPNESLEKYIFPHGSNISRELLVPKKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTEPTVENQNEFYFPEWIYERVINGQDLVLTMETTQGEKEMVRQLAIVALWCIQWNPKDRPSMTKVVNMLTGRLQNLQVPPKPFISSQNQLVI

SEQ ID NO: 25678 - protein, 447 aa, Salmonella enterica subsp. enterica serovar Paratyphi A str.
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARILIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 25679 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGAFTTTEKAKAHLQGGAKKVVISAPSADAPMFVMGVNEKTYDPKIEVVSNASCTTNCLAPLAKVIHDKYTIIEGLMTTIHSYTATQKTVDGPSAKDWRGGRTAAQNIIPSGTGAAKAVGKVIPDLNGKLTGMSMRVPTANVSVVDLTVRIEKGASYDEIKATIKAASEGELKGILGYTEDEVVSTDMNGDLHSSIFDAKAGISLNNNFVKLVSWYDNEWGYSRRVLDLLAYMAKVDGNA

SEQ ID NO: 25680 - protein, 186 aa, Chlamydomonas reinhardtii
MQSTVQLTRRSTVVRRCEGRICRPFAPCHPVSHIAKASPATEEPKTANKSEAELATEKFGLEAGLLTALTSKDEGGEGKLSNTEQAKRLLAQYGSAYLITSISFAIVSFAACYLAVDSGVDMAGVLARFGLEASDTSEKVGTFALAYAAHKALSPVRFPPTVALTPVVAKYLGKKKEEPSSGSNSK

SEQ ID NO: 25681 - protein, 215 aa, Brassica napus
  misc_feature (23)..(23): Xaa can be any naturally occurring amino acid
MEEPYETRNDNGEAYQMVRYHQXYNRTSSSPLLDLRVFYVRISNFKADDSTPEVLTLTHIPLDPDSLLEINGVRCSQGVSSQLRRDRVDKRSEAVTYISTDSIRLSGSVRFEVYDREELVLSGTLELSGSNNGFTGESVKHSVKRWGMSCEAEITAGCGFLKEKKHIGCSEMSSSPLLPTVEVYVTGCFSGTPIILTKTLQLGFRKKQVNRVAAS

SEQ ID NO: 25682 - protein, 262 aa, Legionella pneumophila str. Lens
MKSLPIYQVDAFASNLFKGNPAAVCPLDKWLSDETMQAIAAENNLSETAFFVPEKDGYRIRWFTPNEEVALCGHATLASSYVLFNQLGFSGEEIIFNSLSGKLWVKNTDQGLVMDFPVLPYEEINFSAELQHLSLKKPFKTLRSQFDLMFVYQNAEEVVEAKPDLNAVAHLDYRGLILTAPGISTDVYSRCFYPGCNVPEDPVTGSAHCVIAPYWCEQLRKNHITALQGGLRQGDLYCEVKENRVLLYGNCHLYLEGRIYLP

SEQ ID NO: 25683 - protein, 421 aa, Mesorhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYELMLRQHVDAGADVTVGCLEVPRMEATGFGVMHVDAKDNIIAFVEKPADPPGIPGNPEFALASMGIYVFKTKFLMEQLRRDAADPGSSRDFGKDIIPYIVQHGKAIAHRFTKSCVRSTMENEAYWRDVGTVDAYWEANIDLTDVTPELDLYDRDWPIWTYAELKPPAKFVHDEDGRRGSAVSSLVSGDCIVSGASLKKSLIFTGARINSYSALEEVVMLPDVHVGRNAKLKRVVIDHGVRIPEGLVVGEDPVLDAKRFRVSEKGICLVTQDMINKLGL

SEQ ID NO: 25684 - protein, 393 aa, Nocardioides sp. JS614
MTDRFQVASRANVPPFHVMDLLAASAERQRTHGDVLNLLAGQPMTGAPAPVREEAKRLLDSGDPLGYTPAAGIRELREAIAGHHRRAHGIEVDPDHVVVTTGSSGGFLLAFLAAFEVGDRVAMARPGYPCYRNVLTALGCEVVEIPTGPETRFQPTVEQLDGLADIRGLVVASPANPTGTMLLPSELAALAAYCEERGIQLISDEIYHGIEYAPLSGAEPLARSAWETSREAVVFSSFSKYFSMTGWRIGWMLAPDRLRRAVDVLTGNFTICPPVIAQRACLAAFDDASYAELDGHVARYAENRRILLDGLPKLGITELAPADGAFYVYADVGHLTDDTMRFARDLLARTGVAVAPGVDFDTVVGPRFVRLSFAGPGADIELALERLSTVLDR

SEQ ID NO: 25685 - protein, 267 aa, Magnetospirillum magnetotacticum MS-1
MEHEDREFSRIRRHGPADFEAMRKAGLLAAQTLDFIAPYVVPGVTTAEIDRLCAEFITTRGAVNAPMNYRGFPKSICTSVNHVVCHGIPGEKRLEDGDIVNIDVTPIVDGWHGDSSRMYYVGKVGVKARKLVEVTYESLMRGIEVVKPGATLGDIGHAIQSFAEKHRFSVVRDFCGHGLGRIFHEPPNVMHYGNKGEGGVLAEGMFFTIEPMINAGRYETKILADGWTAVTKDKSLSAQFEHSIGVTATGCEIFTLSPAGYHCPPYL

SEQ ID NO: 25686 - protein, 345 aa, Triticum aestivum
  misc_feature (40)..(40): Xaa can be any naturally occurring amino acid
  misc_feature (94)..(94): Xaa can be any naturally occurring amino acid
MDHAAEAQRTDLMTITRHALNEQGRHPESRGDFTILLSHXLGCKFVASAVNKAGLAKLIGLAGETNVQGEEQKKLDVLSNEVFVKALVSSGRTXCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTANQHCRYVERCKFPQDGSSPKSLRYIGSMVADVHRTLLYGGIFLYPADKKSPNGKLRVLYEVFPMSFLMEQAGGQSFTGKQRALEIVPAEIHQRSPIFLGSYDDVEEIKSLYASESSTA

SEQ ID NO: 25687 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDLRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVRYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 25688 - protein, 505 aa, Nocardioides sp. JS614
MSFDVHDLDTFILVGSAVTLLAILAVRVSTGAGLPSLLIYLLMGAALGESGVGIQFENYEVAHAVGFAALAMILAEGGLTTNWPEMRGCIRLGVSLATLGVAVSVTVVAVGAHYLLGMPWQLAVLLGAVTSPTDAAAVFSVLRVVPLPKRLTGTLEAESGLNDAPTVVLVTLISSGAVEDNGALAMVGIVGYELAIGVALGLAAGYGGAWVMRRAALPSSGLYPLAVMTLAFLGYGAAAFVHGSGFAAVYVAALVLGNSELPHRAATRSFAEGLAWLSQIGLFVTLGLLLSPGRISLSTVGLAIVAGLVLTFVARPLSVLASAVVQPLPWRELSFVSWAGLRGAVPIVLTTIPLAEGVDDAERLFDLVFVMVVLYTVLTGPTLPLVARVLRVARRSEPRGLEVEAAPLERIAADLLQVSIAPGSRMHGVEVGELRLPRGASVSMVIRDGNTLVPERRTVLRQGDDLLVVTPRKLRWQTEERLRQVSARGRLAQWLVEKPARRPQP

SEQ ID NO: 25689 - protein, 188 aa, Zea mays
MREFLSTLAKRVRPNTTAYGNYRRIFVPGGQPPECEAGEPLRVNVLFKHIQRMLSDGGAIIAETGDSWTAKLLEMVETLVAAPFNDRQGSRDRGLAPWRVAGGARYVFVQWQLRAMPFLNSATKQIEGFKSQIQEAAKKFIATNISFLIGDVESADRAFHYSGLKENDVPLLFVIAQGGKISKPNYRP

SEQ ID NO: 25690 - protein, 161 aa, Leptospira interrogans serovar Copenhageni str. Fiocruz L1-130
MYRIGNGIDFHKLEINLNRPLILGGIECESEFALVGHSDADIILHAISDAILGALALGDIGQYFPDTDPSLKNIDSKIILVKCLELMKEKNFDLVNIDCTVIGERPKIAPLKDRITKSLSNLLNLPLDCISVKATTTEKMGALGRQEGIGTFCSILLEKRS

SEQ ID NO: 25691 - protein, 446 aa, Acidovorax sp. JS42
MKVTVFGTGYVGLVQGAVLADVGHDVICVDVDAAKVAALQAGHIPIHEPGLEPLVKANQAAGRLRFTTDAAQGVAHGELIFLAVGTPPDEDGSADLQHVLAVARTIATHMTEPKTIVNKSTVPVGTADKVADTVRKVLETRGVALAFEVVSNPEFLKEGAAVADCKRPDRIVIGTRAPQAERQLRELYAPFNRNHDRIVMMDVRSAELTKYAANAMLATKISFINEMANLAEQLGADIEDVRRGLGSDPRIGYHFIYPGVGYGGSCFPKDVKALIHTAQSIGFTPDLLLAVESRNDAQRQLLARRIIAHYGGSLRGKTIAVWGLAFKPETDDMREAPSRYLLQSLWAAGAQVRAHDPAAMDEARRIFGERDDLVLCGSPTEALEGADALAIVTEWKIFRVPDFAQMAHALHDRMVFDGRNLYDPETITRFGLGYVSIGRAPVVGMS

SEQ ID NO: 25692 - protein, 160 aa, Magnaporthe grisea 70-15
MFSLTLTAELGGVTNLRPDDTEASPFWYTFKVQCTSCRETHANWVGVSRFETNEMSGSRGEANFVWKCKNCKRESSASIKAAPAAYEASEPAKGQKIIEFDCRGLEFVEFKPEGNWLAEGVESGTKFTEIDLDEGEWFEYDEKAGDEVSIKDLKWEISRA

SEQ ID NO: 25693 - protein, 336 aa, Acidovorax sp. JS42
MSVTLVTGCAGFIGMHCVQRLLERGERVVGIDNLNAYYDVGLKHARLDRLHCQSDFTFEQIDVADRDAMHALFARVRPHRVLHLAAQAGVRYSIDQPDDYTDSNLLGFGNILQGCRAQQVEHLVFASSSSVYGGNAKLPFSERDAVDHPVSYYAATKKANEVMAHAYAHLYGIPTTGLRFFTVYGPWGRPDMALFKFTRAMLAGETIDVYGEGQLVRDFTYIDDIVEGVLRVLDKPATPDAAFDPLSPSPGTGLAPYRIFNIGNSAPTLLMDYIQALEEALGMVALKRMRPLQPGDMHSTAADMSALASWVGFAPHTPVRDGVARFVHWYKDFYPS

SEQ ID NO: 25694 - protein, 309 aa, Brassica napus
  misc_feature (126)..(126): Xaa can be any naturally occurring amino acid
  misc_feature (175)..(175): Xaa can be any naturally occurring amino acid
MEVELKALLDDLNVLEKSLSDPAPIQKLRSRVENLAALSKCNPHRRSKVKELSSEVVDSNPYSRLMALQRMGIVENYERIREFSVAIVGIGGVGSVAAEMLTRCGIGRLLLYDYDTVELANMNRLXFFRPDQVGMTKTDAAVQTLAEINPDVVLESFTMNITTVQGFETFTSKLXNKSFCPTKEGCGVDLVLSCVDNYEARMAVNQACNELSQTWMESGVSEDAVSGHIQLLVPGETACFACAPPLVVASGIDERTLKREGVCAASLPTTMGVVAGLLVQNSLKFLLNFGEVSPYLGYNSLKDFFPTMQ

SEQ ID NO: 25695 - protein, 426 aa, Sporosarcina pasteurii
MLLTKEKNGMEIIEERESAVRSYSRSFPTVFEKAKDHLVWDVDGKEYIDFFAGAGSLNYGHNNEKMKTKIMDYVMNDGISHSLDMGTVARAEFLETFNEVILRPRNLDYKVMFPGPTGTNTVESALKIARKVTGRQNIISFTNAFHGMTLGSLSISGNSSIRNGAGVPLTNTISMPYDTFFKNGNAIDYLEQYLEDTGSGVDLPAAMILETVQGEGGINAASFEWLRGIEKLCRRYDILLIIDDVQAGCGRTGTFFSFEPAGIQPDIVCLSKSIGGYGLPLAITLIKPEHDIWEPGEHNGTFRGNNMAIVAATEALSYWKTDDLAKSVQKKSKIIKLRFEQIVEDYPELKATTRGRGFMQGIACGKGKEAYATKICAKAFEKGVIMETSGPSGEVVKFLGALTIDETSLIKGLGILEEATEEVVRQ

SEQ ID NO: 25696 - protein, 369 aa, Bradyrhizobium japonicum USDA 110
MKTRAAVAFEAKKPLEIVEVDLEGPKAGEVLVEIKATGICHTDAYTLDGFDSEGIFPSILGHEGAGIIREIGPGVTSVKPGDHVIPLYTPECRQCKSCLSQKTNLCTAIRATQGKGVMPDGTSRFSYKGKPIYHYMGCSTFSNFTVLPEIAVAKIREDAPFDKSCYIGCGVTTGVGAVVNTAKVEPGANVVVFGLGGIGLNVIQGAKMAGADKIIGVDVNDSKEDWGRRFGMTHFVNPKKITGDIVPHLVNLTDGGADYTFDCTGNTTVMRQALEACHRGWGTSIIIGVAEAGKEIATRPFQLVTGRNWRGTAFGGARGRTDVPKIVDWYMNGKIQIDPMITHVLKLEEINKGFDLMHEGKSIRSVVVY

SEQ ID NO: 25697 - protein, 202 aa, Desulfitobacterium hafniense Y51
MSYLVPMVIEQTNRGERSYDIYSRLLKDRIIFLGGPVTDDVANLVVAQMLFLEAEDPEKDIFLYINSPGGSISAGMAIYDTMQYIRADVHTICVGLAASMGAFLLTAGAKGKRQALPNAEILIHQPLIGGGGISGQATEIEIHAKHLLRVKERMNRILAERTGQTIERIEADTDRDRYMTAEEAKEYGLIDEVLEKPNQPKK

SEQ ID NO: 25698 - protein, 142 aa, Salmonella enterica subsp. enterica serovar Paratyphi A str.
MRCEQMANQPSAEELKKKLSEMQFYVTQDRGTEPPFTGRLLHNKRDGVYHCLVCDTPLFHSHTKYDSGCGWPSFYQPVSEEAIRYIDDFSHGMQRVEIRCGNCDAHLGHVFPDGPQPTGERYCVNSASLAFSDEKNGDQLKG

SEQ ID NO: 25699 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPLAKVIHDKYTIIEGLMTTIHPYTATQKTVDGPSAKDWRGGRTAAQNIIPSSTGAAKAVGKVIPDLNGKLTGMSMRVPTANVSVVDLTVRIEKGASYDEIKATIKAVSEGELKGILGYTEDEVVSTDMNGDLHSSIFDAKAGISLNNNFVKLVSWYDNEWGYSRRVLDLLAYMAKVDGNA

SEQ ID NO: 25700 - protein, 443 aa, Shewanella sp. MR-7
MSQQNPGLKQSLSLWQVVVMGLAYLTPMAVFDTFGIVSEITSGHVATSYLLALAGILFTAFSYGHLVRKYPYAGSAYTYAQKTFSPNVGFMVGWSSLLDYMFMPMINMLLAKIYLTAMFPNVEPWIFIFGLVAVMTVLNLRGIDLVANFNGVIVFVQIAIILVFIGLMAHSLSLGEGEGVIASVRPFYSEEISLAPLFTGATILCFSFLGFDGLSSLSEETKDAKRVIPRAIVLTALIGGVIFVSVSYFLQLFFPDISRFQQLDAVLPEIALYVGGNLFQSVVLVATTIAVLASGMAAHAGVARILYVMGRDNMLPNKGFGYIHPKWRTPAFNVILVGLLALSAVSFDLEMALALVNFGALVAFTFVNLSVIVQFYIKEKRNQSLKDHFQYFALPLCGAATIGVLWLNLEPQSLELGLIWAAVGVLYLALRSLRLRKAVELQN

SEQ ID NO: 25701 - protein, 566 aa, Arabidopsis thaliana
MEKVEVPPIHNHPLLPFTRFSYKACKGCGYVGYIYGGYHCNELGCESVFHKECADPLPEINHYSHPDHPLKLLINVEPLASCSQCPSSFENGYLCSICDFKLDFRCATRLPLEFILEESTVHEHPIQLSDGTRDGFVQLCKTCKWGVFDAVHYKCNKCDLRFHVECTKLFPQASHVLHPQHPLKLLRCEEAPDYADNKCLLCGNKFDGRIHHCDVCNFTICGGCMENPPPLSVVSPTTHEHQLYLLSKPLGFTCNACGTQADQSPYFCLQCNFMIHWECIDLPRVININRHDHRISYTRRLGHGQNTCGVCRKKVDGFYGGYSCSKCSNYVVHSRCATDEDVWDMIELEGTPEEPEEDAPFEVIDDNTIKHFSHDHNLVINKDGRILHESTLCKACVFQICSDAFYSCENCDFILHQKCANLPRKKRHVCDNLPFTLVTNDTSDETSCDLCWQSFTGFRYECLTRMVTLDVRCGSIREPLVHQSHQHPLYFSKRSSKSCTECGKNMDLDIGSFSCDECDYSLDFKCALLPQKVKWHRYDDHPLYLSCGESSVDGEYWCEACETKVN

SEQ ID NO: 25702 - protein, 397 aa, Thermococcus litoralis
MVKASKRAMSIEYAIRDVVLPARELEKQGIKIIKLNIGDPVKFDFQPPEHMKKAYCEAIMEGHNYYGDSEGDRELREAIVEREKKKNGVDITPEDVQVTAAVTEALQFIFGALIDGGEEILIPGPSYPPYVGLVKFYGGVPKAYRTVEEEGWQPDIDDMRKKITEKTKAIAVINPNNPTGALYEKKTLQEIIDLAGEYDLPIISDEIYDLMTYEGKHVSPGSLTKDVPVIVMNGLSKVYFATGWRLGYMYFVDPENKLAEVREAIGKLARIRLCPNTPAQKAAIAGLRGPMDYLEEYMAKLKERRDYIYKRLNEMPGISTQKPQGAFYIFPKIEEGPWKSDKEFVLDVLHNAHVLFVHGSGFGEGGEMHFRSIFLAPVPVLEEAMDNLEKFMKERLG

SEQ ID NO: 25703 - protein, 328 aa, Venturia inaequalis
FGRIGRIVFRNAIEHEDINIVAVNDPFIDPTYAAYMLKYDSTHGQFKGEIKVTGSDLTVNGKTIRFYQERDPANIKWSETGAYYVVESTGVFTTTEKAKAHLQGGAKKVVISAPSADAPMFVMGVNEKTYDPKIEVVSNASCTTNCLAPLAKVIHDKYTIIEGLMTTIHSYTAAQKTVDGPSAKDWRGGRTAAQNIIPSSTGAAKAVGKVIPDLNGKLTGMSMRVPTANVSVVDLTVRIEKGASYDEIKATIKAASEGELKGILGYTEDEVVSTDMNGDLHSSIFDAKAGISLNNNFVKLVSWYDNEWGYSRRVLDLLAYMAKVDGNA

SEQ ID NO: 25704 - protein, 481 aa, Pseudomonas syringae pv. tomato str. DC3000
MKTIRMRAEVLAGLTTSFALVPECIAFALVAHLNPLMGLYGAFIICTLTALFGGRPGMVSGAAGSMAVVIVALVVQQGVQYLLATVLLGGLIMILFGLLRLGKLVRLVPYSVMLGFVNGLAIVIAMAQLEHFKVGESWLSGTSLYVMLGLVALTMAIVYLLPRITRVAPPALVAILSVGLAVYLLGLPTRTLGDMAHIAGGLPVFALPDIPWNLDTLRIIAPYAILMALVGLLETLLTLNLTDEITETRGYPDRECVALGAANMVSGAFGGMGGCAMIGQTVINLSSGGRGRVSGVVAGLMILMFVLFLSPLIERIPLAALVGVMFVVAQQTFAWASLRVLRKVPVNDVLAIIAVTVVTVLTDLATAVVFGIIIAAINFAWQQARELYADSHVEADGSKIYHLHGTLFFASTTPFLDQFNPSEDPAQVTLDCRHLSFVDYSAIAALKTLRERYAKAGKHLRVVHLSDRCKRLLKRAGVQHA

SEQ ID NO: 25705 - protein, 141 aa, Methanopyrus kandleri AV19
MSEIRLGLVVTEFNREITYAMEELAVQHAKDLGAKVVERVLVPGSFEVPLAVRKLLERDDIDAVVTLGAIIKGDTDHDQAIAQQAFRKIQDLMVEYGKPVALGISGPGMTRMEALERVHYAKRAVEAAVKMVRRLRELEGE

SEQ ID NO: 25706 - protein, 228 aa, Chlamydia muridarum Nigg
MKKQGVLIAPSIMGADLACLGDAARNIEESGANLIHIDVMDGHFVPNITFGPGIIAAINRSTDLFLEVHAMIYTPFEFVEAFVKAGADRIIVHFEAAENLKEILDYIRKCGVQAGIAFSPETSIEFISAFIPLCDVILLMSVQPGFCGQKFIPDTIEKIRFVRQAIQTLGKEGSCLIEVDGGIDEESARACREAGADILVAASYFFKKDSINMKEKVLLLQGEEHGAK

SEQ ID NO: 25707 - protein, 327 aa, Xanthomonas campestris pv. campestris str. ATCC 33913
MHRTHPAHVVISGASSGIGQATAEAFAERGARLVLAARGEEALQQVAERCRARGAEVLVVPTDVKQADQVQALATSARSFLGRIDLWFGNVGVGAVGTFHEVPIEASTAVVQANLIGRMHDAHAAIPIFVEQGHGVFVNMISLGGFAATPYAAAYSASKFGQRGFSEALRAELIDHPKVHVCDVYPYFVDTPGLSHGANYVGRRVTGPPMMLDTRTVAQAVVRLLDRPRNTVVIGPAVQAMRVGHALAPNLFARAMSRFFQRYFAQAPRVGRSSGNVFGPPAIAGGIDGGFRRRPAVRARAGRNTLAIGAAVAALATVAVLAAKRAR

SEQ ID NO: 25708 - protein, 189 aa, Mycoplasma genitalium G37
MAEQKRDYYEVLGITPDADQSEIKKAFRKLAKKYHPDRNNAPDAAKIFAEINEANDVLSNPKKRANYDKYGFDGVDGEPAFNFQADVFQSFFEEIAKSGVFNNQTNPEQKEKKKRYHWFSKKPKQEQPEINLDHVVEQTIKKVQQNQNQNKDPDELRSKVPGEVTASDWEALVGDTRYGYFDETGDWSW

SEQ ID NO: 25709 - protein, 591 aa, Oryza sativa Japonica Group
MDDHNLDYKGSGALEELEMLTVNAKEAQELILTKILERNQATEYLSKFMNGSTNISAFKRHVPVVTYDKVHPYILRIATGEESSILCGEYILELLRSSGTSRGEPRLMPSILKDLDRRTYLYSLIMPIMNKYISGLGEGKAMYLLFVKAETLTDSGIPVRSVLTSYYKSPHFLHRKHDLYNNYTSPDEVILCPDSQQSMYCQLLCGLVERQHVLRIGAVFASAFLRSISFLEQHWRDLVNDIRIGQLNSSITSPACRLAMLNFLALPNPELADQVEAICSCGSWKGILGRLWPNVKYIEAVLTGTMAQYIPMLEFYGGGAIPFVCTMYASSESYFGVNLSPLCSPADVSYTILPNMAYFEFIPLEDGLRLTDHEEVIENDKLVSLVDVKVGCYYELVVTTFSGLYRYRVGDVLQVTGFYNRAPQFKFICRRNVILSIDSDKTNEEDLHNSVTTAKKILENQNYLLLEYTSYTDISTVPGHYVLFWEIKSTHDERPAPLDAQLLESCCAAVEESLDYVYRRCRAHDRSIGPLEIRLVEAGAFDALMDLLVSHGSSINQYKTPRCIESSLALKLLNSKVIACFFSPQDPECGM

SEQ ID NO: 25710 - protein, 96 aa, Petroselinum crispum
ATYNVKLITPDGEVEFKCDDDVYVLDQAEEEGIDIPYSCRAGSCSSCAGKVVSGSIDQSDQSFLDDEQMDAGYVLTCHAYPTSDVVIETHKEEEIV

SEQ ID NO: 25711 - protein, 868 aa, Oryza sativa Indica Group
MMVTWPWRALPLAAVLFLFLSPAASVDTVTMEAPLAGNRTIVSAGGTFTLGFFTPDVAPAGRRYLGIWYSNILARTVVWVANRKSPVVGGSPTLKINGNGSLAIVDGQGRVVWASPVMSASVLSAGSAKAQLLDNGNFVLRFASAGVAWQSFDYPTDTLLPGMKLGIDFRTGLDRYMNSWRAADDPSPGEYSFRIDPSGSPEFFLYRWSTRTYGSGPWNGYQFSGVPNLRTNTLLSYQYVSTADEAYYQYEVDDSTTILTRFVMNSSGQIQRLMWIDTTRSWSVFSSYPMDECEAYRACGAYGVCNVEQSPMCGCAEGFEPRYPKAWALRDGSGGCIRRTALNCTGGDGFAVTRNMKLPESANATVDMALGLEECRLSCLSNCACRAYASANVTSADAKGCFMWTADLLDMRQFDNGGQDLFVRLAASDLPTNSVSDNSQTAKLVEIIVPSVVALLLLLAGLVICVIKAKKNRKAIPSALNNGQVTPFGQRNHTASALNNWEITPFWQRNHVAASNDAQDNNSMRPAGQGNHQDLDLPSFVIETILYATNNFSADNKLGQGGFGPVYMGRLDNGQDIAVKRLSRRSTQGLREFKNEVKLIAKLQHRNLVRLLGCCIDGSERMLIYEYMHNRSLNTFLFNEEKQSILNWSKRFNIINGIARGILYLHQDSALRIIHRDLKASNILLDRDMNPKISDFGVARIFGTDQTSAYTKKVVGTYGYMSPEYAMDGVFSMKSDVFSFGVLVLEIVSGKKNRGFYHNELDLNLLRYAWRLWKEGRSLEFLDQSIAGTSSNVTEVLRCIQIGLLCVQEQPRHRPTMSAVTMMLSSESPALLEPCEPAFCTGRSLSDDTEASRSNSARSWTVTVVEGR

SEQ ID NO: 25712 - protein, 403 aa, Oryza sativa Japonica Group
MGVLSRPEEVLPLVKLRVAAGRIKRQIPPEEHWAFAYTMLQRVSRSFALVIQQLGPDLRNAVCIFYLVLRALDTVEDDTSIPAAVKVPILKEFHRHIYNRDWHYSCGTKDYKLLMDKFRLVSTAFLELGQGYQEAIEEITRLMGAGMAKFICKEVETVDDYNEYCHYVAGLVGYGLSRLFHAGGTEDLASDSLSNSMGLFLQKINIIRDYLEDINEIPKSRMFWPREIWSKYVNKLEDLKYEENSEKAVQCLNDMVTNALSHAEDCLQYMSALKDHAIFRFCAIPQIMAIGTCAICYNNVNVFRGVVKMRRGLTARVIDETNTMSDVYTAFYEFSSLIESKIDNNDPNASLTRKRVDAIKRTCKSSCSLKRRGYDLEKSKYNSMLIMVVLLLVAIVLGMIYAK

SEQ ID NO: 25713 - protein, 231 aa, Fusobacterium nucleatum subsp. nucleatum ATCC 25586
MNKEQKSKFVHEVFENIHTQYDRANNKISFGLQKNWKQELVDKIVEETPKNSDFLDVCCGTGDISIWLAKKREDLNIIGVDFSSAMLNEAVKKSKNLNIVWKEADALCLPFKDSSFSAVAISFGLRNTVDYEKVLKEMIRVVKKDGFIYCLDSFVPDCLWIQPFYKMYFKYIMPLFGGGKKYYKEYVWLYESTQQFLKKKELILLYEKLGLKEIKHCSKMFGVCVMIQGKK

SEQ ID NO: 25714 - protein, 236 aa, Shigella flexneri 2a str. 2457T
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGKIAKLDQGKRLGPDPDQFGG

SEQ ID NO: 25715 - protein, 174 aa, Thermosynechococcus elongatus BP-1
MANRRKNPRKVEKETDWQERVVQIRRVSKVVKGGKKLSFRAIVVVGNERGQVGVGVGKAADVIGAVRKGVADGKKHLIDVPITKSNSIPHPTFGEGGAARVMIRPAAPGTGVIAGGSVRTVLELAGVRNVLAKQLGSSNPLNNARAALEALAALRTFQEVAEEREIPIENLYSK

SEQ ID NO: 25716 - protein, 315 aa, Thermococcus kodakarensis KOD1
MVVSLAGRDVLCLQDFTREELETILKTAEMMKIWNKIGKPHRVLEGKTLAMIFQKPSTRTRISFEVGIYQLGGYGLYLNAQDLQLRRGETIADTARVLSRYVDGIMARVFDHKDVEDLAKYASVPVINGLSDFSHPCQALADYQTILEKKGRIQGLKIVYVGDGNNVAHSLMIAGTKLGANVVVATPEGYEPDPKVIKWAEQNAAESGGSFELLHDPVQAVKDADVIYTDVWASMGQEAEAEERRKIFMPFQVNKELVKHAKPDYIFMHCLPAHRGEEVTDDVIDSPNSVVFDQAENRLHAQKAVMALVMGGIKV

SEQ ID NO: 25717 - protein, 100 aa, Oryza sativa
  misc_feature (63)..(63): Xaa can be any naturally occurring amino acid
PAVVVGGGRVGQALLSMGPPGADVLVGRGEKVPEDAPGPILVCTRNDDLDAVLDATPRSRWRXNGMLDPWFESKGLVDANQVLAYFAVSKLGEPPVDGIT

SEQ ID NO: 25718 - protein, 238 aa, Acidovorax sp. JS42
MTTIASNLQNVRERIARACTAAGRPPDAVALLAVSKTFGPEAVRDAALAGQRRFGENYIQEAVEKMALVAALGLPQPLEWHCIGPVQSNKTRLVAQHFDWVHTVDRPKTAQRLSDQRPDNLPALQVCIQVNVDGGATKAGVPAEEALALAQAVAALPRLTLRGVMSIPDPVPDEAAQLAVLLRVRQVFDTLRAQGGPGFEAVDTLSLGMTGDLEAAVRAGSTMVRVGSGIFGARHYPA

SEQ ID NO: 25719 - protein, 279 aa, Vibrio angustum S14
MSIKIKTAEEIEKMRVAGRLAAEVLEMIEPHVKAGVTTEELDRICHDYITKDQQAIPAPLNYHGFPKSVCTSINHVVCHGIPAQADEEVPEANGKYIKPAVLKDGDIINIDVTVIKDGYHGDTSKMFEVGEVSLEDKRLCRVAQESLYLAIKKVKPGARVGDIGTAIQKFIKSGNSRFSIVKDYCGHGIGNEFHEEPQVVHYKNNDRTVLKEGMCFTIEPMINAGKFGCESDDQDGWTVYTVDGKKSAQWEHTLLVTKDGCEILTLRTEETLPRLMHNA

SEQ ID NO: 25720 - protein, 378 aa, Acidovorax sp. JS42
MSGLLPDVDPDGLLEFSVVYTDRALNHMSRRFVGVMQDILATLKEVYRAHTAVLVPGSGTFGMEAVARQFANREKVLIVRNGWFSYRWSQIFDAGGLGDGAAVCQARRQGDGPQAPWAPCPASEVAAAIRAERPKVVFAPHVETASGILLPDDYLRTVSDAAHEVGALFVLDCVASGAMWVDMEKTGVDVLISAPQKGWSGSPCCAMVMLSARAREAIEQTQSSSFSCDLKKWMQIAEGYEKGQHAYHTTMPTDALVRLRDVMLETRDYGFAKVRDEQIALGAKVRALLQARGFPSVAAAGYEAPGVVVSYTTDPGIQSGKKFAEAGLQTASGVPLQCGEGADFQTFRLGLFGLEKWHNVDRTVGHLAAALDQVAPAR

SEQ ID NO: 25721 - protein, 254 aa, Pseudoalteromonas tunicata D2
MNILANKVAIVTGASTGIGYATAKLFAKEGAAVVVAARRQRELDELVDLINREGGQAVALAGDVSDEAFAKALVDKAVSHFGGLDIAFNNAAILGAMGPVPQMSLTDWDQVIATNLTSAFLGAKYQLPAMAARKGGSLIFTSTFVGYTAGMPGMAAYAASKAGLIGLTQVLASEHGPQNIRVNALLPGGTDTPAGREFANTPEALAFVHNLHALKRMATPDEIAQSALYLASDASSFTTGSAMLVDGGVSINRV

SEQ ID NO: 25722 - protein, 229 aa, Acidovorax sp. JS42
MSNADAIGDFRERTMGRKFSTVLADPPWQFQNRTGKMAPEHKRLNRYGTMDLDAIKALPVAEVCADTAHLYLWVPNALLPDGIEVLRAWGFQYKSNLVWHKIRKDGGSDGRGVGFYFRNVTELILFGVRGKNARTLAPGRSQVNLLATQKREHSRKPDELYPLIEACSPGPFLEMFARGSRPGWTTWGNQADDYYPDWPTYSNHSQSDPGQAVTSTAAQPTLFEFAKAV

SEQ ID NO: 25723 - protein, 338 aa, Arabidopsis thaliana
VADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYDVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 25724 - protein, 188 aa, Campylobacter jejuni RM1221
MKKILFIDNYDSFSYTIIYYLKELGFECKVIKNDAFKKAKELEKFDFTHLIISPGPHSPKESKLSLKAIKYFKKNKKILGICLGHQCIAEVFGGRVSKMQNPMHGKISKLYFKKDPIFKGIKKEIEICLYHSLHISSMPEKCKILAHNSENIIMAIKHKKYPIYGLQFHPEAVLTQKGKKILKNFMKL

SEQ ID NO: 25725 - protein, 571 aa, Legionella pneumophila str. Lens
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAAAKRFSHEYRQPRGLYIAHSDKNQLEEIINNRSNPDIDLVVVTDGEGVLGIGDQGIGGMDIPVAKLMVYSLCGGIDPTRTLPIFLDVGTNNQELLNDPMYLGCRHPRIKSSEYDDFIKTFVNKIHKQFPNAFLHWEDFGRGNARRILDQFQDELCTFNDDIQGTGAVTLAAILAACDVTGLPLHEHRIVVFGAGSAGTGISDQIVDAMVKNRLSLTDAYDRFWLIDKQGLLLATDQELTDAQKPYARNPIDIQSWEINNKQHPSFTDTIRHVKPTILIGCSAQTGAFSQDIVETMSTACERPIIFPLSNPDEKCEAQPSDILAWSKGRALIATGTAFAPIEYQNRMVQIAQCNNALVFPGIGLGVLAVSASRLTKDMILAAAQTLSKFAPSKKDSFLPLLPSLDNAQIVAKEIAIAVAQCAIDSGYAQKNQDKELPRLIDELFWEPRYLPFRKRG

SEQ ID NO: 25726 - protein, 504 aa, Mycobacterium bovis AF2122/97
MPELATSGNAFDKRRFSRRGFLGAGIASGFALAACASKPTASGAAGMTAAIDAAEAARPHSGRTVTATLTPQPARIDLGGPIVSTLTYGNTIPGPLIRATVGDEIVVSVTNRLGDPTSVHWHGIALRNDMDGTEPATANIGPGGDFTYRFSVPDPGTYWAHPHVGLQGDHGLYLPVVVDDPTEPGHYDAEWIIILDDWTDGIGKSPQQLYGELTDPNKPTMQNTTGMPEGEGVDSNLLGGDGGDIAYPYYLINGRIPVAATSFKAKPGQRIRIRIINSAADTAFRIALAGHSMTVTHTDGYPVIPTEVDALLIGMAERYDVMVTAAGGVFPLVALAEGKNALARALLSTGAGSPPDPQFRPDELNWRVGTVEMFTAATTANLGRPEPTHDLPVTLGGTMAKYDWTINGEPHSTTNPLHVRLGQRPTLMFDNTTMMYHPIHLHGHTFQMIKADGSPGARKDTVIVLPKQKMRAVLVADNPGVWVMHCHNNYHQVAGMATRLDYIL

SEQ ID NO: 25727 - protein, 475 aa, Pyrococcus horikoshii OT3
MKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 25728 - protein, 608 aa, Oryza sativa Japonica Group
MAAATLPPSHHRLHLHLHLHTPKPSPPRRLRLAAAAAASRLQNPTTTHYPNLPPPAPPPSTSLVAAEEASLAPRRTYRFPGSVPSSPTLPDTADGGLAAAAAVADDAVLRRALEVRRAVAGEVLVAALRGGKVGGLTYIRNLTSRMAPFVDRVVVEAAAMRRDRPELAHQSFNARARVYIEESGLVALVKWFKHNSMTYPQIAKVVCSSSGNLEKVRRMIKWLRSIHVKGEYLGRVLAKGDTFLSRSFEELEEIIYYMESCGVRKDWIGHVVGRCPQLLNLSMDELETRVRFYTDMGMNDNDFGTMVYDYPKALGFFSLEEMNSKVQYLKEFGLSTDELGKLMAFKPQLMACSIEERWKPLVKYLYHLNISRDGMKRMLVVQPTIFCLDLETVIAPKVQFLQDIGVRSDAVGGVLVKFPPVLTYSLYKKIRPVVIFLMTKAAVKQEDIGKVIALDPQLLGCSIVRKLEVSVKYLRSLGIYHFVLGQMVTDFPTLLRYNVDVLRPKYQYLRRVMVRPLIDLVEFPRFFSYSLEDRIVPRHQTLVENRINMKLRYMLTGSDEDFSQRVREAVERRARFEAGNVEASDSQATTDGAEATAPASQDGWEADT

SEQ ID NO: 25729 - protein, 157 aa, Leifsonia xyli subsp. xyli str. CTCB07
MALENDTQAPDFELPNQHGQAVRLSDFRGRKAVTIVFFPLAFSGTCTGELCELRDNLALFEDHRVELLAVSVDSKFTLRAWEEHEGYGFSLLADFWPHGGIAKEYGVFLPEKGFANRATFVIDESGIIRASFITAPGRARSIDTYRTALDLLPAHVG

SEQ ID NO: 25730 - protein, 325 aa, Pyrococcus horikoshii OT3
MHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 25731 - protein, 549 aa, Haemophilus influenzae Rd KW20
MKNINPTHTHAWKSLEAHKAELSNITIQDLFKQEKNRFDDYSLTFNNQILIDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFLSTPIEQNIPTTLALVGLWNTNFLGAQTEAILPYDQYLHRFAAYFQQGNMESNGKYVDRDGNVIKNYQTGPIIWGEPGTNGQHAFYQLIHQGTTLIPCDFIAPAQRHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 25732 - protein, 424 aa, Nocardioides sp. JS614
MGIVVQKYGGSSVADAAGIKRVAQRIVNTRKAGHDVVVVVSAMGDETDNLRDLAEQVTPLPPPRELDMLLTAGERISMALVAMAIAALGHEAKSFTGSQAGVITDSAHGKAKIIDITPGRIEKALKDGAIAIVAGFQGVSQDTKDVTTLGRGASDTTAVALAAALGAEVCEIYSDVDGVFTADPRIVPAARKLARVSTEEMLEMAASGAKILHLRCVEYARRYDMPIHVRSSFSQKEGTWVIPDSKAGEDEMEQAIIAGVAHDRSEAKITVVGVPDKVGEAARIFEALAATEVNLDMVVQNVSAAATGLTDISFTLPRADGQSAMGALARIQDEVGYDKLLYDDQIGKVSLIGAGMRSHPGITARFFASLAAAGVNIEMISTSEIRISVIVDEAQVDEAVRATHTAFDLDAEEVEAVVYGGTGR

SEQ ID NO: 25733 - protein, 439 aa, Thermococcus kodakarensis KOD1
MEGVAWLLATIGIALILAKIGDSIIERFELPGVLGELIMGMILGNLVYFGYVAPDYLPIVSGMGYESVLNQIAEFLAKLGIIFLLFLGALDADIEQLKKTGLTATVSTVLGVFVPLVLGWWALMAMGYPSREAFAGGVLLTATSIGLTVRVMMDLGVLRSEVGAASLSASVMDDFLGIALIIFAVGTGSLFELSIKIVAFFIITGVLGWYFIDHYIRFAERLHVEKGILGMAIGMMFLFAALAEGWFAAAIEGAFMMGLILSKLPEGKRIMEDVRAIGYGLLIPFFFVHTGAMLNLKVFEHGDAITLAAVLSVIAIVGKIVGRGFGAWITAWGRGRDFLFTRENFWMSLQMGIGSVPRTEVALVNLMVAIHGGAIPSTDAPKFIAATLIFITVSVLITPPLLKWAFKAEIEKAKAEKAAQKVGRIQETKEKIKELKGSE

SEQ ID NO: 25734 - protein, 341 aa, Thermosynechococcus elongatus BP-1
MSLFFRPAEWLPHRACWLAFPSHEDLWGELLPQVRFEFAALCRAIADPDPVTGQCRGEQLKILVLDETGKATAHSYLSDLNPQFYQLTFGDIWLRDTAPVGLINEAGERRLLCLPFNGWGKKYQLAGDSDLAIRLALLMGIPYGSVPLFLEGGAIEVDGEGTCLTTRQCLLNPNRNPYLSSAEVEARLKPALGVSKILWIESGLVNDHTDGHIDTLVRFVAPATVVCMLAESPEDPNCDVLRTIYEQLQTLTDAKGRSLEVIPVPSPGRVTSQKGEILPASYVNFYIANTTVVVPTYGVEADAKAVEAIAKLFPSRRTIGLPARTILEGGGAFHCITQQEL

SEQ ID NO: 25735 - protein, 437 aa, Blastopirellula marina DSM 3645
MKIAMVGTGYVGLVTGTCFADSGNRVTCVDINAAKIADLNAGKIPIYEPGLEELVVRNSEAGRLKFTTDLAAAVKDAELVYLGVGTPQGDDGAADLSALWAVVDGLAPHLKPDAAVVIKSTVPVGTNAETFARLREKTGRDCHVASNPEFLKEGAAIDDFMKPDRVVVGVRDPQVGEKLRLLYAPFLRTEKPFLVMSPESAELTKYVANAMLATKISFINTMANLTEKLGGDINDVRRGIGHDSRIGFAFLFPGVGYGGSCFPKDVRALEAMFERAGIDPVMLKAVDVINEAQKRTLLDKMTEFYEGQFAGKTFAIWGLAFKPRTDDIREAPALVLIDNLLAAGAKLRVHDPEAADNVRAIYGDKLTYCDQPLETLDGADALAINTEWAEFRQPDMNDVKRRLNAPVIFDGRNLYDRGLMQELGFTYYSIGRQTVRS

SEQ ID NO: 25736 - protein, 555 aa, Prochlorococcus marinus str. NATL1A
MALINGFHLKNIRGDVLGGLTAAVVALPLALAFGNAALGPGGAIYGLYGAVVVGFLAALFGGTPAQVSGPTGPMSVTVAGVVASLAAVGVPRDLSAGEILPLVMAAVVIGGLFQILFGLLRLGKYITLVPYSVVSGFMSGIGVIIITLQIGPLLGISTRGGVLESLSTLFNNFEPNGAAVAVAVMTLAIVFLTPRKISQWVPSPLLALLIVTPLSILLFGDSSIDRIGAIPEGGLSLSLPDPSLGNFFPIILKAGLVLAVLGAIDSLLTSLVADNISQTRHNSDRELIGQGIGNAVAGIFTGLPGAGATMRTVINVKSGGSTPISGMVHSVVLLFVLVGAGPLAAQIPTALLAGILIKVGLDIIDWGFLLRAHKLSLKTASVMYGVLFMTVFWDLIWAVLVGVFIANMLTIDSITETQLEGMEADNPFDSTSNNNAANAQLPSDEKALLDRCAGEVMLFRLKGPLSFGAAKGITERMMLVRNYKVLILDITDVPRLGVTATLAIEDMVQEALSNSRKAYVAGATGRVKDRLAKFGVDVIGTRKEALVAAIDSLNG

SEQ ID NO: 25737 - protein, 311 aa, Prochlorococcus marinus str. NATL1A
MELNGFKDYFKILGISRNATDQEIKSAFRKLARQFHPDLHPNDQKAESEFKEINAAYEILSDEAKKKSYEQHLSYWFKKRAGKSRDFSTENNDNQFDEYLNFDDFLSDLIGRFSEVSQDIYSNISSNKNAQSLNLDAEFNLQISFLEALNGTKKNLLVNDERIEVTIPQGIETGSKIRIKNKGNIQSGKGKRGDLLIEVSVKSHPIWKVKGLDVYADLPLSLDEFALGANIMVVSPQGDTYLSIPSGSLPEQKLRLQGQGLHNLDTQGDLFFTLKLKLPENWSADELRLLEKLRSVRIDEPRSSWFEKART

SEQ ID NO: 25738 - protein, 127 aa, Escherichia coli
RGQYPSETVAAMARVCLGAEKIPSINVSKHRLDVQFDNVEEAIAMSAMYAANHLKGVTAITMTESGRTALMTSRISSGLPIFAMSRHERTLNLTALYRGVTPVHFDSANDGVAAASERLICCAIKVT

SEQ ID NO: 25739 - protein, 180 aa, Zea mays
MAEKKSRPRLNKRIMSSLSKRSVAAHSWHDLEIGECTFCAAVVEITKGSKVKYELDKKTGMIKVDRVLYSSVVYPHNYGFIPRTLCEDGDPMDVLVLMQGEKDDKIIAVCVDDPEYRHLTDLKELSPHRLNEIRRFFEDYKKNENKEVAVNDFLPPTTSLEAIQHSMDLYAEYILHSLRR

SEQ ID NO: 25740 - protein, 442 aa, Streptomyces carzinostaticus
MTDTAGRLLEFRMPDVGEGLTEAELLTWYVRPGDTVVDGQTVCEIETAKAVVELPIPFDGVVRELRCAEGETVPVGTVVITVAQARAPDPSPAPPAREPVLVGYGVASGPTSRRRRTAVPPPIRPAEPGSGPVLAKPPVRKLAKDLGVDLTRVVPSGPQGVILRADVHAAAHTAGTVVAPAPAPAAPSVPQESAPGPDGEPMETRGTGQPRETRVPVRGVRRATAAAVTASAFSAPHVTEFVTVDVTRTMKLVRDLRREPRFADRRVGPLLLVAKALLVAVERNPEINASWDDGAQEIVRKHYVDLGIAAATPRGLIVPAVKDAHTLSLAELAGALDDLVDAARAGRTSPAALSGGTVTLTNIGVFGVDSGTPILNPGEAAILAVGAITPRPWVHKGKVVPRQVVSLSLSFDHRLVDGELGSKVLADVAAVLERPHRLIAWS

SEQ ID NO: 25741 - protein, 363 aa, Ralstonia solanacearum GMI1000
MHNKDKRMTKIAVLPGDGIGTEIVAEAVKVLKTLGETFEMETAPVGGAGYEAKGHPLPEDTLKLAKEADAILFGAVGDWKYDTLPRELRPEQAILGLRKHLQLFANFRPAICYPELAGASSMKPEIVAGLDILIVRELTGDIYFGQPRGVRAAPDGLFAGAREGFDTMRYSEPEIRRIAHVAFQAAAKRGKKLCSVDKANVLETFQFWKDIVTDVHKEYPEVELSHMYVDNAAMQLVKAPKNFDVVVTGNMFGDILSDEAAMLTGSIGMLPSASLDANNKGLYEPSHGSAPDIAGKGIANPLATILSAAMMLRYTLGKAEQADRIENAVKKVLAQGYRTGDILTPGCKQVGTVEMGDAVVAAL

SEQ ID NO: 25742 - protein, 264 aa, Triticum aestivum
  misc_feature (234)..(234): Xaa can be any naturally occurring amino acid
NKFVQKSRLVPVRNSRDIVDPRVRPDMVDRMLRLLASYNVVSCRTEEGKDGRLSRRYGAAPVCKYLTPNEDGVSMSALALMNQDKVLMESWYYLKDAVLDGGIPFNKAYGMSAFEYHGTDLRFNRVFNEGMKNHSIIITKKLLELYKGFEGLNTLVDVGGGVGATVAAITAHYPAIKGINFDLPHVISEAPPFPGGTHVGGDMFQKVPSGDPILMKWILHDWSEEHCPKLLKNXCYNPLPAQGKGGLRELPPGGGTRKPTPRAP

SEQ ID NO: 25743 - protein, 132 aa, Oryza sativa Japonica Group
MYQAIPYNANRAWPAASRPATAAAAPPPPPPRGEEEEVRRAVAECPVVVVGRSGCCLSHVVKRLLQGLGVNPAVHEVAGEAELAGVVAGGGGVALPAVFVGGRLLGGLDRLMAVHISGELVPILKEAGALWL

SEQ ID NO: 25744 - protein, 335 aa, Ehrlichia ruminantium str. Gardel
MKIGINGLGRIGRCLIRCIYENNSIYKDFLELSALNGSTLPEIHAHLIQYDSVHGKFPHDVTYGKDYIAINNKEIPLSIEKEPNNIPWEKHNVDIVLECTGKFNKKPLAKVHINSKVKKVVVSAPMEDPDVTIVYGVNNEMLKNEHQVISAGSCTTNCIAPILKIMNDTIGIKNGFITTIHSYTNDQNLVDNNHKDLRRARASAMSMIPTTTGATKTINSIIPELKGKLNGTAIRVPTPNVSMIDLVFNSIKSTNSTEINNIIKELSQNSQVINITDKKLVSIDFCHSIYSAIVDAEETYVTDNNLCRIAAWYDNEWAFAMRMLDIVCLLSQHIN

SEQ ID NO: 25745 - protein, 306 aa, Salmonella enterica subsp. enterica serovar Paratyphi B str.
MTASLHIILDTDPGIDDAAAIAAALFAPQLDLQLITTVAGNVSVEKTTRNALQLLHFWNSDIPLAQGAATPLLRPLRDAAYVHGESGMEGYDFVDHQRQPLAKPAFIAIRDVLMNAPEPMTLVAIGPLTNIALLLMHYPECACNIHRLVLMGGSAGRGNFTPNAEFNIAVDPEAAALVFRSGLEIVMCGLDVTNQAMLSPDFLNKLPALNRTGKMLHSLFNHYRSGSMRTGVRMHDLCAIAWLVRPELFTLQSCFVAVETQGQYTAGTTVVDIEGRLGQPANAQVALALDVDGFRQWVAEVFAYAP

SEQ ID NO: 25746 - protein, 303 aa, Ehrlichia ruminantium str. Gardel
MHYCILINLCFTNLFNHYILMYTLYNVVAYKTMNILLIGCGNLGSILLNKWSLNDQISDIVVVQPSLSKKNIFNTINKITFVRDHKEINKSFMPQIVVIAIKPQQVANAIPDYKTYNKSASFISLCAGIDIEFLKKHLDSTTIIRVMPNIAMSLGESVNLAYMEEEIDQEKQKVHTVFNGTGLLYWLQKEDVFDKLSPITGSGPAYFFSLAEELVKNTMKAGIREEDAIKLISQTFIGSAKLLETRKNSISNLISSITSRGGITQAALEILNSHLPNIMSLSLKSATERLVHLKNSDDNKKNT

SEQ ID NO: 25747 - protein, 500 aa, Ehrlichia ruminantium str. Gardel
MGYVAHFLFSYCNMSFALKYRPSNFKDLIGQDVLVRILRNAFHLNKVPQSILLTGGSGIGKTTAARIISMCLNCASGPTSNPCNTCINCISIKNFNHPDVIEIDAASNTSIEDVKIILENSHYVPITSKFKVYIIDEVHMLSNSAFNALLKVLEEPAPYVKFILATTEVKKIPVTIISRCQRFDLQRIPTENIVDHLRIIAKEENILFDEESIKLIAYNSDGSMRNALSLLEQSAIYSNKNLSEESTKKMLGYVNRHVLLKIIESITNGNITEALNKFEEVCNTYSPVIVLDNILQMIYEICYFSITKKNDFLPDSDIITSIQNNKIQSPTFLSRLWQILSKGIQEVKSSACVKQAANMLIIRLCYLSDLPSPKQIIEKLQNNVKANENGLEINRKMLLALLKTNNMEDLYNQLSKSLLEITYNNDCTSNIILNTILPNNSQKELLNFLSNLTSKKWNICIKKNNDPCYNSQLDSTISDILQEFDGAKVINIETIKKEQQ

SEQ ID NO: 25748 - protein, 1152 aa, Candida albicans SC5314
MSHIDGDDHMTKDLIDSLESKDNDLSLVTSNTQIPDVEVANLTHDADEINQLFDTATNNVLPESNKKDKPIDTQDLHEDDPKAVPKTTSNGESTSNSNSVSPKLLPNDGKSTPKIQKELRRKSTFVPVTSNSKSLEPSEDDNNNNNNNSRISAYARLDFENFTFFVQTLQVVLGRKSNDETLQQNVDVHLSSKKAISRRHAKIFYNFGTQRFEISILGRNGAFVDNVFVEKGLTIPLTDGNKIQIGDIPFKFVLPSNEPNEENNNQDSSEKQFNPSDAINLRSNLYSKSSSPQSSPKRKPQPSKKVKKEPVSASNTSKDIKPTPPVPTTAISPTASISTSTNAATAATATTPATTTAARKNSINRRNSLLKIRRLSNARRKSLAANDEINELLKDLGVTSIDEINEEDSELLDAQIQSLLDEDNENLGGIEDSLMKLAEFNESAIDDDDDEEEGNENSQADLDRLEKTMEHDAIDDEIKAIDSNLTLLDDEISKLTPLINDTNQGLLEEKETKKKQLEEEKRKKQLQQLQHKNSLAKFPRRSAPLMGKPASIQPPASSSIYSRINGLDKIGKTVSPRPPPPKLIAPVLRVTAEPSAIRSRPPLRAITVSDSSYIATFSYPKTIEEPSKYPKPKVKKEHHKKHSKKVYSLDEIPEPYRSKPNISFQIMITNVLKTEAARNGLIINEITEAIKEVYPYYKYCTDGWQFSINHCIKFTKIYKRLQKRGSEWLYAMDELYINERENIRIKQREIAKAKAKAEALRQEEIRQRQRLEAQKSLPHNIVGRNFASPYANTRVPPNQYNQFSQSSSSSSSSATTTTNGQYGSTTMVGGTSPQAGSIRAQLAAVRGNGNTPATTSTTPSLPAMNDPKTKKSLEYLQKELFTLYKARKLTYDTQTATSLITKAVATTIAQVNSIGAKAGAGDNALVFLVERAPEKVSKILDIALTKSIKEYEGIASKSPSQPATPGMRPAQLTTTSQSAATPTTTPQISNLQSLPVKPPISTPLPQVPQQQVSGVNIPGPIATPNIGVTSGVGNLGTTSIGTPTPTQIQSPATSVIPAMQSPQKPVSTPIPTSVPVPLPVPSAPLARPPSFGKPPGAGSSLSRPKAFGKPPGAGSSLSRPPTFLSNKPSYKRELEDDEEEGEQATNKIAKTE

SEQ ID NO: 25749 - protein, 527 aa, Fusobacterium nucleatum subsp. nucleatum ATCC 25586
MNNILFLSSVVIIVSIFMYRYLSKFGVPMLLVFISLGMIFGVNGIFKIDYNNYELSRDICTFALIYIIFFGGFGTNLSMAKGIIKKSLILSSLGVIFTSLLTGVFAHYTLKIDWYTSFLIGSVLGSTDAASVFAILRSHKLNLKENTASLLEIESGSNDPFAYVLTISFLTLSKGGLNLPILLFKQVCFGLLVGYIFAKLSCLIIRKTKNLDSGMSMALIMASMLLSYSISEFIGGNGYITVYLLGVLVGNIKFNKKSEIVSFFNGITSIMQILIFFLLGLLVNPLEALKYTVPAILIMIAMTFIIRPFVVYLLINPLKSSRGQKLLTSWAGLRGAASVVFAILVVVANKEIGMVVFNIAFIVVLLSIAIQGSLLPFFSKKFDMIDEEGDVLKTFNDYSDTEDVDFITAEIDKNHKWVGKQVKNLEFMPSVLLVLIIRNGQNIIPNGDTIIEKGDRVVLCGSSFVDKNTRINLYESTVDKNSKYKNKSIRELDKNTLIVMIKRNDVAMIPSGNTTLLENDILVLLDR

SEQ ID NO: 25750 - protein, 376 aa, Prochlorococcus marinus str. MIT 9313
MTLCQVWAASSSGTAESATYFCMIGGHFPCGFPVFVMTLRVAINGFGRIGRNFMRCWLSRGANTGIDVVGINVTSDPKTNAHLLKYDSILGQIKDAEIGYTDDTFVINGKTIKCFSDRNPLNLPWKEWGIDLVIESTGVFNTDVGASKHIEAGAKKVILTAPGKGDGVGTYVVGVNADQYRHGDFNVLSNASCTTNCLAPIVKVLDQTFGINKGLMTTIHSYTGDQRILDNSHRDLRRARAAAMNIVPTSTGAAKAVALVYPQMKGKLTGIAMRVPTPNVSAVDLVFESGRSTTAEEVNAALKSASQGGMKGIIKYGDLPLVSSDYAGTNESTIVDEDLTMTIGDNLVKVVAWYDNEWGYSQRVVDLAEIVAKNWK

SEQ ID NO: 25751 - protein, 720 aa, Mycobacterium bovis AF2122/97
MPDNTIQWDKDADGIVTLTMDDPSGSTNVMNEAYIESMGKAVDRLVAEKDSITGVVVASAKKTFFAGGDVKTMIQARPEDAGDVFNTVETIKRQLRTLETLGKPVVAAINGAALGGGLEIALACHHRIAADVKGSQLGLPEVTLGLLPGGGGVTRTVRMFGIQNAFVSVLAQGTRFKPAKAKEIGLVDELVATVEELVPAAKAWIKEELKANPDGAGVQPWDKKGYKMPGGTPSSPGLAAILPSFPSNLRKQLKGAPMPAPRAILAAAVEGAQVDFDTASRIESRYFASLVTGQVAKNMMQAFFFDLQAINAGGSRPEGIGKTPIKRIGVLGAGMMGAGIAYVSAKAGYEVVLKDVSLEAAAKGKGYSEKLEAKALERGRTTQERSDALLARITPTADAADFKGVDFVIEAVFENQELKHKVFGEIEDIVEPNAILGSNTSTLPITGLATGVKRQEDFIGIHFFSPVDKMPLVEIIKGEKTSDEALARVFDYTLAIGKTPIVVNDSRGFFTSRVIGTFVNEALAMLGEGVEPASIEQAGSQAGYPAPPLQLSDELNLELMHKIAVATRKGVEDAGGTYQPHPAEAVVEKMIELGRSGRLKGAGFYEYADGKRSGLWPGLRETFKSGSSQPPLQDMIDRMLFAEALETQKCLDEGVLTSTADANIGSIMGIGFPPWTGGSAQFIVGYSGPAGTGKAAFVARTRELAAAYGDRFLPPESLLS

SEQ ID NO: 25752 - protein, 742 aa, Aspergillus oryzae
MAETPVDALLKGNTGRNTRGLLRIIILVTIAAAAVSSRLFSVIRFESIIHEFDPWFNFRATKYLVQHGFESFWDWFDDRTWHPLGRVTGGTLYPGLMVTSGVIYHILRFLTIPVDIRNICVLLAPAFSGLTAFAMYLLTCEMSISPSAGLLAAAFMGITPGYISRSVAGSYDNEAIAIFLLVFTFFLWIKAVKNGSIMWGALTALFYGYMVSAWGGYVFITNLIPLHVFVLLCMGRYSSRLYISYTTWYALGTLASMQIPFVGFLPIRNSDHMSALGVFGLIQLVAFADFVRGFIPGKQFQRLLTAMVIIVFGVAFAGLVLLTVSGVIAPWSGRFYSLWDTGYAKIHIPIIASVSEHQPTAWPAFFFDLNLLIWLFPAGVYMCFRDLKDEHVFVIIYAVLASYFAGVMVRLMLTLTPIVCVAAALALSTIIDTYVFASRGPSPQSKAQDETSAEGLRSTRNPVVGISSYISKAVVTSSVVIYLLLFVAHCTWVTSNAYSSPSVVLASRMPDGSQFIIDDYREAYYWLRQNTPDNAKIMSWWDYGYQIGGMADRPTLVDNNTWNNTHIATVGKAMSSREEVSYPILRQHDVDYVLVVFGGLLGYSGDDINKFLWMVRIAEGIWPDEVKERDYFTARGEYRVDDEATPAMRNSLMYKMSYYNYNALFQQGQAMDRVRGSRLPAEGPQLSTLEEAFTSENWIIRIYKVKDLDNLGRDHNSATAFERGHKRKRATKRKGPRVLRTE

SEQ ID NO: 25753 - protein, 186 aa, Pyrococcus furiosus
AHHHHHHGSNPFHDLEPGPDVPEVVYAIIEIPKGSRNKYELDKKTGLLKLDRVLYSPFFYPVDYGIIPRTWYEDDDPFDIMVIMREPVYPLTIIEARPIGLFKMIDSGDKDYKVLAVPVEDPYFKDWKDIDDVPKAFLDEIAHFFKRYKELQGKEIIVEGWEGAEAAKREILRAIEMYKEKFGKKE

SEQ ID NO: 25754 - protein, 416 aa, Leptospira interrogans serovar Copenhageni str. Fiocruz L1-130
MTDMSFSAERIRTDFPILGTKMNGKPLVFLDSAASSQKPFTVIDTIEKYYREENANIHRGIYYLSQKATEKYELSRIRLSKFIGAQCAKVCIFTRNATESINLVAQTWGRTQIKEGDEIVLNELEHHSNIVPWQMLAQEKKAVLKFIPLNEDSTLDFSNLQEIITTKTKLVAISQMSNVTGTIHDILPVQKRAKEVGAKLLVDGAQGVCHLPVNMKEMEYDFYVFSAHKMLGPTGVGVLYAKEEILEEMPPWMGGGDMIAQVYKEKSTYAELPSKLEAGTPNIAGVIGFGSAIEYLENIGMQEIRNHEIELLSYALNRLDDFGGLELYGTRDLSKRGGVISFNFPGVHPHDVGTILDEEGIAIRVGHHCAQPFMAFQNIPGTCRASLYLYNTKDDIDRLIQGLIKVKEIFSRVLKR

SEQ ID NO: 25755 - protein, 258 aa, Triticum aestivum
MAANFWTSSHSKQLLDPEEVDVVPAQDRERGVTPVEFRLVKIHMSFHIWRLAQQVKVRQRVIATAITYFRCVYTRKSMTEYDPRLVAPACLYLASKVEESTVQARLLVFYIKKMCAGSDDKYRFEIKDILEMEMKLLEALDYYLVVYHPYRPLLQLLQDAAVTDLTQVAWGLVNDTYKMDLILIYPPYMIALACIYIASVLKDKDTTSWFEELRVDMNIVKNISMEILDFYDTYKIDPQRGLQEDKIIPVMNKLPSKA

SEQ ID NO: 25756 - protein, 327 aa, Glycine max
NEVNFFVCDENVESRFKMPEKSIPKDAAFQIINDELMLDGAPRLNLASFVTTWMEPECDKLIMASLNKNYVDMDEYPVTTELQNRCVNIIANLFHAPISEEETAVGVGTVGSSEAIMLAGLAFKRKWQTKRKAEGKPYDKPNIVTGANVQVCWEKFARYFEVELKEVKLKEGYYVMDPAKAVEMVDENTICVAAILGSTMTGEFEDVKLLNELLTEKNKETGWDTPIHVDAASGGFIAPFLYPDLEWDFRLPLVKSINVSGHKYGLVYPGVGWVVWRSKDDLPDELVFHINYLGSDQPTFTLNFSKGSSQIIAQYYQLIRLGFEGYK

SEQ ID NO: 25757 - protein, 97 aa, Zea mays
  misc_feature (37)..(37): Xaa can be any naturally occurring amino acid
  misc_feature (69)..(69): Xaa can be any naturally occurring amino acid
  misc_feature (75)..(75): Xaa can be any naturally occurring amino acid
CNHTLGHCGLTTSNVLKTNCILWLSIVFVTILCTPQXEHVIMWSPNPTVSVDLLHQLEGFCARNASPYXVQWLGXLPFTTLQMVQLAVIRRSHEPSF

SEQ ID NO: 25758 - protein, 464 aa, Thiobacillus denitrificans ATCC 25259
MDRIVRLREYLADCRRATGWATPIAASGRLTRVSGLVMEAVGLRMPVGSQCHIQIPGGQSIEAEVAGFAGDRLFIMPATDIYGVMPGARVVPDNPLAAQPPRLGMRYIPRRRAQDRVRQVPVGDSLLGRVLDGAGRPLDGIGPLSLERRVPLYSRPINPLERAPIRETLDVGVRAINGLLTVGRGQRLGLFAGSGVGKSVLLGMMARMTEADVVVVGLIGERGREVKEFIDRILGAEGMARAVVVAAPADHPPLMRLNGAAYAMSIAEYFRDQGKHVLLIMDSLTRYAMAQREVALAIGEPPATKGYPPSVFAKLPQLAERAGNGRSGSGSITAFFTVLMEGDDQQDPIADAARAILDGHIVLSRDLADAGHYPAIDIEASISRAQPDLLTEEALERTRRFKYLYSRYMRSRDLLAVGAYVPGADVVLDEGVRLYPRMQGYLMQGMREQASLDAARDGLEGILG

SEQ ID NO: 25759 - protein, 306 aa, Prochlorococcus marinus str. MIT 9313
MLTELVKRSPPLPTGSKLLVLGGGFSGQHVVALARALGSTAICSRRDINSPDADIAFDSATKLLPATKVLEGVTHLLSCIPPAADGKDPVLTCLGDQLRALPLQWVGYLSTTGVYGDRQGRWVTEIDHPQPQQARSKRRLACEEAWQASGLPLQILRLPGIYGPGRSVLKNVNTGQSRMIHKPNQVFSRIHVDDIAGAILHLIQCAADGQRPIVINVTDDLPTAYTDVLGFAAQLLGKSLPEIEPFAVAAAQMNPMALSFWQENRRVSNQLLCRELGYSLMHPNYQSGLRDCYLAEGFKVSQTNFP

SEQ ID NO: 25760 - protein, 644 aa, Prochlorococcus marinus str. MIT 9211
MTLISLINASKDFGIRSLFTNLDLHISQKERLGLIGPNGAGKSTLLKILAGIEPLLEGERLCSPSLKISLVGQENKLNKDKTILEAVLEGCGEKRDLLIRFNKLTSAVAKNPQQKNLLAQLGHTSELMDTANAWNLEQQCKEILRRLGIHDLGIPIGELSGGYQKRIALASALVANPDVLLLDEPTNHLDASAVEWLQSWLDTYKGALVLVTHDRYVLDKVTKRMIEVNSGIARKYSGNYTNYLQQKVQEEYSEAASKKKFQGILRKELSWLRQGPKARSTKQKARLQRIADMQAKPINQPKQTLEIHSLSKRIGKIAIETEALRLTIDGKEKSPVLFDEFTYSFSPEDRVGIIGPNGSGKSTLLDLIDGRRTPNGGLIRLGETVKIGYLDQHTNDLNTGKGLQRKVIDFIEEAAIRINTGKQQITASQLLERFLFSPEQQHSPLNKLSGGEKRRLSLCRLLIQAPNILLLDEPTNDLDINTLSVLEDFIEDFKGCVVIVSHDRYFLDRTVDIIFNFESGKLRRYQGNYSYFLEKKNAQNTNEKKKVNSIKKVGKNSNIAIKNTSQEKNDYERNKPRRLTFKESRELKELNEELPKLEEIKSLLESKIASGAGDIIKNSLELAQIIESLEKAETRWIELSELNE

SEQ ID NO: 25761 - protein, 284 aa, Xanthomonas campestris pv. campestris str. ATCC 33913
MSESDTTHCPQVTLRNGRSVPALGMGSWNLVQGRHAPQQEIEALQTGQALGMRLIDTAEMYGNGRSEQLISQVIARGQPPYLVSKVLPSNASARGIARACEASLQRLGVRTLDLYLLHWRGGSDLAEVVAAFETLRDAGKIRDWGVSNFDVDDMQELWQIDGGQHCLVNQVLYHAGSRGIEFDLLPWCAQHAVTVMAYSPLGSRALLDHPVLHAIGARRGVAATAVALAWAIRSGQVIAIPESGTPAHVRANADACTLQLDARDLADLDSAFPPPTRKQPLDLL

SEQ ID NO: 25762 - protein, 432 aa, Magnaporthe grisea 70-15
MLPQITDRWHCSGPYFKEYFNNPTRAQVGAMVAILEVGAFISSLMVGRIGDIIGRRRTILYGSMIFFVGGAMQTLATGFEMMLVGRVIAGLGVGMLSTIVPVYQSEISPPHNRGKLACIEFTGNIFGYATSVWVDYFCGFITSNMSWRLPLMMQCIMGALLGLGSLIIVESPRWLLDNDHDEEGIVVIANLYGGGDIHNSKAREEFRDIKMDVLIQRQEGERSYSEMFRRYRTRVFIAMSAQALAQLNGINVISYYAPYQRHNLPALNRPAMTPMLVVIFVMIYNAAFGYSWGPIPCFVIVYFIYPETCGVRLEDMGSLFGDSTTAMGTPATMGTPAQDPETGALLRPSSPIPPLDIRNGSGGPFGAAGAIPGLNIDPPDQAAVDAKNSRDAEQGGGGIGAWFSRLMGRGRSRNGESSRDGGRYTAIGQGDD

SEQ ID NO: 25763 - protein, 473 aa, Burkholderia vietnamiensis G4
MRPSRPPELAASFERQRSAYARDPAPPLAIRLSRLDRLRALLDTHEAALVQAIDADFGGRSAHETRLAELFVVHSGLRHARAHLRQWMRERRVPTAAHFRPGYNRIAPQPRGVVGVMAPWNYPLQLALGPAVAALAAGNRVLVKPSDLTPRLSALLESLVADAFDVDELAVVTGDVDTAKAFARLPFDHLFFTGSTAVGRDVAQAAAANLTPVTLELGGKSPAIVDPSCDLAHAAARIAFGKLLNAGQTCIAPDYLLVPAGTAETVAARVADAIAHHYPTLAANPDYTSIIAATPRDRLAALVDDARAGGARVREVNPAGERFAAGSRKFAPTLVLDARDTMRVMREEIFGPVLPIVEYADLDDAIDRVNRGPRPLALYWFGRDAARRDRVLRETVSGGVTVNDCLWHLAQEHQPFGGVGASGIGAYHGKWGFDTFSHHKPVFHQARRSGTALFHPPYGKTFDLLLRVLTRFA

SEQ ID NO: 25764 - protein, 324 aa, Prochlorococcus marinus str. NATL1A
MAIPPIFVKAARDIWSFEWKILMNGLAPSDSNGNYKRPINIQQQIQIPTKEDLNNRASNQMPGLIIGRSCPWAHRAWIIHEIKGLKKSINLHIAQVDNEGGRWRLDPPIKGCKTLQELYQKCGNYQSRRATVPMLFDPGKEPKSKLRLINNESAELVEILNNWPIYDQEIDLNPSKYKKEIINWQNLIQENINNGVYKCGFARNQKAYEKASKNLFSTLNIIEEHLKSNGPWLCGKNLSIADIRLFPTLIRWEAIYYPLFKCSNKPIKSFPHIIKWRKKIFNMYNIKKTCDVDAWRKDYFGALFPLNPSSIIPKGEDITTTINN

SEQ ID NO: 25765 - protein, 519 aa, Zea mays
MVRNFTPKMVQLFLQVPAECGSVNTVVVEGRRSLFHNVESIIKSLTKSAGRYEARLWLCATVSLVHSLSDCGQRDLFLDLLERKNSRRDVAARLLRMIFDKKPRMVGSILARKGHILEDFFRGNPNRIMQWFGHFAVTGESTHRKGAKALSQFAFVNRDRCWEELEWKGKHGQSPAVVATKPHYFRDLDVLETVENFLEYVPDFWSSDELANSIKDGEILQIDEEYFVDQFLYLMYEENSKDAWHVVEDFLMDEQFSSLCQHLLIHLDEERLLGFLNSLGKLINPTRQCKELTFPCCWLEVLLSGHYDHISLDDLVFLNCVIAKGRQLWRLMNDEEQHEEWGQMEELLKGVNHLTDADHFALMKEHVETELPGMLKWVGIQSWIIFCELSKECKSGDSCESFFSHNKIEFHKADDYSLVRNYGFSISHMPDIDVEDLTGSSNKRRKRNRRKRHRYESDEDKFDELLELGSSDGKNGVESQRGSWRLSTDGFSASWDISDIPDHLSTCYFTIWVKWACFR

SEQ ID NO: 25766 - protein, 250 aa, Arabidopsis thaliana
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITVITGVFYWIAQLLGSTAACFLLKYVTGGLAVPTHSVAAGLGSIEGVVMEIIITFALVYTVYATAADPKKGSLGTIAPLAIGLIVGANILAAGPFSGGSMNPARSFGPAVAAGDFSGHWVYWVGPLIGGGLAGLIYGNVFMGSSEHVPLASADF

SEQ ID NO: 25767 - protein, 226 aa, Glycine max
MATPASITNVTVEFLQFPALVTPPGSTKSYFLGGAGVRGLNIQEEFVKFTGIGVYLEDKAVSSLAAKWKGKSAAELLDSLDFYRDIIKGPFEKLIRGSKLRTLDGREYVRKVSENCVAHMQSVGTYSDEEEKAIEEFRNAFKDQNFPPGSTVFYKQSPTGTLGLSFSKDETIPEHEHAVIDNKPLSEAVLETMIGEIPVSPALKESLATRFHQFFKELEANPNIEN

SEQ ID NO: 25768 - protein, 391 aa, Oryza sativa Japonica Group
MGSMDTMIGRIFNNISSLKSAYIQLQEAHTPYDPDKIQAADQLVIEELTKLSELKHAYREKNPKPVAATPQDARLLSEIQEQQNLLKTYEVMVKKFQSQIQTRDTEITHLQQQIDEAKLRKSKLEKKLKQRGLLNKESEESDDEDNYFSIELTPSLFTSAVDNAYQSIHDFSKPLINMMKAAGWDLDAAANAIEPAVVYTRRAHKKYAFESYICQRMFGGFQEESFSVKAANITVSNEAFFHQFLAVRAMDPLDVLSQNPDSVFGKFCRSKYLLLVHPKMEGSFFGNMDQRNYVMSGGHPRTPFYQAFLKLAKSIWLLHRLAYSFDPKVKVFQVKKGSDFSEIHMESVVKNIILDEGAERPKVGLMVMPGFLIGTSVIQSRVYLSGVKSAD

SEQ ID NO: 25769 - protein, 371 aa, Chlamydomonas reinhardtii
MKPPRQKTKVLVRKLPPAMSEDTFKSVLDSVAAGRYNWLSYYAGKVSLKRVASSRAYINFVSEEDVYNFKQRFDGHVFISRQGNQYRCAVEYAPLQKMPTLEAKPHPLEGTIDQGGGGKGRREQSGRQGKGQQAPAGAEAEAATAGRGKASGKNGKAAAAAAAAAAAVSLEEAGHEAHEPRERGAGRHGKGREREPRGAPAAAAADADATAAGPSSSSRGERGAKGERSGKGARNAKAAAVASLLGDDEGPAPSQQQPLVVRPQPTAAPKLLLMKGGARTTQVAAQPADAEAGPAVTAAEKPGRKEPRGHRQDSGAAQEPMYGTHKTVPACRLTRLHLYRALSSPYLFAFARGSCSTAYKTSCRRFSAHKP

SEQ ID NO: 25770 - protein, 225 aa, Legionella pneumophila str. Lens
MRLLLVEDDELLGDAVKAGLTQFGYVVDWLKDGEAARAALKSESFELIILDLGLPKLSGLSLLQNIRHDGNSTPVIILTARESIEDRVKGLDSGADDYLIKPFDLNELSARIRALVRRSQGRADSVLQYKNITLDPAAHSVFVDDVLVNVPRREFALLQKLLENSGQVLSREQLMQSIYGWEEDVDSNALEVHIHNLRKKLNANFIRTIRGVGYMAEKNDSVLLS

SEQ ID NO: 25771 - protein, 281 aa, Glycine max
SIWSLPNPLPGTPRLTTAAMACAFSASTVSTAAALVASPKPAGAPQCLSFPRAIAGAAARPSRLAAASSRTARARSFVARASAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVQENPDEVCPAGWKPGEKSMKPDPKGSKEYFAAI

SEQ ID NO: 25772 - protein, 124 aa, Zea mays
MAEAPETAAPTQPPPAPAASSPPPKSGIPPRYDLDAKWDACLDLSIRRVAYSSLAGALAGLLLFRSPTTRWASVTLGAGVGIGAAYTECSYLFSGGPPNWSPKVSTIPSAHSEVIALSFSLNPV

SEQ ID NO: 25773 - protein, 421 aa, Sulfolobus solfataricus
MEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKKLEDHDLRTAAMALAVDRVVRAMKARGIL

SEQ ID NO: 25774 - protein, 437 aa, Zymomonas mobilis
MRITMIGSGYVGLVSGACFSDIGHNVICVDHDQEKIALLQKGVMPIYEPGLADMVANNVKAGRLSFSNDLASSVKDADAVFIAVGTPSRRGDGHADLSYVFAAAKEIAASVSDNTVVVDKSTVPVGTGDEVERIIREIAPDKKIWVASNPEFLREGAAIGDFKRPDRIVIGTENPEAREIMQEIYRPLYLNQSPILFTSRRSAELIKYASNAFLATKITFINEMADLCEAVGGDVQDVARGIGADNRIGSKFLHAGPGYGGSCFPKDTLALLKTAENFATPLRVVESVVTANNIRKRAMARKVLQAIGKDMRGQKIGLLGLPFKPNTDDMRDAPSLALIQGLEDAGAIIHAYDPEGMVQARPLLPNVIFEDEPYKVAEKAEALVIVTEWDAFRALDLKRIAGLLKTPLLLDLRNIYTEEEAKKAGLVYHGIGRPHAG

SEQ ID NO: 25775 - protein, 409 aa, Corynebacterium diphtheriae NCTC 13129
MPRWINTRSPEQLDTDARALFTQAFGNEPEGVWAAPGRVNVIGDHVDYAGGMSIPFALQQNTAVAVRQRDDALLNVVSLIPGAKEPARLSIPLAEVGPLNPDSWAGYVVGTVWAGVQSGVIPRCSGLDIAVVSDVPVGSGLSSSAALECSIGVAAYELAVGHAPDAAARAELVEAAIRAENEVVGASTGGLDQRASIFGEEGKALVIDFHTNQFRLVPFDLESRGLVLLIADTNAPHALNDGQYASRRGVTDEVAHALGGENATIRSVNSTGDILDRTREWAAANNKDIDVVVRRVKHIVEETERTAEAATALDAGNFDRFRELMKDSHISLRDQYKVSTPELDSAFDAAGQYGARMTGGGFGGSVITLVAADRVEEVATAIADAAQRQGYPEPTFVVASPGRGARRLS

SEQ ID NO: 25776 - protein, 332 aa, Staphylococcus epidermidis ATCC 12228
MRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGWGDNAKAALMTRGLAEISRLGEKLGADPMTFLGLGGIGDLIVTCTSTHSRNYTLGFKLGQGKTAEEALKEMKMVVEGIYTTKSVYHLAQQEGVEMPITNALYEVLFEDVPVSKSVRTLMERDKKAE

SEQ ID NO: 25777 - protein, 393 aa, Prochlorococcus marinus str. MIT 9211
MALIIFCWLSLPRGFILIKLVFAYRSRAFLMLKVGIIGLPNVGKSTLFNALVANAQAQAANFPFCTIEPNIGTVAVPDERLNLLAALSSSKEIISARIEFVDIAGLVEGASQGEGLGNKFLANIREVDAIVHVVRCFEDENVIHVSGSVDPIRDIEIINLELGLSDLAQIEKRKERLQKQIRINKDAQLEYAALERINLTLQQGGAAREVDLQDEERILVKPLGLLTSKPIIYASNLTEDDIAIGNAYSTKVNDFAVSQGSQNVKISAQVESELIDLGEQERLDYLNDLGVKEGGLQSLIRTSYDLLGLQTYFTTGEKESRAWTIKQGMTAPQAAGVIHTDFERGFIRAQTIGYRKLLEAGSFVEAKSKGWLRSEGKDYVVEEGDVMEFLFNV

SEQ ID NO: 25778 - protein, 347 aa, Leptospira interrogans serovar Copenhageni str. Fiocruz L1-130
MLEKYGKIPKRYPVSLAPMMDWTDRHFRYFLRLISKHTFLYTEMVHTGAVLHGDRRKLLSYSPEELPLAIQLGGSDPKALAESCKIGEDYGYTEINLNVGCPSDRVREGNFGACLMETPEKVAELTFAMDTSVSIPITVKCRIGIPGKETFEDLCKFIECVRQTGVQRFIVHARIAILGGLTPAQNRQVPPLHYTYVESLKKEFPDLLIEINGGIRTITSIRERLEKNDGVMIGRAAYETPYLFSEVDSLFFGENLPPLSRREILLRMKDYIEEVILKEKNGKPHHALRHMLGLFHGEKGARSFRKILTEGMYSGYSKDLLSKAIQEISNDSLDIVSSNAYLYKSGS

SEQ ID NO: 25779 - protein, 438 aa, Arabidopsis thaliana
MSSTHQLVSSMISSSSSTFLAPSNFNLRTRNACLPMAKRVNTCKLQAGYLFPEIARRRSAHLLKYPDAQVISLGIGDTTEPIPEVITSAMAKKAHELSTIEGYSGYGAEQSAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSEFGPGGEGFVRVSAFGHRENILEACRRFKQLYK

SEQ ID NO: 25780 - protein, 491 aa, Pseudomonas putida
MSQRLAAYENMSLQLIAGEWRVGKAGRDLDVLDPFTQEKLLQIPLANREDLDEAYRSARQAQVAWAACGPSERAQVMLNAVRIFDERRDEIIDWIIRESGSTRIKAQIEWGAARAITQESASLPSRVHGRILASDVPGKESRVYREPLGVIGIISPWNFPLHLTARSLAPALALGNACVIKPASDTPVTGGLLLAHIFEEAGLPKGVLSVVVGSGSEIGDAFVEHEVPGFISFTGSTQVGRNIGRIAAGGEHLKHVALELGGNSPFVVLADADLDQAVNAAVVGKFLHQGQICMAINRIIVEDSVYDEFVNRYAERVKSLPYGDPSKPETVVGPVINAKQLAGLQDKIATAKSEGARVMVEGEAQGNVLPPHVFADVTADMEIAREEIFGPLVGIQRARDEAHALELANSSEYGLSSAVFTSSLERGVKFARGIRAGMTHINDIPVNDEPNAPFGGEKNSGLGRFNGDWAIEEFTTDHWITVQHAPRRYPF

SEQ ID NO: 25781 - protein, 144 aa, Larix laricina
VRYRNHEEAALAIQLANGRVICGKSIKCSWGSKPTPPGASSNALPPPSAPFQGVVAAQGLNQGYTAADILAYRQMNMSQAGAGQPLLPLSAQQGMGLGLGHGPMGVVGPAGNQNLYDNFQAGAGLPSAAAAAAAAMRQQIMYYQ

SEQ ID NO: 25782 - protein, 621 aa, Coccidioides immitis RS
MKPATSTANWSKGETQRSLIGTLFGRPHRDATLDDVELLPSQPEEQELQSLPAFFFSFGEGSDPLQEGGLSWLRPCRESSTCDTDGQVHSMLRAYMIMEEEPGCLIRTFTAGKMLSALKDIPPGHLALGAAACFLLYQVYLYLTLGLARRKFIQQNGCRPPPAYPHKDPILGLDWALKGMKYSRSRTFLQGTQKRFREHGNTHSLNVIGKPAIATCDPENIKATLATKFQDFDLSTVRKRLFQPLFGKGIFTTDGAEWEHSRAMLRPNFVRSQVADLDMIERHLKNLFKEIPTDGSTVDLQDLFFDLTLDTATEFLFGESAYTLTKKDMGSGERFSDIFTYCTAVIGQWARLGIFLGIPDRRYHRYAAGVHEFADRYVQKALENYRAQQSGMITSDKTSNRYIFLDELVKSTQDPVELRSEALNILLAGRDTTASLLACLWNVLSKRPDVWSKLLNEVDALNKKRPSFEELKNMKFLRYCVNEALRLYPVVPGNTRVAVRDTFVPVGGGPDGKSPVFVPKGTLLNYSVYTMHRREDIYGPDAAEFKPERWEKLRPGWEYLPFNGGPRICLGQQLALTEASYTTVRLMQEFRHVESRDPNPWEELLTVTCASAHGAKVALRP

SEQ ID NO: 25783 - protein, 382 aa, Prochlorococcus marinus str. MIT 9313
MQDKLTLMIPGPTPVPETVLKAMGRHPIGHRSGEFQAVVRHTTEQLRWLHQTKADVLVITGSGTAAMEAGIINTLSYGDKVLCGDNGKFGQRWVKLAKAYGLDVQVIKADWGQPLDPEAFKKALEADNGKTIKAVILTHSETSTGVINDLETISKYVRTHGKALAIADCVTSLGACNVPMDSWGLDVVASGSQKGYMMPPGLSFVAMSERAWQAHQQSDLPKFYLDLGPYRKTAAQDSNPFTPAVNLYFALESALGMMQSEGLEAIFERHARHRAAAQAGMKAICLPLYAAEGHGSPAITAVAPEGIDAEQLRKTVKEKFDILLAGGQDHLKGKVFRIGHLGFVCDRDILTAIAAIESTLQSLGLHKGNMGDGLAAAAAILR

SEQ ID NO: 25784 - protein, 629 aa, Prochlorococcus marinus str. MIT 9312
MLLSELSHPNELHGLTVSQLEEIACQIRERHLQVVSTSGGHLGPGLGVVELTLALYQTLDLDSDRVVWDVGHQGYPHKLITGRFSQFDSLRQQNGVAGYLKRSESKFDHFGAGHASTSISAALGMAIARDRKGENHKCVAVIGDGALTGGMALEAINHAGHLPNTPLVVVLNDNDMSISPPVGALSSYLNKVRLSPPLQFLSDSVQESVKNIPLIGKDIPEELKNIKGSVRRLAVPKVGAVFEELGFTYMGPIDGHDIENLINTFNAAHRLKKPVLVHIVTTKGKGYPYAEADQVGYHAQSAFDLTTGKSIPSKKPKPVSYSKIFGQTLLKICEQDSKVIGITAAMATGTGLDILQKNIPEQYVDVGIAEQHAVTLAAGMSCDGLKPVVAIYSTFLQRAFDQLIHDVGIQNLPVSFVLDRAGIVGADGPTHQGQYDISYMRSIPNFVLMAPKDESELQRMLITSINHKGPTALRIPRGSGLGVAVMDEGWEPLNIGEAEILEEGNDILIIAYGSMVASAIETAEILKGMNINTCIVNARFVKPLDKNLIIPLASRIQKVVTMEEGTLIGGFGSAIVELFNDNEVNIPVYRIGIPDVLVDHASPDQSKEKLGLMPDQMADKIIQKFKLNN

SEQ ID NO: 25785 - protein, 669 aa, Yersinia pestis KIM
MRHVYMTTELETSFADLGLSAPILSALTDLGYEKPSPIQLECIPHLLNGRDVLGMAQTGSGKTAAFGLPLLHNIKADLKSPQVLVLAPTRELAVQVAEALSSFSKHINGVNVVALYGGQRYDVQLRALRQGPQVVVGTPGRLLDHLKRGTLNLSNLSGLVLDEADEMLRMGFIEDVETIMAQIPAEHQTALFSATMPEAIRRITRRFMKEPQEVRIQSSVTTRPDISQSYWRVGGGYRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLQNIERTMKLTIPEVELPNADLLSERRLAKFAAKVSQQLESSDLDMYRALLAKLQPEEEFDIETLAAALLKMAQGERPLILPPEAPRRPQREFNSRDDRGNDRGSRDRGDSRRDNRSDSRSADSRDGGERPARRERRDVGEMELYRIEVGRDDGVEVRHIVGAIANEGDISSRYIGNIKLFASHSTIELPKGMPGEMLSHFTRTRILNKPLNMQLLGDAQPHERRERPAGGNGGERRGGGRPFSGERREGAGAPPRRSFSGDRAPTGGGERRGNRDGQRSAAPRRDDAAAPAAAAAAPARRRFGDA

SEQ ID NO: 25786 - protein, 460 aa, Thiobacillus denitrificans ATCC 25259
MTTFAELGLAPDILRALDEMGYVSPTPIQAQVIPRALQGGDILGAAQTGTGKTAAFALPLIQRLLPFANTSTSPAKHPIRALILTPTRELAIQVEEAIQAYTKHVPLRSLVVYGGVNINTQIPILKTGVEILVATPGRLLDHVQNKTLMLTQVNTLVLDEADRMLDMGFMPDLRRIVALLPAQRVNMMFSATFPEEIRKLADSILSTPTFIEVARNETAVTVTQVVHPVHHERKRQLLAHLIKSRDLRQVLVFTGTKLGCNRLANELNKAGIHADAIHGDKTQQERIKALDAFKAGTIRVLVATDVAARGIDIEALPFVVNYDLPHNAEDYVHRIGRTGRAGAKGEAISLVSEAETRYLKDIERLIGTPLEPVIVPGFEPGAADVPAFESRPARAPRSSDRGRERAPAKPQPSRDALFDAPYVPREPGQGDAAHAPARPAPTKQVAALFRSPVKRNVPDQ

SEQ ID NO: 25787 - protein, 528 aa, Prochlorococcus marinus str. MIT 9313
MSNSQSEGKRQPAIVILDFGSQYSELIARRVRETEVYSLVMSYCTSADELRQLAPKGIILSGGPSSVYAERAPLCDPNIWDLGIPVLGVCYGMQLMVQQLGGRVEAAIGKAEYGKAPLQVEDPRDLLTNVESGSTMWMSHGDVVRDLPEGFVRLAHTANTPDAAVADHNRQFYGVQFHPEVVHSSHGIALIRNFVYHICGCEPNWTTTAFIEEAIAQVQAQVGQKRVLLALSGGVDSSTLAFLLKKAIGDQLTCMFIDQGFMRKGEPEFLMDFFDQKFHINVEYINARQRFISKLKGIIDPEEKRKIIGTEFIRVFEEESNRLGPFDYLAQGTLYPDVIESSGTNIDPKTGERVAVKIKSHHNVGGLPKDLQFKLVEPLRRLFKDEVRKVGRALGLPEEIVRRHPFPGPGLAIRILDEVNDEKLNCLRDADLIVREEIREAGLYHEIWQAFAVLLPVRSVGVMGDKRTYAWPIVLRCVSSEDGMTADWSRLPHELLERISNRIVNEVRGVNRVVLDITSKPPGTIEWE

SEQ ID NO: 25788 - protein, 312 aa, Bradyrhizobium japonicum USDA 110
MTTSDSLRDTRIPTHESVTIPAVGFGTLIPDPLVTRQAIRAALEAGFRHLDCAERYRNEAAVGDAMQDAFKAGKLRREELFVTTKLWNTNHRPERVKPAFDASRRRLQLDEIDCYIIHTPFAFQPGDEQDPRDASGRVIYDSGVTLVETWHALERLVDEGHCKSIGLSDITLEKLREIVAVARIRPAMVQVESHPYLPEWDLLDFCREHGIVLQAFAALGHAMEPRVLEDPVITAIARRVQKTPAQVCLAWAVQRGTAFLTTSTNPARIRENFDISALPEDAMREIRDGITTNVRFNAVVETGVPGFIPRAR

SEQ ID NO: 25789 - protein, 419 aa, Corynebacterium glutamicum ATCC 13032
MGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 25790 - protein, 285 aa, Arabidopsis thaliana
  misc_feature (13)..(13): Xaa can be any naturally occurring amino acid
  misc_feature (73)..(73): Xaa can be any naturally occurring amino acid
MAERGGESGAERXGDRGDFGRGFGGGRGGGRGRDRGPRGRGRRGGRASEETKWVPVTKLGRLVADNKITKLEXQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 25791 - protein, 276 aa, Zea mays
MRSSRDLRLAVLLLLFSASVLLPVARAQQETEEEEEFSYSLDAENGPAHWGDIKEEWSACGKGNMQSPIDLASPRVSLVRGLGYLNHSYHPANATIVNRGHDIMLKFEGDAGSVSIGGTPYFLRQLHWHSPTEHSVNGRRYDMELHMFHESAQGKAAVIGVFYEIGAHDAFLHKLEPYLEMIADRKDREEKMGMMDPRGARGKASVYYRYVGSLTTPPCAEGVIWTIVKRVRTVSRHQLELLREAVHDDMEKNARPRQEVNSRDISMFRPFEQNRH

SEQ ID NO: 25792 - protein, 214 aa, Zea mays
MDDTEREKEKEKEKHDCGTDVEDEEEDEEGNKRVVVLGPQVPLKEQLELDKDDESLRRWKEQLLGQVDTEQLGETAEPEVTVLDLTILSPGRPDLVLPIPFQADDKGYAFALKDGSPYSFRFSFVVSNNIVSGLKYTNTVWKTGVKVETQKMMLGTFSPQLEPYIYEGEEETTPAGIFARGSYSAKLKFVDDDGKCFLEMSYYFEIRKEWPGGQ

SEQ ID NO: 25793 - protein, 426 aa, Zea mays
  misc_feature (195)..(195): Xaa can be any naturally occurring amino acid
  misc_feature (226)..(226): Xaa can be any naturally occurring amino acid
MATYDKAIESYKKAVTTAASLAASAMLVRGVVNELVPYEVRDLLFSGLGYLRSRMSSRHTVVIEETEGWTSNQLYDAARTYLATRINTDMQRLRVSRVDEGKSLMFSMEEGEEMADVHAGAEFRWRLVCRDGAGNGVGNGGGNGHGHGHARGGSYRVEVRSFEMSFHRRHKEKAIASYLPHILAEAKKIKDQDRXTLKIYMNEGESWRIGKAWKRGYLLYGPAPGXGKSSLIAAMANYLKFDVYDLELTEVNWNSTLRRLLIGMTNRSILVIEDIDCSLDLQQRADEAQDAGTKSNPSEDKVTLSGLLNFVDGLWSTSGEERIIIFTTNYKERLDPALLRPGRMDMHIHMGYCCPESFRILASNYHSITDHDTYPEIEALITEVMVTPAEVAEVLMRNEDTDVALEGLIQFLNGKKDHAKDDSRQG

SEQ ID NO: 25794 - protein, 292 aa, Oryza sativa Japonica Group
MEHLERRGLAQGAYDGADPLDIGGFGDATGVDDAAEDVGDDLPLLDEVPAQDDLLRVVLIVADRGGGGGGRGSGISRGVAIRRGRGGHRDGDARCRLLPPELISLLSRAPTTETSSPPSAAMQQRRPASGRPSGTDGSDFSYRMVVDSRYQRVADGKSRLGRLILVQALHQVAGGALLLLALSKGAEMNKFAVMSVAAGLLAIVLGEIGRRRTMAVLLRMYTSLSSIAVAFSVACIIRSELFFKITKQNTESITSHELLEVVRVALGVLLQLVVIATTTRLLQNMSPPRRAS

SEQ ID NO: 25795 - protein, 382 aa, Salmonella enterica subsp. enterica serovar Paratyphi B str.
MIKSALLVLEDGTQFHGRAIGATGSAVGEVVFNTSMTGYQEILTDPSYSRQIVTLTYPHIGNVGTNEADEESSQVHAQGLVIRDLPLIASNFRNTEDLSSYLKRHNIVAIADIDTRKLTRLLREKGAQNGCIIAGDSPDAKLALEKAKAFPGLNGMDLAKEVTTTETYRWTQGSWTLKDGLPEAKSEDDLPFHVVAYDFGAKRNILRMLVDRGCRLTVVPAQTSAEEVLKMNPDGIFLSNGPGDPAPCDYAIEAIKKFLQTDIPVFGICLGHQLLALASGAKTVKMKFGHHGGNHPVKDMDRNVVMITAQNHGFAVDEDSLPANLRVTHKSLFDGTLQGIHRTDKPAFSFQGHPEASPGPHDAAPLFDHFIELIEQYRQSAK

SEQ ID NO: 25796 - protein, 243 aa, Escherichia coli CFT073
MPTGSESLFLYIMRVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 25797 - protein, 478 aa, Oceanobacter sp. RED65
MSDKFDVIVIGGGPGGYVAAIRCAQLGLKTACIDKWLDEEGKGVFGGTCLNVGCIPSKALLDSSHKYEEAKEHYDVHGIDVKDISMDVSKMLERKKGIVKQLTQGVRGLFQSNGVTPYEGLGKLLAGKKVEFTNHAGKTETLEAENIIIATGSVPVEIPPAPLQDDIIVDSTGALEFTEVPERLGVIGAGVIGLELGSVWNRLGSKVTVLEAQDKFLHLVDQQVAKEAAKQFKKQGMDVLLGARVTGTEVKGKEVTVNYTDSEGEQSITFDKLIVAVGRRPYTENLFSADTGVSLDERGFVFVDDQCGTEAPGVWAIGDVVRGPMLAHKASEEGVMVAERIAGEKAQVNYECIPSVIYTHPEIAWVGKSEDELKAAGEKYNVGSFPFAANGRAMAANDTGGFVKIIADAETDRILGASVIGPSAGDLCQQVVIAMEFGSSAEDLGMMVFSHPTLSESVHEAALGVNNHAIHKANRKRR

SEQ ID NO: 25798 - protein, 412 aa, Oceanobacter sp. RED65
MSTEIKAPVFPESVADGTIATWHKQPGEQVSRDELLVDIETDKVVLEVVAQNDGVLKEIIKAEGDTVLSSEVVGIFEEGATGSAGGSKDEAPAAKEETAQEADEDDLKVNPAARKLAEEKGVQLSAVKATGKDGRITKEDVLNHIKAEKEAPAAAPAPKAESAPAPASAPSMPSFNAGERAEKRVPMTRLRATIAKRLVSAQQNAAMLTTYNEVDMKAVMELRSQYKDMFEKKHDGVRLGFMGFFVKAATEALKRFPSVNASIDGNDIVYHGYQDIGVAVSTDKGLVVPVLRDVDAMGLADIEGGIVDYAKKAKQGKLGIEEMQGGTFTITNGGVFGSLMSTPILNPPQTAILGMHKIQERPMAINGQVEIRPMMYLALSYDHRMIDGKEAVQFLVTIKELLEDPARILLDV

SEQ ID NO: 25799 - protein, 198 aa, Salmonella enterica subsp. enterica serovar Paratyphi B str.
MSYYAFEGLIPVVHPDAFVHPSAVLIGDVIVGAGVYIGPLASLRGDYGRLILEAGSNLQYGCIMHGYCDTDTIVHENGHIGHGAILHGCVVGRDALVGMNSVIMDGAVIGEESIVAAMSFVKAGFQGEARQLLVGSPARVLRQVTDQELHWKRLNTKEYQDLAIRCRTGLSETKPLTQVEENRPRLKGTTDVKPKSAQ

SEQ ID NO: 25800 - protein, 574 aa, Zea mays
MEAAADEERPLIQYLAPEDDEASSRYTSDGTLDINKQRALKKSTGNWRACFMILGTEFAECLAFYATAKNLVTYLTAELGESNIDAATNVSTWIGSCYLTPLIGAFLADTYWGRYKTMIVFLLLYIVGMLTLTASAWLPLAMEDDSPDNSGLRRATAYLGLYLVSLGTGGIKPCTAALGADQFDGGDAAERVTKASFFNWYYFCTNIGSLLSGTVLVWVQENIGWGVGFTVQTVFMLFGLAVFVAGRKVYRYKKLGGSPLTRVAQVVVAAVRNCHLVLPDDTSALYHDKLLPTEPNFRIESARQFRFFDKAAIITGEKGAAAPTSPWRLCTVSQVEELKMLLRLLPVWASMVLFFAVSAQTVTTFIEQARVMDNRIGPFTIPPASIATFDVISVMVCVPVYDAVLVPLARRATGNDRGLSQLHRLSIGIALSVVVMVYAALLEGRRLALARANMPAMNIAWQAPMFAVHGAAAVFATVGVLEFFYDQSPDGMKSLGNALALLSMAAGSYFNSLALSTVGAITASGGERGWLPDDLNKGHMDYFFWMMAALGTLNLLHFLHYCNRRYRGNNNNTS

SEQ ID NO: 25801 - protein, 274 aa, Oryza sativa Japonica Group
MAERGGERGGERGGFGRGFGRGGRGDRGGRRGGRRGPRQEEEKWVPVTKLGRLVKEGRFSKIEEIYLHSLPVKEHQIVETLVPGLKDEVMKITPVQKQTRAGQRTRFKAFVVVGDNNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPDFWRDTKFVKSPFQEYTDLLAKPTKALMIDAPVENVEA

SEQ ID NO: 25802 - protein, 444 aa, Magnaporthe grisea 70-15
MVRNIVVLGGNSHPELVDEVCGILSIPPCDRILSKFEVGESRCEIKDSVRGKDVYIIQSGGGKSNDHFIELCIMISACKTGSAKRVTAVLPLFPYSRQPDLPYKKSGAPLSQAAGSSNKEYTFESVPATPAPGIPRTAGLTNGVDITHMLRDSSFTNGNAPASPRPAPPSEQFSGKNDANGVNGSRSGKPKAHNSSASTSSLVRSYTTHDYENPSFINHFQARPGYKQWVAQAGTLVANLLTCAGADGIITLELHDHQYQGFFDIPVDNLYGKPLLQRYIQTHVPNYKDAIIVSPDAGGAKRATAIADSLGMDFALIHKERRPTKISDNQNATMMLVGNVSGRICILVDDLCDTGNTITRAAKLLKKQGATYIYALVTHGLFSGDAIPRINASSIDKIVTTNSVPQAEHKALCPKMEILSVSPVFAEAIRRVHHGESISVLFQH

SEQ ID NO: 25803 - protein, 408 aa, Escherichia coli CFT073
MLSGKTQAASAKLLESTRGFTMSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 25804 - protein, 799 aa, Zea mays
MMEEDMENGRSYQERPRTFSTVRSKSSIPLALRLLMRINPRALIILSLLVFSGVLYVGASTSPIVVFVFCICTLSLFFSLYLTKWVLAKDEGPPEMSEISDAIRDGAEGFFKTQYGTISKMAFILAFVILGIYLFRTTTPQQEASGLGRATLAYITVASFLLGALCSGIAGFVGMWVSVRANVRVSSAARRSAREALQIAVRAGGFSAIVVVCMAVFGVAILYSTFYVWLGVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVVSSVGILSIRGTRDSGLISPIEDPMAIMQKGYSVTIMLAVLTFGASTRWLLYTEQAPSAWLNFALCGLVGIVTAYAFVWISKYYTDYKHEPVRLLALSSSTGHGTNIIAGVSLGMESTALPVLVISVAIISAYWLGQTSGLVDESGNPTGGLFGTAVATMGMLSTAGYVLTMDMFGPIADNAGGIVEMSQQPESVREITDVLDAVGNTTKATTKGFAIGSAALASFLLFSAYMDEVASFAQLPFKEVDIAVPEIFVGGLLGSMLIFLFSAWACSAVGKTAQEVVKEVRRQFIERPGIMDYKEKPDYGRCVAIVASASLREMIKPGALAIISPMAVGVVFRILGHYTGQPLLGAKVVASMLMFATVAGILMALFLNTAGGAWDNAKKYIETGALGGKGSESHKAAVTGDTVGDPFKDTAGPSLHVLIKMLATITLVMAPIFL

SEQ ID NO: 25805 - protein, 189 aa, Prochlorococcus marinus str. NATL1A
MIDNSNSDTALGPRQKIFLVILSFFLVVSLFFFRTGFKANEMLDQLAKNSLEPEIALSNGKPTVFEFYADWCEACKEMAPEMVNAEKLNSNKIDIVLLNVDNSRWFDLIDKYDVNGIPQLTFFDDQGDFKGFSLGVRKYSELNQIFLALINNSELPAFTKLSNSSNLISKNNLKVLDNNIRSEGPRDHS

SEQ ID NO: 25806 - protein, 322 aa, Bradyrhizobium sp. ORS278
MESSAATQRPGRGRVFDSIIEAFGNTPIVRLRKLPEQHGVKATILAKLEYFNPAASVKDRIGVGMILAMEQAGVLKPDSVLIEPTSGNTGIALAFVAAARGYKLKLVMPESMSVERRKMLAFLGAEIVLTPAAQGMKGAIATAEELLRTTPNSVMPQQFKNLANPEIHRRTTAEEIWNDTAGNIDLFVAGVGTGGTITGVGQVLKSRKPGLKVVAVEPEESPVLSGGQHSPHKIQGIGAGFVPDILDRSVIDEIVKINSATAIETSRALARNEGIPGGISSGAAIAAAIELGKRPENAGKTILAIVPSFSERYLSTALFEGI

SEQ ID NO: 25807 - protein, 325 aa, Oryza sativa Indica Group
MPAPPAASWRRHAAAAAASSSTRKTLLLLLPVLLLLLLFVLSRAPDLTLSPAAASSRHLSAGVRPFDCYASQQASPVFASLVEGVPHPFFYSLADMGALPDHPHKNIARILKGKRFRKPDISETIQQLLGGKVGIGSRGVVVDVGANVGMASFAAAVMGFRVVAFEPVLENLQRICDGVYLNRVQDQVVVYHAAASDRVGNITMHKVIGRLDNSAISATGAKLAFKANEEIAVEVATIPLDEVILDAERVVLIKIDVQGWEYHVLRGASKLLSRRKGDAPYLIYEEDERLLQASNSSAREIRAFLSSVGYNHCTRHGTDAHCMKN

SEQ ID NO: 25808 - protein, 399 aa, Ralstonia solanacearum GMI1000
MTTASAARPAPSADTLAPIAPPPSRLPKVGTTIFTVMSALAAEKQAVNLGQGFPDFDCDPRIVDAVSDAMRAGFNQYPPMTGVPALRQAIAAKIATLYGHAYDAEREITVTAGATQALLTAVLCCVHPGDEVIVFEPTYDSYLPSIELAGGKAVPITLEAPDYRIPFDKLAAAITPRTRLIMLNTPHNPTGTVWHADDMRRLAEIVAPTDVLLLSDEVYEHMVYDGVPHASVSRIPELARRAFVVSSFGKTYHVTGWKVGYVAAPAALSAEFRKVHQFNVFTVNTPVQHGLAAYMADPRPYLELPAFYQHKRDLFRAGLEHTRFKLLPCQGTYFQCVDYSALSDLPEAAFAKWLTSEIGVAAIPVSAFYSQPHESGVVRFCFAKKDETLRLALERLSRL

SEQ ID NO: 25809 - protein, 493 aa, Mycobacterium sp. KMS
MRGDELFIGGTWCAPSTDRRIEVISPHTETTVGHVAAAAPADVDRAVGAAREAFDTGGWPRTSPAGRIDAVRRLAANYERRRSEMAELITSEIGAPISFSQRAQVALPWSMINAFCDLAQTYPWREARPGRYGSDIQVLREPVGVVGAVVPWNMPQFLIVTKLIPALLAGCTVVVKPAPESPLNALLLAEVIAESGLPPGVVSVLPGDGSVGEYLVGHRGVDKVSFTGSTAAGRAVATACAADLRRVSLELGGKSAAIVLDDADPVVVAAGVRSASLSNSGQICNALTRVLVPRSRAGEFTDALAAEVSALVVGDPTDGATQVGPLVARRQQQRVTGYLEQGVRDGARVVTGGTGMPDGLDRGWYVKPTVFDRADNSMTIAREEIFGPVLTVVAYDNEDEAVAIANDSDYGLAGSVFTADTDRGLAVGAAIRTGTFGVNQGYTMDPFAPFGGVKSSGYGRELGREGIDGYVDTKSISVAPKQDLATAAAGKGA

SEQ ID NO: 25810 - protein, 438 aa, Desulfitobacterium hafniense Y51
MSKMMKFESGFSQEEALAEASRCLQCKKPLCRQGCPVNNAIPQFIRALKEGEYAQGLEAIYRHSYLPAVCGRVCPQEKQCEASCILARKGKAIRIGKLEQFIADNATEVGFPKVAATMGAIAVIGSGPAGLAAAVQLAQLGYAVTIFEGEAEPGGVLLHGIPEYRLPKDVVRRDIKKIENLGVEFRLNTLVGVDLFLDDLLAQGYQAVFIGTGAGLPKTLELPGEYLEGVISALYVLQTINLYNSGQLPEQELPVEKGEHVVVIGAGNVAMDAARTASRLGAEVTVLARRGLNDMAARDIERDEAIADGVKIRTYAAPLAILGEENVTGIKCVNTMVSPEGKAIIKEEESFVLPADKVIFAIGQRPYARIVTTSQGFEINKQGLLICNEHGMTTREGVFAAGDVVHGPATVVKAMGEGRRIAIEMHAYLLRKRLQSAK

SEQ ID NO: 25811 - protein, 332 aa, Shewanella sp. MR-7
MSELPHDYTHIYLEQPGAPEVMQLTRSPLPVPSAGQVLIRNCAVGVNGPDIKQRMGIYPPPPGASPIIGLEVAGEICALGEGVTQWQLGDKVCALVPGGGYGEYTLTYAVHCLPIPQGFSEVQAAALPETFFTVWGNLFMRAGLKAGETVLIHGGSGGIGSTAISLAKHLGATVITTTGQDEKRDYCSGLGAHLVVNYNTQNFVEEVMAFTQGKGVNVVFDIAGGDFINLNLQALALDGRMVSVSTQRSAKAEVNILQLMAKRIVWTGSTLRPQTVEAKAEIAKQLAEHVWPLLDSQQIVPHICATFPLAEAAKAHALMQSGEHRGKVVLTL

SEQ ID NO: 25812 - protein, 416 aa, Salmonella enterica subsp. enterica serovar Paratyphi A str.
MESKVVVPVEGKKITLQNGKLNVPENPIIPFIEGDGIGVDVTPAMLKVVDAAVEKAYKGERKISWMEIYTGEKSTQVYGQDVWLPAEALDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLKCSEFGDAIIANM

SEQ ID NO: 25813 - protein, 381 aa, Shewanella sp. MR-7
MSNPAQRATKLFVQTFGTKADDLYQAPGRVNLIGEYTDYNDGFVLPAAINFHTVIAVKRREDNKFRAVADAFPGQIKEWSFGKDTEINPEDGWVNYLKGLTVAMANTGLIAKGLDLAVVGDVPLAAGLSSSGALVVAFGTAISDSSQLHLSPMAVAQLAQRGEYRYVSSACSIMDHMICAMGEPDHALLIDCLDLDSEPIAIPENLSLIIIDAHIEKQRLAAINQQRREECAQAADFFGLDALRHLDLRQLESAKDQLDDTLYRRAKHVVTENKRTQSAARALEQNNLSKFSLLMAQSHQSLRDDFEVTLPEFDTLVDIVGQVIGERGGIRMTDGCVVALVDHELTDAVVSAVEHAFYEQTGIDATVYLCSASAGAGRIDS

SEQ ID NO: 25814 - protein, 174 aa, Brassica napus
PFVATLIISITLLMLSISGFYSEEEESPLPPDAVSKPTNDDYFVESSFVKSNPDANPDLPRLAYLISGTKGDSHRVMRTLQAVYHPRNQYVLHLDLEAPPKERMELALSVKSDPIFSRMENVRVMSQSNLVTYKGPTMIACTLQAVAILLRESLHWDWFLNLSASDYPLVTQDG

SEQ ID NO: 25815 - protein, 478 aa, Escherichia coli
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDMVAFEVAQFVEKPNLETAQAYVASGEYYWNSGMFLFRAGRYLEELKKYRPDILDACEKAMSAVDPDLNFIRVDEEAFLACPEESVDYAVMERTADAVVVPMDAGWSDVGSWSSLWEISAHTAEGNVCHGDVINHKTENSYVYAESGLVTTVGLKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 25816 - protein, 274 aa, Clostridium acetobutylicum ATCC 824
MLDINSFTVLNNGVKMPWLGFGTYKIEYEESSVDYIKTALKVGYRHLDTAAVYGNEPIVGKAVKESGIPRNEIFITSKVWNNKHGYDKTLKAFEDTLKRLDTDYLDLYLIHWPKTLNKETWKALEKLYKDGRVRAIGVSNFKVHHLEEILEDCEIVPMVNQVEYHPQFPQTEVHEFCKKNKIQLESWGPLMQGKIFDIPLMKELSLKYGKTISQIALRWDLQMGVVTIPKSINENRIKENCDLYDFEISKEDMKKIESLNTGVRIGHDPDTITF

SEQ ID NO: 25817 - protein, 512 aa, Chlamydia muridarum Nigg
MSNILILDFGSQYTNVLAKKIRLLSVFCEVLPWNTPLEKILQKSPSGLIFSGGPHSVYQNNSPEVDKEIYNSNIPILGVCYGMQLIARDFGSEVQGGKSEFGYTPIVFYPSELFKGLADQDAFHTEIRMSHCDCVVVPPKDFFVIASSQHCPIAAIECPKKKLFGLQFHPEVSDSQDIGDKILSNFVKHICQTSETWKIETIEKQLIQGIREKVGETERVLLGLSGGVDSSVLAVLLHNALGDRLSCVFVDTGLLRKNEVEEVKQQFSSLGLEILVVDASEKFFHDLSGIEDPEQKRKVIGAAFIEVFDEASKNLDVQWLAQGTIYSDVIESAKSCDATQVIKSHHNVGGLPEKLNLKLLEPLRFLFKDEVRALGKVLGLPDVLISRHPFPGPGLGVRVLGEVRREYVEIVKNADSIFIEELKKANLYHKVSQAFAVFLPCKSVAVKGDCRHYGYTIALRAVESTDFMTACWPSLSREFLNRCSSRIINEIPEVCRVVYDISDKPPATIEWE

SEQ ID NO: 25818 - protein, 299 aa, Campylobacter jejuni RM1221
MKVYEKVSELIGNTPIIHLKKFGINVFAKCEFLNPSHSIKDRAAFEMIKDALDSKKINQDTTIVEATSGNTGISLAMICADLGLKFIAVMPESMSLERRKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDEVITVSNEDAINTAKELAKSGLMVGISSGANVFAASMLAKKFPDKRILTMLNDTAERYLSTDLFA

SEQ ID NO: 25819 - protein, 370 aa, Azoarcus sp. BH72
MIKSRAAVAWGPNQPLEITEVDVAPPKAGEVRVRIVATGVCHTDAFTLSGADPEGIFPSILGHEGGGIVEAIGEGVTSVAVGDHVIPLYTPECGKCKFCLSGKTNLCQAIRATQGKGLMPDGTSRFSKDGKPIFHYMGTSTFSEYTVLPEISVAKIQKDAPLDKVCLLGCGVTTGIGAVLNTAKVEPGATVAVFGLGGIGLSAIIGAVMAKASRIVAVDINPDKFEIARQLGATDFINPKDYDRPIQEVIVELTDGGVDYSFECIGNTNVMRSALECCHKGWGESIIIGVAGAGQEISTRPFQLVTGRVWRGSAFGGVRGRTELPSYVAKAQTGEIPLDTFITHRMGLEDINKAFDLMHEGKSIRSVIIY

SEQ ID NO: 25820 - protein, 462 aa, Vitis vinifera
MASTMLSLVSAALPLQENHKGKMNLGSSDCSSFLRKEKRNPFMKTKSFGRINMAIAVNTSRFEGVTMAPPDPILGVSEAFRADNSEMKLNLGVGAYRTEELQPYVLNVVKKAENLMLKRGENKEYLPIEGLAAFNKVTAELLFGAGNPVIEQQRVATVQGLSGTGSLRLAAALIERYFPGAKVLISSPTWGNHKNIFNDARVPWSEYRYYDPKTVGLDFDGMISDIKAAPEGSFVLLHGCAHNPTGIDPTPEQWEKIADVIQEKNHIPFFDVAYQGFASGSLDADASSVRLFAARGMELLVAQSYSKNLGLYAERIGAINVVCSSADAAARVKSQLKRIARPMYSNPPIHGARIVANVVGDPALFNEWKEEMELMAGRIKNVRQKLFDSLSAKDKCGKDWSFILKQIGMFSFTGLSKVQSENMTNKWHVYMTKDGRISLAGLSLAKCEYLADAIIDSFHCVS

SEQ ID NO: 25821 - protein, 353 aa, Aspergillus oryzae
MSTMQAVVFQGPLKVTLEQRPVPQIEEPTDVIVKVRYTALCGSELHVFRGHQPSGTGFIMGHEFTGEIVEVGSAVRGFKVGDLVVSPFTVNCGECFYCARKCSSRCAKGKLYGSVMLDGGQADYARVPSADATLVAAPAAVDEKKLVLMADILPTGFFAARNAFKGMDRATIEESTVLLFGCGPVGLCALISALDYRPKHLIAVDSVPSRLELAKSLGAEPWNFQTDAEGLKQRVKDLTEGRGADVAIEVVGHSDALRMAFDNLRPWGRISSIGVHNGEIPWTGNEAYGKNLQIQMGRCPVRSIFEDALEFLIRKQDSLGFMVGDIRPLSQAIQAYDDFNQMKSQKIIFEAGK

SEQ ID NO: 25822 - protein, 606 aa, Prochlorococcus marinus str. MIT 9313
MSQAYQPLHHKYRPQRFDALVGQDAIAATLSHALRSSRIAPAYLFSGPRGTGKTSSARILARSLNCLNCDQPTPEPCGNCELCKSIAAGTALDVIEIDAASNTGVDNIRELIERSRFAPVQARWKVYVVDECHMLSTAAFNALLKTLEEPPPRVVFVLATTDPQRVLPTILSRCQRFDFRRIPLEALEQHLEMIATREAIPIEPEALHVVAQRAQGGLRDAESLLDQLSLLPGPIKAEAVWELMGAVPEQELLKLAEALAQADPLSLLETCRNLLNRGRDPGALLQGLAAVLRDLVLMTAAPDRPELTSVSPQFRNQLPPLASQIGRHQLLQWQVQLKGSENQLRHSVQPRLWLEVLLLGLLADPPSSEAVTAVPIAKTAQPITPTAQEITAKALTPTTQIQQPPSGSTTTNNPVSAITPNAEPDPSPAPAQRTPNSNLQELWQQILGSLELPSTRMLLSQQAQLVRLDDHRAVVQVAGNWMGMVQSRATLLEQAIAKALGNSRQLVLESQSGSATQTPIPQKTGAAPTTNTSASTAEPSPPPQVQSRSTDAYSPDPATSAAITDQPKPLEEDSPTTQPTSSLEPIDSKAKRLADFFNGKVLDVDL

SEQ ID NO: 25823 - protein, 176 aa, Prochlorococcus marinus str. MIT 9211
MKHTLSVLVEDQSGALSRISGLFARRGFNIESLAVGPAEAKGISRLTMVVEGDEETLQQMTKQLDKLVNVLNVIDLTRLPAVERELMLLKVSAKKDARKDILDLVQVFRAKVVDVSDEALILEVVGDPGKLVALEKLLKPYGILEIARTGKVALKRASGVNTEMLKSTSSGINLPA

SEQ ID NO: 25824 - protein, 350 aa, Thermococcus kodakarensis KOD1
MAEKMQAIMKTKPAYGAELVEVDVPKPGPGEVLIKVLATSICGTDLHIYEWNEWAQSRIKPPQIMGHEVAGEVVEVGPGVEDLQVGDYISVETHIVCGKCYACKHNRYHVCQNTKIFGVDMDGVFAHYAIVPAKNAWKNPKDMPPEYAALQEPLGNAVDTVLAGPIAGRSTLITGAGPLGLLGIAVAKASGAYPVIVSEPSEFRRKLAKKVGADYVVNPFEEDPVKFVMDITDGAGVEVFLEFSGAPKALEQGLKAVTPGGRVSLLGLFPREVTIDFNNLIIFKALEVHGITGRHLWETWYTVSSLIQSGKLNLDPIITHKYKGFDKFEEAFELMRAGKTGKVVFFPHKG

SEQ ID NO: 25825 - protein, 357 aa, Leifsonia xyli subsp. xyli str. CTCB07
MSRTVQLVVIPGDGIGPEVIAEAVKALDAVTAGSGLAFQKTYFSLGADRYLATGDVLTDDDLAAIRGHDAILLGAVGGRPGDPRLAGANVERGLLLRLRFSLDHYVNLRPTTLFPGIASPLAAPGEVDFVVVREGTEGQYVGNGGAIRPGTPHEVANEVSVNTAYGVERVVRYAFEQAGQRRKKLTLVHKTNVLTFAGSLWKRIVDALAAEHPEVAVDYLHVDAATIFLVTDPARFDVIVTDNLFGDILTDLAAAISGGIGLAASGNINPVGEFPSMFEPVHGSAPDIAGEQRADPTAAILSVALLLRHLGERPLAERVERAVTTDLAARSGQMATASQTRTTSQIGDAIAALAAQN

SEQ ID NO: 25826 - protein, 737 aa, Bradyrhizobium sp. BTAi1
MAFKNFKLETDADGIALITWDIPGRSMNVLDETSTNELEALVKETTADAAIKGVVITSAKEAFCAGADLSMLEGMNRLYADVLKSKGEEAANQMLFDTSRRFSQINRAMETSGKPWVAAINGLALGGGFEITLSCHYRVAAENPKTRLGLPEIKVGLFPGAGGTQRVPRIVQPQDAMNLLLKGEALTLDKAKALKLVDAIVPAADLIKAAKDWIKGGGKAVQPWDEKGFKLPGGPVFSKNGMMMFPAGNAIYRRETYDNYPAARAIMSCVYEGLQLPIDAALRVESRYFTKILRSKEAAAMIRSLFLSMQELNKGARRPADVPATKLKKIAVIGAGFMGASVGYVSARGGLDVVLIDRDQESADKGKAHAQSVIDGLVKKGRAKPSEAEAIMGRITATADYAALKDCDLVIEAVFEDRKVKAETYAKAQAYLKDGAIFASNTSTLPITSLAEEFKDQGRFIGIHFFSPVEKMMLVEIIMGKATGDVALATALDYVRSIGKTPIVVNDSRGFFANRCVMRYIAEGNEMFLEGVPPALIENAAKMAGMPVGPLSLSDEVALDLGLKIMKATEHDLGPNAINQDHKKLMVELVEKQGRFGRKNGKGFYDYPEKGKGQKSLWPDLAKLQPKHLDPDTLDVEELKQRFLVVQAVEAARTVEDHVITDVREADVGSILGFGFAPFTGGTLSYIDFMGTKKFVELCHTFTAKYGSRFAPPKLLEEMAAKGETFYGRFPPKKAAA

SEQ ID NO: 25827 - protein, 127 aa, Bacillus cereus G9241
MDMLVSLPAHKKLLATGHSLGGALATLHILDARINTAFAQYGLYTFASPKVGDIAFRNYYKLQVASSFRFVNLFDVVPLLPPRNVHFNEQDWEYAHVHHNMTFTKNTKSITNNHAMTTYKTCLTSHF

SEQ ID NO: 25828 - protein, 429 aa, Shigella flexneri 2a str. 2457T
MKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGVFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 25829 - protein, 500 aa, Pseudonocardia sp. K1
MTVIAKPDHLLRDDVQKFIDRPKKLFINGQWHDSIKGETLEVYDPAVGTKICTVAAGDAEDVDRAVAAARHAFDEGPWSKLNPSERGRLVWRLADLLEEHADEFAQIDALDNGKPVTDARAVDVAFSIELLRYMAGWSNKIYGETIPLTNPADFHAYTLREPVGVVGQIVPWNFPLMMAVWKVAPALAAGCTVILKPAEQTPLSALRLAELTEEAGFPPGVFNVITGFGETAGAAIAAHDNIDKVAFTGSTEVGRLIAQAASGNLKKVSLELGGKSPVIVFGDSDIEQAVAGASSAIFYNNGQTCTAGSRLYVHRKVYDKVVEGIASEASALPIGHGLDPATRIGPLISAEQRDRVTGYIAQGREAGAEVIVGGDTVGDGGYFIQPTILTKTDPSMSVVREEIFGPVLCAMAFDEDTIDSVVREANNSVYGLAASIYTRDISVAHRVAKRLKAGTIGINTHHVVDVALPFGGFKQSGYGRDMGRDAIDQYTEVKSIGIAL

SEQ ID NO: 25830 - protein, 338 aa, Triticum aestivum
  misc_feature (120)..(120): Xaa can be any naturally occurring amino acid
  misc_feature (159)..(159): Xaa can be any naturally occurring amino acid
  misc_feature (235)..(235): Xaa can be any naturally occurring amino acid
IASGRPFFFFLARRTRNACPTEQGGLVYYSLLRRKYIGSLERYFNFPPIPAGVNPATGVVSKDVVIDPANGLWARVFLPPGAGGKLPVLIYFHGGAYVIGSASDPIAHNNLTGLVPAAKXLAVGVGFPSAPEPPFPGAYDESWEGLQLGGSNAPGGAGXAPSPGWFTHGDFSRCSLPGAGAGGTIAHVMAVRAGEQAALPGVGIKGIIVVHPYFSGAAEIGKEATTGKAEKAKAXDAFWRFLYPGSPGLDDPLSNPFSEPAGGSAARIAGERVLVCVAQKDGLRDRGVWYYESLKASGYGGEVELLESMDEDHVFYCMKPRSEKAIELQERILSFLRK

SEQ ID NO: 25831 - protein, 360 aa, Pseudonocardia sp. K1
MGTFNVRFEPIGEEIECGEDETILDAAFRSGLNLVHGCREGRCSACKAFVLDEGWIYLKKYSSFALSDQEEEGGYTLLCRAVPESDVTIELLNYDPDHYRLEHAITDGVGQVVEVEALTHDIRRLELQIESPQGFGFLPGQFVDIWIPGTEQRRSFSMANLPSDGRLEFIIKQYPGGRFGALLDDGLAVGDPVKFTGPYGTCYLRDTGGSRSALLIAGGSGMAPILSLLRQMSDDGQGRTVSVFYGGRTRRDLFYTELVQSLGKRIEQFEFIQVVSDEPDSDGDDVRYGFVHDAVDQWIETSGFRLDACDVYMAGPPPMVDAVNDVLTLRHQVEQNRIFVDKFTSTGPEDSADSDSVSSL

SEQ ID NO: 25832 - protein, 531 aa, Thermosynechococcus elongatus BP-1
MASSPVAPVVLVILDGWGYREETYGNAIASAYTPVIDSLWQAYPHTLIHTSGKAVGLPKGQMGNSEVGHLNIGAGRIVPQELVRISDAVEEGSLFSNPVLVRLCQTVKERNGKLHFIGLCSAGGVHSHIDHLYGLVELAKRHGLPACIHVITDGRDTPPRDAAGVLEELEQRLKTSGCGRIVTVSGRYYAMDRDRRWERTEAAYRVMTSNEHIQPLRAVDVARQSYAQDIGDEFIVPTRIAAGAVEPGDGVVFFNFRPDRARQLTQAFIDPNFSGFERALITPLDFVTFTQYDASFNCGVAFPPQNLSHILGEVIAEHGLKQLRAAETEKYAHVTYFFNGGLEEPFPGEDRILIPSPMVTTYDQAPAMSALAVTQAVKKAIEKQEYALVVVNFANSDMVGHTGKLAATIQAIETVDRCVGVLVEAATKVGGTLLITADHGNAEYMIDEDGNPWTAHTTNPVPFILVEGEKRKVPGHGGHVILRKDGCLADIAPTILEILELPQPLEMTGRSLIVSAPYEMRLNRTPVSLKI

SEQ ID NO: 25833 - protein, 500 aa, Coccidioides immitis RS
MDTPSFPTQQLYYNGAVRKATSGKTFETVNPSDASVLASVEVASHADVDNAVKSAERAFSDWSKTPVSTRAKILLRAAEILRERNDEIAQIETLDTGKAFSETSTVDVVTGADVLEYYAGLISGGGLNGETTQLREDAWVYTKKAPLGVCAGIGAWNYPIQIALWKSAPCLAAGNTMVYKPSEFTPLHGLVLSQIYTEAGLPAGVFNVVHGAGDVGAYLTAHPTIAKVSFTGQVSTGKKVAGSAAGNMKYVTMELGGKSPLIILPDADLESAVDGAMLANFFSTGQVCTNGTRVFVPSKMKADFEALLLGKMGYIRAGPLMDPNTNFGPLSSSVHREKVMSYIRHGIDNDKATLLYGGPHPPANLDSSFRDGYWVSPTVFTNCTDDMKIVQEEIFGPVMSILTYDTIDEAVRRANNTPLGLAAGVFTRDINLAHKIIDRLDAGITWINSWGESPAEMPVGGWKMSGVGVENGRRGIEAWVRNKSTLVDMSGTVATVFTKL

SEQ ID NO: 25834 - protein, 231 aa, Chlamydophila caviae GPIC
MNKKQRQKTLIAPSIMGGDLACIGAEAKKIEESGADLIHIDVMDGHFVPNLTFGPGVIAAINRSTDLFLEVHAMIYTPFDFIEAFVKAGADRVIVHFEASEDLKELLAYIKKCGIQAGLAFSPETSIEFIPPFLPFCDVLLLMSVHPGFCGQGFIPDVPDKIRFTRQALKTMGLEDSCLIEVDGGINEASAKECREAGADILVAASYMFQKDALTMEEKVLLLRGENHGIK

SEQ ID NO: 25835 - protein, 570 aa, Bacillus anthracis str. Sterne
MSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENGVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENFSDNDIKIAVKEAIWEPEYRQIKAVEKVTI

SEQ ID NO: 25836 - protein, 123 aa, Glycine max
MEEMSGLATAINSSNIGFQLLKKHGWKEGTGLGVSEQGRLEPVETHVKNNKRGLGADKAKKKVVKAKPDQSDSSKGNNQQDHLPQKKSKTLSKRMRKMQEFEKKMREKEFERAFFREFWPENV

SEQ ID NO: 25837 - protein, 658 aa, Pseudoalteromonas tunicata D2
MVLQGIFTEIFSLLAIAVVLVWLFKRLNLPPVLAYLAVGVLVGPHALGWISEYQEIHLVAEFGIVFLLFSLGLEFSIPKLMAMRHIVFGLGSAQVVATSCIIIAIVMVYNPHFATAFSIGTLLALSSTAIVVKQLSESGELHTRRGQLAIGILLFQDIAVVPLLIILPLLSGEGEHHLVWALSIALTKGAFVCMLLWAVGKWVLPRLFNEVAQLRTDELFVLTTLLVTLFASGLTHFFGLSMALGAFLAGIMLGESQYRHQLEADIRPFRDILMGLFFVTVGMQLDMSFVWFNAYWILLAVCGLILIKALLIKQLAHFMGETAKDAWATGLMLCQMGEFGFVLIALALQHQLIESSYASLLISIGVISMAMTPYLIDKNQQLAKKLSRGEKSEQDKTAAPNFSTNLTNHVVICGFGRVGQTVARFLKAEAIPYIALDIDPIRVREAQAAGENVQFGHVRQKDILKAAKVDKSRLVIISFADYAKAMSVVSVVRQLSDSVKILVRMRDDQHLIELKNAGVTEVVPESLEASLMLVSHVLFMSGVPVKRILRRVQQERKNRYGILHGYFPGENTDLSAESIGRLEYMHAIAITDDAFAVNKTLGELKLSKRRVEVMGLRRNDNEIDHPTEETLIQAQDILIIRGKPRQVERTERYLLEGD

SEQ ID NO: 25838 - protein, 453 aa, Aspergillus nidulans FGSC A4
MASRLSLRQFSAQRLRTFTTSKGSENARSASGLIQGLQKGPALRNGFSRVNVIPISNYQVRTYADTVVKVPQMAESITEGTLKQFSKQVGDYVERDEEIATIETDKIDVSVNAPESGVIKELLVNEEDTVTVGQDLVKLEAGGTPEKKSEEATEKPKEPASTGSEAEKPKEPESAPSSSAPEKSTSSTKAPQAETSKPTQEVASKSRPTEEAKPALGNREERRVKMNRMRLRIAERLKQSQNTAASLTTFNEVDMSSLMEFRKLYKDEILKKTGVKLGFMSAFSRACVLAMKDVPAVNASIEGPNGGDTIVYRDYVDISVAVATEKGLVTPVVRNAETMDLVGIEKSIADLGKKARDNKLTIEDMAGGTFTISNGGVFGSLMGTPIINLPQTAVLGLHAIKDKPVAIGGKVEIRPMMYLALTYDHRLLDGREAVTFLVKVKEYIEDPRRMLLG

SEQ ID NO: 25839 - protein, 514 aa, Arabidopsis thaliana
MDCLLNPPPQSILDLKAHAHQLIFRPRLDSFTCNACGLNGDRSPYICVQCDFMIHQECFSLPRLININRHDHRVARTSVLGVVNSVCGVCHQKVDWTWGGYSCQRCPQYVIHSKCATRNDVWNGKELEGVPEEIEDIKPYVVIYGNIIQHFSHKEHYLRFHVNGFFRDGNKRCSACTYPIGLQSFYECIDCDFMLHQNCAEFPRKKWHMLHNDRLTLVTSVAEFFWCIACRRMSNGFKYQCGYGVLDVLCCSVSEPFVHPSHPDHPLYYIRQVKYRQCYGCNGRTYNVLTCIESCCGFVLCFCCATLPQVVMHRVDDHPLSLCYGEKASGKYWCDICEKELNPSTWFYTSKDHRASLHTKCVLGDFAGLMPRSTIKYGSRSYEVVLNNSVSRPFCRVCESHCMYPISLKMLGTSDPYICSLNCQKRLNSLDNLTKKLEALYVLKTTKKESDDDDRTQLQALLLAEETAKKEPDYADRMQLVCMYCKYCCYASTNKVLTLKRHIYGGFEDQRLEP

SEQ ID NO: 25840 - protein, 232 aa, Oryza sativa
MFGCANDYPRDDVKEIKCYVRNQKGHLCCADFSDICPKEVSCYNCAQPGHTGLGCAKQRREASTAATPTLCYKCGEEGHFARGCTKNTKSDRMNGESSAYSRKKGKGKKDFGTRSAPHDARKTSKRKSPLFEERRNSSHFKSKARGGWIADDADDQPYKKCKPNVWASPSTPKKQYNNHQFSSGGDYSTPQSSRWQKHGFASPSATYSPNTRKHSFSSSRFASNTHVRFGRS

SEQ ID NO: 25841 - protein, 518 aa, Aspergillus nidulans FGSC A4
MEHIHNVFGLDTFFIINIGIALAGLATWLRSVWNLVNRYADTCIATVYINEHDPLYNDVIQWMNDHIFKDRNFCCVLAVTDNHHRPGKRQGLISAIAGPMNPADASPPQVLGKSTFELKPFNGSRIFTFRGRWVLFSHSAPSRTITTLQDGAEERIHLKLQTLSLSLDPLRALIEEANAYSKKLAKSQISVYRAMSNVRDLVRWNRITTRPSRAISTVILDSCKKKAVLDDMREYLREDTRQWYANHGIPYRRGYLFSGPPGTGKTSLSSALAGVFGLDIYVLSLLDPNISESHFLRLFSEVPTQCVVLLEDIDAAGMTLKRANEEPVTADTTASFDVMKKRARPGAPVPTSPPTPISLSALLNAIDGVSSQEGRILIMTTNAPQDLDPALIRPGRVDMHIRFELPSRVEFRELFRSMFSDAPSGPDSEVKGESDIGSDALKLEETKKKNIDMIDLDRLAQEFAEALPEGRFSLAEVQGFLLQYKRQPEAACARAAEWATDNKPRQYLPCPPAGPGDV

SEQ ID NO: 25842 - protein, 268 aa, Azoarcus sp. BH72
MSIPMPAIGLGTFRLQGQTVIDSVRSGLELGYRHIDTAQIYANEAEVGLAIAESSVARDQLFITTKIWTENLAAEKLIPSLEDSLARLRVEHVDLTLIHWPSPGEAVPLAESLMALQEAKRRGLTRQIGVSNFTIAHLQQAIALLGADEIATNQVELHPLLQNRKLAGFARAQGIHLTAYMPLAYGKVLAEPVVQRIAAAHDATPAQVALAWLLQQDHAVIPSSTRRENLASNLAAARLHLSAAERAEIAACDRGERMANPDFAPRWD

SEQ ID NO: 25843 - protein, 507 aa, Chlamydia muridarum Nigg
MEEIKEMGPTLPACPPCVMVIFGATGDLTARKLFPALYNLTKEGRLSENFVCVGFARRPKSHEQFREEMRQAIQNFSHSSEIDIRVWESLEHRIFYHQANFSEAEGYSSLRSFLESVDQKYGTKGNRLFYLSTPPDYFQEIIRNLNRHQLFYHEQGAQQPWSRLIIEKPFGVDLQTAQELQQCIDANINEESVYRIDHYLGKETVQNILTIRFANTLFESCWNSQYIDHVQISVSESIGIGSRGNFFEKSGMLRDMVQNHLMQLLCLLTMEPPSEFSSAEIKKEKIKILKKILPIREEDVIRGQYGEGVVQGVSVSGYREEENVDPNSLVETYVALKLFIDNPRWKGVPFYLQAGKRLPKRTTDIAVIFKKSSYDLFNSENCPLCPLENDLLIIRIQPDEGVALQFNCKVPGTNKLVRPVKMDFRYDSYFNTVTPEAYERLLCDCILGDRTLFTSNEEVLASWELFSPLLEQWSKIRPIFPNYIAGSLRPQGADELLSRDGRAWRSY

SEQ ID NO: 25844 - protein, 169 aa, Leifsonia xyli subsp. xyli str. CTCB07
MSTHVLSLLVEDKPGLLTRVAGLFARRGFNIHSLAVGTSEVDGLSRITVVVDVDELPLEQVTKQLNKLINVIKIVELEPAQSVQREHLLIKVRVDNSTRSQVLEAVTLFRARVVDVATDALVIEVTGDSGKTQALLKVLEPYGIKEMAQSGLLAIGRGGKSITERVYKN

SEQ ID NO: 25845 - protein, 86 aa, Zea mays
CLKIILTYLPKLPLKVFSVPEAAPFTEELKYAVEAFKSAAHTSAIITNDGLGINPEQSAGNVFLKHGAELCIIPRDRVAAVHMSSG

SEQ ID NO: 25846 - protein, 194 aa, Triticum aestivum
  misc_feature (170)..(170): Xaa can be any naturally occurring amino acid
MAATVMASSATSVAPFQGLKSTAGLPVSRRSNGASLGSVSNGGRIRCMQVWPIEGIKKCETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVHCVSFIAFKPPGCXESGKAYTAHSRQAIYKVPLQLSQL

SEQ ID NO: 25847 - protein, 182 aa, Campylobacter jejuni RM1221
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLMNLKDLNGANKLEKLTSVYSVLEI

SEQ ID NO: 25848 - protein, 481 aa, Corynebacterium diphtheriae NCTC 13129
MTTALEEQNTQQASVAGRVVRVIGPVVDVEFPRGELPALYNALTVEVTLEAVAKTITLEVAQHLGDNLVRAVSMAPTDGLVRGAVVTDSGKPISVPVGDVVKGHVFNALGDCLDEPGLGRDGEQWGIHRDPPPFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQHQDVLLFIDNIFRFTQAGSEVSTLLGRMPSAVGYQPTLADEMGVLQERITSIKGKSITSLQAVYVPADDYTDPAPATTFAHLDATTELDRAIASKGIYPAVNPLTSTSRILEPGIVGERHYAVAQRVINILQKNKELQDIIAILGMDELSEEDKITVQRARRLERFLGQNFFVAEKFTGIPGSYVPLAHTIDAFERICNGDFDHYPEQAFNGLGGLDDVEAAYKKMTEK

SEQ ID NO: 25849 - protein, 379 aa, Thiobacillus denitrificans ATCC 25259
MSRAQPAILVLADGSVFRGRSIGADGITTGEVVFNTALTGYQEILTDPSYSRQIVTLTYPHIGNTGVNPEDVEAGRIHAAGLVVRDVPRRHSNFRSAESLSDYLASQNIVGIADIDTRRLTRILREKGAQSGCVMAGGVDESKALEAARAFPGLAGMDLAKVVTAPAMYEWHETEWRLGRGYGQVSEPRYHVVGFDYGVKRNILRMLAERGCRVTVLPATATAAEALALKPDGIFLSNGPGDPEPCDYAIRAIGELVGAGVPTFGICLGHQLLALASGAKTVKMKFGHHGANHPVKDLDSGRVTITSQNHGFAVDPATLPANLRSTHVSLFDGSLQGLARTDAPAFSFQGHPEAAPGPHDLSYLFDRFIQLMADRAAVH

SEQ ID NO: 25850 - protein, 367 aa, Campylobacter jejuni RM1221
MSLSVGIVGLPNVGKSTTFNALTKAQNAQSANYPFCTIEPNKAMVEVPDLRLNELAKIVKPERIIHSLIEFVDIAGLVKGASKGEGLGNKFLSNIRETEVILHIVRCFDEENITHVEGGVDPLRDVEIINTELILADIEQLSKKIEKLTKEAKANQKGAKESLELANSLLDHLNKGLAASSYPEKESEIYQALIKELRLLSAKEVIYGANVDENGISEDNDYVKALKEYAKKNDHEVIKLCAKIEEELVGLSDEESHEFLSSLGVNESGLDQIIRTAFAKLGLISYFTAGVVEVRSWTIKKGWKAPKAASVIHNDFEKGFIKAEVISYEDYIQYKGENGAKEAGKLRLEGKDYIVLDGDVMHFRFNV

SEQ ID NO: 25851 - protein, 1407 aa, Bacillus cereus G9241
MKKKNRFVTGIVTAGVLFSTALPFNVLAENPINQIDSSNAQSLLSKLSKEQRQALQTLDANPGFTISPDINTSSSEPVNIIVEFQTAPVKINELKQKEKGLQAAPENIKARIDQEHEEFQKGLKRLYQFSPSVKSGNFQSVQIKRSYKHAINGVALTLPANTVEELLRIGVVKRIWKDYEVKLNLPKQAEQKAPQKLTDSIPQIGVDKLHSEGITGKGIRVGVLDTGIDYNHPDLKDVYKGYRAKPGEDSSRIAPNSVKGWDFINNDADPMETTYTEWQQSGAPEFNDRGSSFYTAHGTHVAGIVSAQKKNTSDSAVKGVAPDIELYNYRVLGPYGSGDSSGIIAAIDKSISDGMNVINLSLGDDSNNPLDPTSIAVNNAMLSGVVTVVAAGNSGPNPATLGSPGASPFAITVGASDSSISLPKLSSHAGQLQFPNLILFGKNFTDKIEDFKGQTLPIESVGIGTPDEFSKKDVKGKIALVARGTLSFDEKIANAKQAGAKAVIIYNNVDGEIPFYVGESTKYIPAFRLTKEDGEKLKAQIEQGNTSFSFGELSYIQTEGDHLADFSSRGPVTSNDDIKPDITAPGVAVLSTVPEYINDPQEGENYDVSYERMQGTSMASPHIAGVAALILQEHPEYSPFDVKASLMNTADDLKEKYSVYEVGAGRVDAYNAVHTETSFKVLDTTKTVVNDEVIEVPEETGSIAFGKFYQKDGEALEQKRNIKVENHNKQEKKEFKTEISYTPASSSINDAIANGVKVSVPETITLDAGKSDEIEAKINVPAGVKQGRYEGYIHITNTKNKEETYQIPFSIRVSEPGIENAILSRKAISTDTSKFNPYGESYVHGAFQLNSELETLDLIVKDSKTNKVLGFIGTLNTSGLKTDVYYYLESFFNGKVYPFTNDPAKPIGDEKIDLPEGDYTIEFVGYDKAGKARVKGDYVVIDNTPPEVKLTGLKPGIYELNEENYTVEDGKKALWIKGNVYDSNVDYLQGKGLNITQEANGVMYYDYSPYLHKFLPINANGDFKVGITPESFKVEGPMNTGVYIFDYATAGPDYPSGVNNYWFIPQGAQYAKTSYNKKEVYKGDEFTVTLNAKHVKQFVAGEFNVKFLEKNFKFANAKLNPTFEKLLSEKGVTAKVNEPKLEAGSVTVGGAIDDKNFAGLDGDFPFIDVTFKVENDEFYEANAQLESAVFVYWKPGETEPNRMRVLQDQSFSVMSLNSLVEGHIKPGAFLNERRYLDEKLDYTKLGVKVYATDSYRHKFEGSLDKYGYFKLNGLPVNKRDYNLYVEVPGHLTSRLTTKLGTEKDGKLLGQYYYARLDENLAGDVNGDKVIDIKDAEIIASNYGKKGLSVKDGDLNKDGIVDEKDIRFVEKNFLKKGPDASNSQTPVEKSKSGTLADILKKLGLTPKK

SEQ ID NO: 25852 - protein, 595 aa, Prochlorococcus marinus str. MIT 9313
MALLVQKFGGSSVGNVERIQAVAERIATSKDLGHDLVIVVSAMGQTTDELTALAKVISSNPPQREMDMLLATGEQVSISLLSMALHELGIPAISMTGAQVGIVTESAYGRARILDVRTERLQSLLSTGKVVVVAGFQGTSLSSVGTAEITTLGRGGSDTSAVAIAAALGADACEIYTDVPGVLTSDPRQVSDAQLMQEVSCDEMLELASLGASVLHPRAVEIARNFGVALVVRSSWSNEAGTKLTSKSKRPIGREGLELGRPVDGVELAEGQAVIALSHVPDQPGVAATLFENLSSDGVNVDLIIQSTHEGNSNDIAFTVAEADLAKAHSLCEGLLKSVGGQLSAEAGMSKLSISGAGIMGRPGIAASLFDTISRAGINLRLIATSEVKVSCVIDATLGSKALRAVSTAFELSDSQVRINPLGNGKGEPEVRGVALDQGQAQLSVRGVPNRPGTAAALCSAMAEAGISLDAIVQSERQHDDGSRDISFTLKRDEREQANKTLAPLLAQWPGANLEDGPAIARVSAVGAGMPATAGTAGRMFRALADAKINIAMIATSEIRTSCVVAEPDGVKALQSVHKGFGLGEEADHPVQSNS

SEQ ID NO: 25853 - protein, 442 aa, Yarrowia lipolytica CLIB122
MSEKIDAHTSGADSASVSRVTSRANSKVSSLNTSRDSSREAEYLKKAAKDSSPESKKQAFIVRTIWSLVMIVFFFAVLAAGHIWVIALVGLVQILTFKEVINLASEPASEKKLPWVRSLNWYFLATTIYFLEGENIIRFIKQNNSDLENTLNTLFLHHRFLSYCLYILGFVFFVASLEKNHYRFQFTQFCLTHMTLLFGVVQAHFIVNNIFQGLFWFFVPAGLVISNDIFAYLCGITFGKHQLIAISPKKTVEGFLGAWICTIIWGVIFSVFLYRFDYFICPVEDMGTNLFSNLTCVPNPVFMPKEYPIPTEFLRQLTHKTTFSAAPIHFHVGILASFASLVAPFGGFFASGLKRAFQVKDFGDTIPGHGGITDRMDCQFLMGFFSYLYYETFVSNHVSKVETLLNTLMFTFTRQQQEEFVRQFFEWAKNEGLLTGFCAVLE

SEQ ID NO: 25854 - protein, 159 aa, Zea mays
  misc_feature (104)..(104): Xaa can be any naturally occurring amino acid
  misc_feature (114)..(114): Xaa can be any naturally occurring amino acid
MCQFSCFSAEMLVNLQVPWVILGHSERRALLGESSDFVADKVAYALTQGLKVIACIGETLEQREAGTTMDVVAAQTKAIAEKISDWTNIVLAYEPVWAIGTGKXVATPAQAQEXVHDGLRKGLHSNVSPAVAELTRIIYGGSTTTNIFNCVASQFFTIC

SEQ ID NO: 25855 - protein, 361 aa, Picea sitchensis
MEIGTTPEYANGETLPVGEIPEDANEHCPGPEAETAGKADACEGCPNQQICATAPKGPDPDLIAIEERMATVKHKILVLSGKGGVGKSTFAAQLSFALAEQDKQVGLLDIDICGPSIPKMLGLEGQEIHQSNLGWSPVYVEDNLGVMSIGFMLPDPDEAVIWRGPRKNGLIKQFLKDVYWGELDYLVVDAPPGTSDEHISIAQYLKATNVDGALIVTTPQEVSIIDVRKEINFCKKVGIPVLGVVENMSGIQQPISSFIFKKIAEDGKEEDVTEETLKSLQMHSPHLLSLFASTEIFHVSGGGAEKMAHEMHVPFLGKVPIDLELSKAAEEGRSCFTDPKCKSSASALQRIIEKLLKNIEP

SEQ ID NO: 25856 - protein, 259 aa, Yarrowia lipolytica CLIB122
MSTEAAAPRGGFGRGRGDRGGRGRGRGGRGRGRKDEEKGWVPVTKLGRLVKAGHIKSMEEIYLHALPIKEYQIVDQLLPVLEDEVMKIKPVQKQTRAGQRTRFKAVVVIGDSNGHVGLGIKTAKEVATAIRAAIIIAKLAIIPVRRGYWGSSLGEPHTVPTKTSGKCGSVNVRLIPAPRGSSIVASPAVKKLLQLGGIKDVYTSSAGSTRTLENTLKATFIAIANTYGFLTPNLWTETALTPSPLETHSSFLSSQKRRF

SEQ ID NO: 25857 - protein, 132 aa, Aspergillus nidulans FGSC A4
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKAGKGSQEL

SEQ ID NO: 25858 - protein, 301 aa, Chlamydophila caviae GPIC
MNKQPILLSGSSNLILAQNVCAELKIKLGRMELNQFPDGETHVKVLEDVRGRDVFIMQSIVGQPNHYLFELLIIADALKRSSAKSITAIIPYLGYCRQDRRNKTGEPITAKLVADVLTTAGITNLITCDLHADQIEGFYKTHVDHLHCQQLFVDTIKSCISQDCIAIAPDIGSIKIAERIARMLDTGLAVIKKERLNSFEVSMQLIGEVQDKNVVIIDDLCSTANTLVEAANLCKQKGAKKIIATVTHGLFVGDAIQKIETSALESLFVTDTIHLQSTSTCIKTLSTAPMIASAIKAALSF

SEQ ID NO: 25859 - protein, 151 aa, Vitis vinifera
MLSMRFGLHMISYEQPKGFLEPKFTIYDGANAPYPKDRQVHRQDYLCNKCKRLGHFSRDCPNVTVCNNCGLPGHIVTECNSTTICWNCKESGHLASQCPNDPVCHMCGKMGHLAWDCSCLGLPAHDARLCNNCYKPDQVYLLMFNRVVHRL

SEQ ID NO: 25860 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRTVQCTGSIQAMISAFECVHDGWGVAVLVGVPNKDDAFKTHPVNLLNERTLKGTFFGNYKPRSDIPAVVEKYMNKELELDKFITHTVPFSEINKAFELMLAGEGLRCCIRMDA

SEQ ID NO: 25861 - protein, 613 aa, Zea mays
MACNRRRKLLCACLLLACAAPAAAAAVNISVYWGQNSNEGSLGQTCSSGRYALVAMAFLSTFGSGQTPVLNLAGHCDPASGGCTALAADIAACQARGVRVLLSIGGGAGSYNLSSASDAESVATYLWDNFLGGTSSSRPLGDAVLDGIDMDIEISPSSHFDGLARNLTSLYGGDRRGRKYLLTAAPQCPYPDASLGAALATGLFDHVWVQFYNNPGCEYQQKDGDGVANLAASWKAWTQSLPSSASVFLGLPASPAAAGSGYVPPDDLVSRVLPAVSGSANYGGLMLWNRYYDNSTGYSARILSSRALLHPKGYTYSEVKRMTRSFAHKLGQGGYGAVYRGSMPDGREVAVKMLTGMLEGDGEEFMNEGGEHQQDGPKRALLYEYMPNGSLERYTFGSSSGEDALSWDRLFGIVVGVARGLEYLHTGCNTRIVHFDIKPHNILLDQDMCPKISDFGLAKLCGQKASRVSIAGARGTVGYIAPEVFSRSYEAVGSKADVYSYGMVVLEMVGARKNVHVSATDDGGNSSSSRYFPQWLYENLDQFCRPTTTSNGEIRGDDDDATEVLLVRKMVVVGLWCIQSKPDSRPSMGQVLEMLESNAADLQLPPKALCTAY

SEQ ID NO: 25862 - protein, 483 aa, Pseudomonas syringae pv. phaseolicola 1448A
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTADELHCTVLIGGPLSDHKGINRRGGGLTAPALTEKDKQDIKLAAEMDLDYLAVSFPRDAADMEYARQLRDESGGTAWLVAKIERAEAVANDEVLDELIRASDAVMVARGDLGVEIGDAELVGVQKRIILHARRHNKAVIVATQMMESMISSPMPTRAEVSDVANAVLDYTDAVMLSAESAAGSYPIEAVQAMARICIGAEKHPTGKTSSHRIGHSFTRCDESIALAAMYTANHFPGVKAIIALTESGYTPLIMSRIRSSVPIYAFSPHRGTQARAAMFRGVYTVPFDPAALPPGQVSQAAVDELLKRGLVEQGDWVILTKGDSYHTIGGTNGMKILHVGDPLV

SEQ ID NO: 25863 - protein, 488 aa, Azoarcus sp. BH72
MGKPTGFLEYQRLSEAYQPVTARLKNYKEFVAALSDEQAAIQGARCMDCGIPFCNNGCPVNNIIPDWNDLVYRGNWREAIEVLHSTNNFPEFTGRICPAPCEAACTLNINSDAVGIKSIEHAIIDKAWAQGWVQPQPAAVKTGKKVAVVGSGPAGLAAAQQLARAGHDVTVFEKNDRIGGLLRYGIPDFKMEKGLIDRRVEQMQAEGVVFRTGVVVGAKDLPKGIVNDATEVVSAEQLQKDFDAVVLAGGSEVPRDLPVPGRELEGVHFALEFLIPQNKQVAGDAPNPISAAGKDVVVIGGGDTGSDCVGTSYRHGATSVTQFEVMPQPPEQEHKPLTWPYWPIKLRTSSSHVEGDTQREYAIGTKEFVGENGKLTGVRTVRLEWKDGRMAEVPGTEKLFPAQRVFLAMGFTNPVGGVLEAFGVDKDARGNAKATTDGEGCYATNVEKVFAAGDMRRGQSLVVWAIREGRQCARAVDEFLMGESVLPR

SEQ ID NO: 25864 - protein, 317 aa, Pseudomonas syringae pv. phaseolicola 1448A
MSDIPEASADGSSSHWQLQRIVSQLRGAREDWRARNRRVSGEHGGRELPSRAAMGEILEALSGALFPMRLGPVDLREESEDFYVGHTLDVALNALLAQARLELRYVAHQQGGDLKSIDARALELIQGFAMALPGIRLLLDTDVLAAYHGDPAARSVDEVLLCYPGILAVIHHRLAHHLYRAGLPLLARISSEIAHSATGIDIHPGAQIGPSFFIDHGTGVVIGETAIIGERVRIYQAVTLGAKRFPSDEDGQLQKGHARHPIVEDDVVIYAGATILGRITIGKGSTIGGNVWLTRSVPAGCNLTQANLLQQDDCSKK

SEQ ID NO: 25865 - protein, 292 aa, Brassica napus
SQRRSLKRGGRVCIICFILSSRGNPKLLQFLGILRKRERENPCSLCGHFHKYEEGEVCGICGHRMPDPSDVPAPHVHVSAFPSEILPEFLFLGSYDNASRSELLKTQGISRVLNTGPMCQNLYRNSFTYHCLSDEKVLQFDDAIQFLDQCEKDKARVLVHCMSGKSRSPAVVVAYLMKRKGWRLAESHQWVKQRRPTTDITPEFYQQLEAFERTILGSREGMMAAMNINDPPTFGFGFPKVNNNSQAQVPVFNNTSAASIFSSPASSIPQGFTFGAAPPKPTTGDDTIMGGS

SEQ ID NO: 25866 - protein, 196 aa, Triticum aestivum
  misc_feature (151)..(151): Xaa can be any naturally occurring amino acid
DLTNGTSESGKENPNEDGPESNPQFTTVYVGNLPHEATNNDVHLFFHSLGAGSIEEVRVTRDKGFGFVRYSTHEEAAQAIQMANGQLIGGRQIKCSWGSKPTPPGTASSPLPPPAPAPFSTGVSPTDFLAYQRMALNKMATNPSLMGQHAXIRSHMGMGGRASQSIYDGGFQGISTAAATTSAQQQQQQQQQLMYY

SEQ ID NO: 25867 - protein, 216 aa, Candida glabrata CBS 138
MSSEPFKNVYLLPQTNQLLGLYTIIRDKNTTRPDFIFYSDRIIRLLVEEGLNHLPVENKDVDTHTSEVFNGVGFMGKICGVSIVRAGESMEQGLRDCCRSVRIGKILIQRDEETALPKLFYEKLPEDIADRYVFLLDPMLATGGSAMMATDVLIKRGVKPERIYFLNLICSKDGIDRYHAQFPDVKIVTGAIDKGLNEQKYLVPGLGDFGDRYYCI

SEQ ID NO: 25868 - protein, 378 aa, Brassica napus
MDIISGQALFLFFCFILSCFLIFTTVRSRRSSRGAATLPPGPPRLPIIGNMHLVGKNPHRSFAHLSKTYGPVMSIKLGCLNTVVIASPNAAREVLRTHDQILSGRYWNEAVRSIDHHSFSVAWLHPSSPLWRLLRKISVTHLFSPQRIEATQALRMKKVQELINFVSECSDREEAVDISRASFVTALNIISNVLFSIDLGNYDSRKSSDFQDMVIGVMESAGNTELANFFPFMRFFDVQGTRKKFKDCSERLFRAFRRLYDDRIKGNSLQTEDKDVSSKDFLDALIDLNQGDEAELNMYQIEHLLLDLFSAGTDTNSSTVEWAMTELLQNPKAMTKVQDEIDSVIGQNGVVQESDISQLPYLQAVVKETFRLHPAAPL

SEQ ID NO: 25869 - protein, 380 aa, Triticum aestivum
TVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTVELKAMADRIISMREQLFDALKIRETPGDWSHIIKQIGMFTFTGLNSDQVAFMRQEYHIYMTSDGRISMAGLSSRTVPHLADAIHA

SEQ ID NO: 25870 - protein, 146 aa, Desulfitobacterium hafniense DCB-2
MSKPIRERFRWLMPSIAAREGRTLVDRDRIALRGLKFFAYHGMLREEKILGQTFIVDIDLYADLSKAGKSDQVEDTINYAEVYARIKTIVKREKYQLIERLAERIAEDVLGEFPCEGVRVVIHKPQAPIPGIFDEAFVEIYREKKR

SEQ ID NO: 25871 - protein, 222 aa, Verbena x hybrida
MIILPSITEVQVESVVFPPAVKPPGSDKTFFLGGAGVRGLEIEGKFIKFTAIGVYLENDAVTSLAAKWKGKTAEEVADSGDFFAEIVTGPFEKFTKVTTILPLTGQQYSEKVVENCVAYWKAIGKFTDAEDEATKKFLQVFKNEMFHPGASILFTQSPQGSLTISFSKDGSIPEKENAIIENKQLSEAVLESIIGKKGVSPSAKQSLAARLSDLLKQCESTT

SEQ ID NO: 25872 - protein, 165 aa, Prochlorococcus marinus str. MIT 9313
MMATYEGCYTDAQALRIAVVVARFNDLVTGKLLSGCLDCLARHGVDTSSNSEQLDVAWVPGAFELPIVTQTLALSGQYQVVITLGAVIRGDTPHFDVVVAEASKGIASVSRETGVPVIFGVLTTDTMQQALERAGIKSNLGWSYGLQALEMGSLMAVLRSATSAS

SEQ ID NO: 25873 - protein, 404 aa, Oceanobacter sp. RED65
MHEFHKSNKLANVLYDIRGPVLTAAKRMEEEGHRILKLNIGNPAPFELNAPDEIIQDVIHELPNAEGYSDSKGIYSARKAVMQYSQQKGIDGVEIDDIYLGNGVSELIVMALQALINNGDEVLIPAPDYPLWTGAVSLAGGTPRHYICDEQSNWYPDLDDIRAKVTPQTKAMVIINPNNPTGALYPKEVLEGMIEIARENNLVVFSDEIYDKIIFDEVEHTSTASLADDLLFITFNGLSKTYRLAGFRSGWLIVSGAKHKAKDYMEGLDMLANMRLCANVPAQYAIQTALGGYQSINDLIKPGGRIYEQRMTAHNMINDIPGLSCTLPQGALYSFIKMDQKRFNIKNDEKMVLDLLEQQKILIVHGRAFNWPEPDHFRLVFLPRVEDLEQAIEKMGHFFERYSQ

SEQ ID NO: 25874 - protein, 534 aa, Zea mays
  misc_feature (159)..(159): Xaa can be any naturally occurring amino acid
MEPFFLFVGLALVLCFLTLYYRHLQSKKTSPLEPTEWPIVGHLPGLVANIHHFHDWATGVLAGAGYNFEARAGRTGVRYFITCDPSNVRHIFTSNFANYPKGEEYAAIFDVLGGGIFNADGESWRRQRVKAQMLMTGPRFRAFTARCSRDKVERSLLPXLAHHADDDGRAPPCDLHDVFLRLTFDMTCTLVFGVDPGCLAFGLPVVPFARAMDDALETLFLRHIIPMACWKLMNVLEVGQERKMAAARRTIDSFVAATVAKRRADKLKGCECVSNSYDLLSSFICHEDDDSSENDDVFLRDTTVNLLLAGRDTTGAALSWFFYLVSKNPRVEQKLLDELAPIAASRRTKGAEDAAHAASGMVTFDADELSSLVYLHAALSECLRLYPSVPFEHKVAAALEYPSRGPSLRVPSFLVFNYSMGRMEGVWGKDCMEFRPERWLNVEGTKLRYEPSYKFISFNAGPRTCLGKEMAFVQMKTVAAAVLWNFAVEVVPGHVVEPKLSIILHMKNGLAVKVTRRDDGTAPSSSCVRHTACF

SEQ ID NO: 25875 - protein, 248 aa, Thiobacillus denitrificans ATCC 25259
MRKKLVAGNWKMHGSLAENAALLAALKPALQGIEAAVCVPFPYLAQVQTALAGSSLAWGAQNVSEHGKGAFTGEVSASMLLDFGCKYVIVGHSERRSLYGESDALVAAKYMAAQAAGLTPILCVGESLAERESGVTEQVVARQLDAVVAAAGIASLARAVVAYEPVWAIGTGKTASPEQAQAVHAFIRGKLADLDAAVAAGLIIQYGGSVKAANAAELMAQPDIDGGLIGGASLLADEFVAICRAAAK

SEQ ID NO: 25876 - protein, 507 aa, Oryza sativa Japonica Group
MAPMAGGGGVPWGDRARVVGAQIRSRFRVGVAPVDRRWLWRRGDGRVASEAVRQWTERVRSLWQREKSTDQISSSPGTSQVAAAAKPSSSALRFYRKKVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTGMQDIMPVGKRIPRAGKRVIVVVGDPINFNDLIIDNSDETQHISRGILYDKATERIGQRLQELKAEVDRLAAEQKSELQHHHARDTVNYGTRLWQQVDWEAFGMESSMLSPEPSDVQEPLKKAKPVLHLESEHAKPELHLEPEQAKHELHTEQCVPAAPSAEICSNFGVPLFFRQHTDPSELMGFAARGLLKNGRFMEEEGYRELQRQGAMNMFWGSQANNTVL

SEQ ID NO: 25877 - protein, 415 aa, Blastopirellula marina DSM 3645
MTVASQHADKLDLDAIRADFPILHQEVHGKPLVYLDNAASSQKPQQVIDALREVDERFYANVHRGGHQLSNESTSMYEESREAAQRFLGAKSKNEVIFTYGTTSAINTVAHAWGSANLAPGDEILVTEMEHHSNLVPWQQIAQLTGAKIKALPITGDGLLAMDELPGLLSERTKMVAVSAASNVLGTINPVTEIVRQAHEVGAVVSVDAAQAAPHKPIDVVAWDADFVALSAHKMVGPSGLGILYGKQALLEAMPPFLGGGSMINTVTIDSFTPALLPAKFEAGTPPITAAIAFKAAIEYLENIGLDNILAHEQMLAEYAHQLLADVPGLRILGPAPHQKAGIVSFTVDGISPNDIGMMIDTAGVAIRAGHHCAMPLHARYGIASSARASFYLYNTREEVEIFVAAVRKALTILS

SEQ ID NO: 25878 - protein, 363 aa, Buchnera aphidicola str. APS (Acyrthosiphon pisum)
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKHFNLFSNLRPAKLYPELKCLSPLRSDIVKNGFDILCVRELTGGIYFGEPKGFVNKNNTKYAFDTEIYHEYEIIRIAHLAFKLARSRKKKVCSIDKSNVLQSSILWREVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGE

SEQ ID NO: 25879 - protein, 258 aa, Actinobacillus pleuropneumoniae serovar 1 str. 4074
MTDLQHTTETAENETTHFGFKTVAKEEKQQLVANVFHSVAGKYDLMNDLLSFGIHRVWKRFTIDCSGVRKGQKVLDLAGGTGDFTAKFSRIVGENGEVVLADINSSMLEVGREKLRNLGVVGNVNYVQANAECLPFADNTFDCVVISFGLRNVTDKDKALRSMFRVLKPGGRLLVLEFSKPIIDPISQLYNFYSFNILPKVGEVVVNDAESYRYLAESIRMHPKQDELKAMMENAGFESVNYYNLSAGIVALHRGYKF

SEQ ID NO: 25880 - protein, 429 aa, Bradyrhizobium sp. BTAi1
MGVEVTKLPTGLTVVTDTMPHLETAALGVWAGVGGRDEKPDEHGISHLLEHMAFKGTTTRSAREIVEAIEAVGGDLNAGTSTETTAYYARVLKADVPLALDVLSDILANPSFVPEELEREKNVIVQEIGAAQDTPDDVVFEHLNELCFPDQPMGRSLLGTAKTLQGFDRDKLHGYLATHYRGPDMVVAAAGAVDHQQVVEDVTRRFASFNGAPAPKPLPAAFGKGGSRVVHRDLEQAHLTLALEGVPQADPSLFSLQVFTNILGGGMSSRLFQEVRENRGLCYSVYTFHAPYSDTGFFGLYTGTDPADAPEMMEVVVDIIGNAVETLSEAEVARAKAQMKAGLLMALESCSARAEQLARHILAYGRPQTLQEMVDKIEAVSVESTRDAARALLARSKPAVVALGSGRGLDTAVTFAEALTGSKPKAQLH

SEQ ID NO: 25881 - protein, 635 aa, Kluyveromyces lactis NRRL Y-1140
MQEPMNRIRPSSPLSGQRTVTSGSTRRIWLQLDTPCDSFRGENPIEDTLYNQPTSVDIEVRDMIDDVKSKVLNKLSNTRWFRFKDNTNISLGFYYYSAELLEPSHSHSVGPEKANSNTFVITYSEYQNLIKRNQIRVGRWSQLHNSFNRLLHRSTSQSPSLDTAFNDDNGLRMLSSQHTRQQSQSPDDNLKYAYKVIIEPDTPVMTVYRELYGGLQKSEDALTVFYPPMSSSSPTSPEVLTPAELLDPIRIFTKDAIGQEKEILLSDISQGTEIDSVVERPDQRRPSLFGSFSSSRNNTGILLLPKGVSPEDIEGSNDSPYEEANISLDNIETSPPHPESYALTAQKPLTEEEVGISLTKTISSPELPRPLSRRTTPSLDKQGNLPKYKVFPRINVLIVEDNAINQAILALFLRKNGISYKVAKDGVEAIEKWKEGDSHLILMDLQLPLLSGLEATKKIRELERINNIGNFSQKSVSKKPNLKKNANSKEEGGTTAAKTSDQQNEVEKSNQQNMVLDKSKFRSPVIIVALTASYSQIDRTEALLAGCNDYLTKPVNLDWLSKKITEWGCMQALIDFDGWTEGQRRMTDDVLLRPQIVTARKSQATSTRSVPRVSSVSTTLECDDSKYTKSNDCCP

SEQ ID NO: 25882 - protein, 368 aa, Herminiimonas arsenicoxydans
MKTKAAVAWKAGQPLTIEEVELGGPREGEVLVEIKATGICHTDYYTLSGADPEGIFPAILGHEGAGVVVEVGAGVKSLKKDDHVIPLYTPECRECKFCLSRKTNLCQKIRSTQGRGLMPDATSRFSIDGKPLFHYMGTSTFSNYIVVPEIALAKIREDAPFDKVCYIGCGVTTGVGAVLFTAKVEAGANVVVFGLGGIGLNVIQAAKMVGADKIIGVDLNPAREAMARKFGMTHFINPSKVENVVDAIVQLTDGGADYSFECIGNVHTMRQALECCHKGWGQSIVIGVAEAGAEISTRPFQLVTGREWKGSAFGGARGRTDVPKIVDWYMEGKLNIDDLITHTLPLERINEGFDLMKSGESIRSVVIY

SEQ ID NO: 25883 - protein, 512 aa, Chlamydophila caviae GPIC
MSNILILDFGSQYTNVLAKKIRLLSVFCEVLTWNTPLEKILQISPSGLIFSGGPHSVYQENSPKVDKEIYNSNIPILGVCYGMQLIARDFGSEVQGGKSEFGYTPIVFYPSELFKGLVDQDAFHTEIRMSHCDSVVIPPKDFFVIASSQHCPIAAIECPEKKLFGLQFHPEVSDSQAVGDKILSNFVKHICQASETWKIETIEKQLIQSIKEKVGETERVLLGLSGGVDSSVLAVLLHNALGDRLSCVFVDTGLLRKNEVEEVKQQFSSLGLEILVVDASEKFFHDLSGIEDPEQKRKVIGAAFIEVFDEVSRNLDVQWLAQGTIYSDVIESAKSCDATQVIKSHHNVGGLPEKLNLKLLEPLRFLFKDEVRALGKVLGLPDVLISRHPFPGPGLGVRVLGEVRREYVEIVKNADSIFIEELKKANLYHKVSQAFAVFLPCKSVAVKGDCRHYGYTIALRAIESTDFMTACWPSLSREFLNRCSSRIINEIPEVCRVVYDISDKPPATIEWE

SEQ ID NO: 25884 - protein, 545 aa, Halocyphina villosa
MGCLSLFAFLTALNSVHAAVGPVTDLTLIVDTVAPDGAAFAREAIVVQEEPNSVIGPVIVGQKGDNFRLNVINNLDSPNMRQSTSIHWHGIFQGNGQNWADGAAFVNQCPIAPGGDSFLYDFTEPFQTGTFWYHSHLSTQYCDGLRGAFVIYDPLDPYRLLYDVDDESTVITLADWYHSYAEDILIAAGDTILINGHGRFAGAGGTATELSVITVEHGKRYRLRFANIACDPWFAVKIDSHTNLRVIEADGITTVPVTVDSFNIFVGQRYSVILHANQPVGNYWIRAAPNGVSNFAGGIDSAILRYVGAPEEEPNTSEDTPSDTLQEQDLHPLILPGAPGIHSRGAADVVHTVSMEFLTILKCSPTMPVLLQILSGAQTANTLLPAGSFIQASHNDIVELNFPAVNVAAVGGPHPIHLHGHAFDVIRSAGTNSDNWFNPPRRDVVSTGTDPNDNVTIRFRADNPGPWFLHCHIDWHLELGFALVIAEAPSEWDSDINPPAAWDDLCPTFAWLLFYYFKFPHILNFTDMMPCRLSSSNRVKNLNVD

SEQ ID NO: 25885 - protein, 156 aa, Roseovarius nubinhibens ISM
MRVHICAVGRLRSGPERALIDDYLTRFDRTGRALGLGPCTLHEVEDKKGGGMKAEAALLDRALPAGAVIVALDERGKLLSSPEFSDKLAGWRDMGRGDLAFVIGGADGIDPALRARADFKLSFGKMVWPHMLARVMLAEQLYRAASILANSPYHRV

SEQ ID NO: 25886 - protein, 505 aa, Roseovarius nubinhibens ISM
MSIPKPVVLCILDGWGLSDSDVGNAPRLAQTPIMDRLLADCPNATLLTHGHDVGLPAGQMGNSEVGHMNIGAGRVVEMDLRRIDRAIETGAFATLPGILRFAEALKASGGTAHLLGVLSDGGVHSHITHMIAAAEALTAQGLRVAIHAFTDGRDVAQVSAKTYLEELRDALPQGAFIATVSGRYYAMDRDNRWDRVSLAFDALVNARGYTADTASDAIDNAYDKGRTDEFIKPRVLGDYDGMKDGDGILCLNFRADRAREILASFADPEFADFDTGPRPQFAIVSGFTEYSRRHTAYMDCIFPDEAPENTLSQWIAAKSRTQFHIAETEKYPHVTFFLNGGRERPEPGEERYMAASPKVATYDLAPEMSSGEVTDHLVRAIEQGFDFIVVNYANPDMVGHSGDLDAAIAACEAVDRGLGRVRAAIEAKGGALIVTADHGNCEQMIDPVTGEPHTAHTTNPVPVLLLGGPEGAALRHGRLADLAPTVLALMGLDQPAEMTGQSLLA

SEQ ID NO: 25887 - protein, 728 aa, Cryptococcus neoformans var. neoformans B-3501A
MPDVVLPLVQTPPFVIIALAALQGIPVTWDAQSGEQGQTTYGDIVGAENVRAELEKGVDGKEIPLPPLPTLLTSTSSFQDVSAVLDAFDDYLAYRTYFAGPKFGFGDATIWGTIRGNNSAIGSIKKPGRPHLQRWFNHVETLDVPKAALESHRQAKSEMEKGKKTKRLESIDVVLPNAIKGKVVVRFAPEPSGYLHIGHLKAAILNRYLADQYQGKFILRFDDTNPLKEEGEFEEAIQEDLKMIEISFDKIVHTSDHFDKIQAYAEQLIKQGDAFMDDTEGETVKEQRRAMIPSKNRDLSIEENLVKFKEMCEGTEEGKRWSLRAKIDYQHKNGTLRDPVIYRYVEGSHHVTGTKYKSYPMYDLACPIIDHLDGVTHALRANEYWARHEQYQWFLKTLGFANIEIFDFSRVDFVYTVLSKRKLKYLVEKNVVKGWDDPRFPTVRGIRSRGMTVQGLKNYILGQGASQQAVQLEWDGIWTVNKKVIDPVAPRYWAIAEDRMVSVNVIGRETEEPEVVSRPLHKKNPEVGEKKLVFASKLIMEQEDAKTFGENEEITAMDWGNAFVTSKITTPSGDVSSLTITLHLAGDFKKTSKKVTWLAAPTDANPLIPVVLIEYDYLITKKKLEEDDSLPEVLNPKTEYRTYALASKEVEGLKKWDIIQFERKGFYICQGTRDNQGRMEFGFIPDGRAATVALKAEPAKEKTKVPGTAKGSWGKPGPKAVSTAAAAP

SEQ ID NO: 25888 - protein, 140 aa, Cryptococcus neoformans var. neoformans B-3501A
MSLSRTFLRQLRPASSSRVVLRSFSSSRSTFSETPAGDAPVNPKIAPIVDSISSLSLLEVSELVTALKTKLNITEISLPAASSPASAAASSTSSEAPVEEKPKEKTIFTVKLEKFDAAAKAKIIREVKALMPNMNLVEVS

SEQ ID NO: 25889 - protein, 474 aa, Pyrus communis
MHMLSRNATFNPHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTLDPNHLVLTAGATSANETFIFCLADPGEAVLIPTPYYPGFDRDLKWRTGVEIVPIHCTSSNGFQITETTLEEAYQEAEKRNLRVKGVLVTNPSNPLGTTMTRNELYLLLSFVEDKGIHLISDEIYSGTAFSSPSFISVMEVLKDRNCDKNSEVWQRVHVVYSLSKDLGLPGFRVGAIYSNDDMVVAAATKMSSFGLVSSQTQHLLSAMLSDKKLTKNYIAENHKRLKQRQKNLVSGLQKAGISCLNGNAGLFCWVDMRHLLRSNTFEAEMELWKKIVYEVHLNISPGSSCHCTEPGWFRVCFANLPERTLDLAMQRLKAFVGEYYNVPEVNGRSQSSHLSHSRGQSLTRKWVSRLSFDDRCSIHGR

SEQ ID NO: 25890 - protein, 282 aa, Desulfitobacterium hafniense Y51
MSEQCNESCSSCGEDCADRKEGNPDFSAKLHEQSRVKKVIGIVSGKGGVGKSLVTSMLAVSMKKRGYHTAILDADVTGPSIPKAFGLKEKARGGESGLIPVKSEAGIDIMSINLLLPKDTDPVIWRGPIIAGIVKQFWTDAIWRDVDFMFIDMPPGTGDVPLTVFQSLPVDGIIVVTSPQELVAMIVTKAVNMAKVMNIPVLGLVENMSYFKCPDNGKEYRIFGESHIEEIAAEHQLKILAKLPIEPQIAAACDQGAIEQVEEHWFDLAAELLEKMEGIKHA

SEQ ID NO: 25891 - protein, 454 aa, Burkholderia xenovorans LB400
MRRVYPLQETPGLQFKLPTTATAPFCPSEVQGSVAVTQGAPFWKRILQFAGPGLLVSIGYMDPGNWATDIEAGSRYGYSLLFVVMLSSLAAMALQCLSMRLGIATGRDLAELSRTRYSPAVARFQWLLAELSIVACDLAEVLGGALAFHLLFKCSLTTGVLLTAFDTLIVLGLKGKNFRDLEAIMLGLIATIGVGYIIELALVQPHWPSVAQGLIPSWQALSSREPMYLAIGILGATVMPHNLYLHSSIVQTRAVKRDPASIRSAIGMSRIDTIVSLVLALLINMAILILAAAAFHATGHNQVTEIEDAYKLLAPIVGTGFAAVLFAVTLLASGQSSTFTGTVAGQVIMEGFLKLKIPCWQRRFITRALALIPALIGVQMMGNGAVGKLLVASQVVLSLQLPFALYPLIRMTNDRSLMGEFANTLLTRCVAWTLFVVISAANLWLVVQTAGLAG

SEQ ID NO: 25892 - protein, 262 aa, Pseudoalteromonas tunicata D2
MSAVIKTAAEIEKMRIAGRLAAEVLEMIEPFVKAGVTTEALDKICHDYIVEQQDAIPAPLNYHGFPKSICTSVNHVICHGIPNDKPLNNGDIINIDITVIKDGYHGDTSKMFFVGEPSIQGKRLAEVTQESLYLAIKMVKPGVRLGDIGAAIQKYAEGFSYSIVREYCGHGIGAEFHEEPQVMHYGKPGTGEVLKAGMCLTIEPMVNAGKQQCKLLNDGWTVVTKDRSLSAQWEHTLLVTDNGVEILTHRTEETIDKIIVHS

SEQ ID NO: 25893 - protein, 1638 aa, Shewanella sp. MR-7
MLTHNKVAVMVATALYVGSGIASTSAVNTVEPSSAWGPSPADYAPKPLKEDTFTWENQVNKAIKKQHTIFKAEADIQGVHKYIVQLNDAPISTYEGGVGQLAATQKTVAQARTTKAPLNLNQPQLKAYNNYLAEKRATVVAQAQALQGLDIKVGREFSVALNGFVTEMTQEQAAKLAKVPGVKRITREKIYELKTFSTPNQTGATSVWSNSALNSSNMGEGMVVGVIDTGINADHPSFAAVGGDGYKHTNPLNGKYLGDCAASPEYCNDKLIGIYSYPEITKAYTDPVFSETRPAIGLDYNSHGSHVAGTIAGNVIKDLPHTITEYTPDGKGIETGLELPQVSGMAPHANIIAYQVCWPGSSGDPYAGCPTSAIVAAIEQSAIDNVDVINASLGGLEEDPWSEPMEQAFLNAAASGVFVAVAAGNSGPELMTADHSSPWVTTVAAHTADQIVSFKSNGLENLSGGATTVPMDIVGSTKSFQSVTGLVVDAKNFKNPNEPLASSIKNCDKPFPAGTFDLADNPATTDIDESQQDVIVLCSRSSLPLLNKATNVQAGGGEGIVIASLSPTQDNNLPGVPYAIPGTLVKYSDGNLLRTWLSSGAGHMATLTAGGAELSAVDKERVANFSGRGPSYFGIDTLLVDIAAPGVDIFAPASDDQPFTKNPVTGQWATLSGTSMASPHVAGAATILRQSHPDWTPMQVQSALMMTASNTLTNASFLDNYSDYGDVSALQDAGAGRMHVELADKVGLLLDESMDNMAAANPNLGGRPKNLNTAYMVDTNCPNECSFVRTFTATEDGHWTVDSETWMGNFDISVQPTSFSIKAGETQSLVIKAKNKKNVSGAIYLDYTGSQGQVRLVSDNPNSPVLELPVWTYEGDSGLPNYVKINAHRKSATLNVGPFNTAEITDFTARSYGLVKGDDKTIHTYIDTTGGDPFDTVEVDGVQVNPNHIEWTEVPEGTKLLAGSVVGNDYGRVLVFMGQDSDGDGVPSMDETLCMSTNYSIANFCTISNPQAGRYFTVYMNLASLSYGQVDQGRDISISTALVTGDEGNLTVKAPAQIPGYSEYKLELAYQLPEMEVGNTYFGGFDIGSNANDAGNLGFVPVIVNQIDKDVTFTASRETAIPGEVIEFQVNVIANNEEQARDFALNASFPDAIQIIPDSVVASHATPGTPVLENNALSLTGVQETTKDVVRNYKITNNQNDPMCSLTAAKSPYPGYLELKENLGWKTLEGVEGAYYNEFQYKLKDLMNSEADISFPFFNKYFVDTIKLNPAGLVTFNTARRTPVSHVEFPSGTLGLLPMPEFIVAPFWTGDNRIPKRFDAGYGQYHLNAGITPTYTIARDWLVLEWDNVERANTPGQLVDFEMFLRMNINYEPGNYEMLFAYDNLQMVDDKGSIGFKAADGRIIVDGDTPMDLNLGDSVAYNNLGSVLSNKFVVCMDYTGPEESQFNLQFKAYVSEKAAGTTQTLKVENHLVGADSEVLELQLAVAGNIQLAAIADKMVKENESISFDVLYSDENQVSNMIEVMGDNFTTTVNGNTVTLTPTANFHGETRVTVMVKDSVNPEDAASTSFNLVVESDGIEYGCTNSSATNYDASANTDDGSCKLPAVIVEPEEKSSGGALGWLALGLLPLAYRRNRKTH

SEQ ID NO: 25894 - protein, 471 aa, Chlamydia muridarum Nigg
MDKQKRFLSLVFLTFTLFGIWFCPHSDFVDPKAWHLFAIFTTTILGIILQPAPMGAIVIMGISLLLVTKTLTLDQALSGFHSPIAWLVFLSFSIAKGVIKTGLGERIAYFFIKVLGKSPLGLSYGLVLTDFLLAPAIPSLTARAGGILFPVVMGLSESFGSSVEKGTEKLLGSFLIKVAYQSSVITSAMFLTAMAGNPIVSALASHSGVALTWAIWAKAAILPGIVSLACMPFVLFKLFPPQITSCEEAVETAKIRLKEMGPLKQGERIILLIFSLLISLWTFGDSIGVSATTTALIGLSLLVLTDILDWQQDVLSNTIAWETFLWFGALIMMASFLSSFGFVNFVGDSVIGMVQGLSWKIGFPVLFLIYFYSHYLFASNTAHIAAMYPIFLTVSISLGVNPMFAALALAFASNLFGGLTHYGSGPAPLYFGSQLVSVQEWWRSGFILSIVNLIIWLGLGSWWWYCLGLIR

SEQ ID NO: 25895 - protein, 481 aa, Leifsonia xyli subsp. xyli str. CTCB07
MSLQRPRTAPEGETLSSTSAPSTPRNGTLKRTLGLWAIVGLGLGYMTPTVVFDTFGMVSRETNDVVPSTYLIALTVMMLTAVSYGKMAGALPSVGSAYTYVRESVHPNVGFMVGWTSLIDYMLLPMVNCLIIRSYLEALFPGVPGWIWVVVYCAVVTSIIFLTMRGTSNLNMLLLVFSIVVIAVFVVLVIAQLAQGEAAGTVASLHPFLHDSVTIGAVLTGATIVCFSFIGFDAVTMYAEEATSPAIMPRAILFTVVTGGAIFLVAAYITQLRFPSSSAFPVEAIEDSTLPQIGFQVGGPVLQAALTAAGFCATLASGLASHASVSRMLLVMGRNNVLPRRLFGHIDPKTHTPTFNIVLVGLISLLAAAFTLKLIAAFINFGALIAFTFVNVSVIAWFAIQKGRRRTAKDIVTFIALPGVGMVLTGVLWANLHVDALVGGLVWAAIGFVYLVVLTRGFRRPVTAFDENQPVTGFNKAIAKD

SEQ ID NO: 25896 - protein, 481 aa, Bordetella parapertussis 12822
MRAIADTGYTAPTPIQAQAIPLVLQGGDLLAAAQTGTGKTAGFTLPILHRLMQTKPAARKPGRPRCLILTPTRELTAQVAESVQTYGKYASLSSMVMFGGVNINPQISALKKPLDILVATPGRLLDHAGQKTVDLSGVEILVLDEADRMLDMGFIRDIRKVLALLPKQRQNLLFSATFSDEIRSLARGVLNDPGEVSVTPRNTATELVTQTVHLVEQHHKRDLVSHLIRESGWHQVLVFTRTKHGANRLAEKLVKDGLSAAAIHGNKSQSARTRALSGFKDGSVAVLVATDIAARGLDIDQLPQVVNFELPNVPEDYVHRIGRTGRAGATGAAVSLVDDSEIKLLKAIERLIKKPIERRAVDGWTPPAGGPTAEDRADREREMRDDDRGRGRRGDRGGDRGQRAGGDNRAPQARDGQRRATGAHPQGSAPRNAAGPRADAKRNDAGRPQGRAPGETGAARAPAPARDRPVGNGTRGVLLGK

SEQ ID NO: 25897 - protein, 149 aa, Desulfitobacterium hafniense DCB-2
MEKTFIMLKPDAVQRGLVGQIIARFEAKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 25898 - protein, 246 aa, Triticum aestivum
  misc_feature (181)..(181): Xaa can be any naturally occurring amino acid
  misc_feature (204)..(204): Xaa can be any naturally occurring amino acid
MQLNTMSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRXWEGVLTGKGLFWGGSLIRPEATXGYGLVYYVDYMLKHANRGSFEGKRVALSGSGHVAQYAALRSS

SEQ ID NO: 25899 - protein, 85 aa, Triticum aestivum
  misc_feature (48)..(48): Xaa can be any naturally occurring amino acid
  misc_feature (58)..(58): Xaa can be any naturally occurring amino acid
SVSPAQIEESGFESSTVADILKSKGKSADGSWLWCTTDDSVYDAVKSXMTQHNVGALXVVVKPGGKINPIGHPSTREEIYLPGKP

SEQ ID NO: 25900 - protein, 324 aa, Candida glabrata CBS 138
MSELKSRIGNSGSIANSGPVSILCYCASSILMTVTNKFVVNTDGFNMFFVMLFAQSLVCTMCLMVLKMFGYAKYRPLNLIDVKNWLPISFLLVFMIFTSAKALKYMPVPIYTIFKNLTIILIAYGEVLFFGGSVTPMELSSFILMVLSSVVASLGDQQAAKIAQPLANNSILSPEYYWMFLNCICSASFVLIMRKRIKLTNFKDYDTMFYNNALALPILLGFSFLSEDWSSENLAQNFSGESLSAMIISGMTSVGISYCSGWCVRATSSTTYSMVGALNKLPIALAGLIFFDAPRNFLSIMSIFIGFASGLSYAVAKQKKVQKN

SEQ ID NO: 25901 - protein, 325 aa, Campylobacter jejuni RM1221
MIKSIPEWSEQEYLMLSLPHEKSDWNPYLEEILQSYKEFVKAVSEFQKVLLIAPKQSDFENFKDIKKVEYFKCDTNDTWIRDFGAIDIIENGRLKALDFTFNAWGNKFQSELDNAVNSKLFKEKFKEELKKVDFILEGGSIDFNGEGVMLTSSHCLLNENRNSHLNKTQIDIKLKEIFGLKQIIWLENGFIKGDDTDHHIDTLARFIDKNTIAHCICEDEEDEHYLPLQKMKEELKKTGFDLVELPIPNPLYYEGRRLGATYANFVFINNALIVPFYKDKNDEIIAKRLSKALPSHKIIGVDARVFLRQNGSLHCSCQNRFKGLR

SEQ ID NO: 25902 - protein, 320 aa, Triticum aestivum
  misc_feature (234)..(234): Xaa can be any naturally occurring amino acid
MAATLSQLDDGIVRSMAIGAVFTDYAGKISCLDFHRKEDLLVTSSEDDSIRLYNTTSATLSKTTYHKKHGADRVCFTHHPSSILCSSRYNVESGESLRYLSLYDNRCLRYFKGHKDRVVSLCMSPVNDSFMSGSLDHSVRIWDLRVNACQGILRLRGRPSVAYDQQGLVFAVAMEGGAIKLFDSRSYDKGPFDTFLVGGDTAEVSDIKFSNDGKSVLLTTTNNHIYVLDAYGGXKKCGFSLEPSRNIATEAAFTPDGQYVISGSGDGTLHAWNINTVQEIACWNSHIGPITALKWAPRRAMFATASTALTFWIPNESSSS

SEQ ID NO: 25903 - protein, 224 aa, Acidobacteria bacterium Ellin345
MIELAPSILSADFARLAEQVEAAIQGGGTVVHFDVMDGHFVPNITIGPPVLKSLRKAVKAPIDCHLMIENPDAYIPAFADAGANWISVHQEACLHLDRTLHLIRDHGCRAGVVINPATPVETLSEVLDIVDYVLVMSVNPGFGAQPFIPATLHKVRKLVALRNQGGTNFRIEIDGGMALDTIGEAIRAGVEIVVAGNAVFGKGDPAENARELLKAANSATLVKV

SEQ ID NO: 25904 - protein, 348 aa, Escherichia coli CFT073
MEFFKKTALAALVMGFSGAALALPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKTVFDTLATAAKNGTAVVRSSRVPTGATTQDAEVDDAKYGFVASGMLNPQKARVLLQLALTQTKDPQQIQQIFNQY

SEQ ID NO: 25905 - protein, 247 aa, Thermococcus kodakarensis KOD1
MILAFIGTAGSGKTTLTGEFGKYLSENGYRVAYVNLDTGVRKLPYTPDLDVREKVTAWSLMDEGLGPNGAIVKSYDILAEYTGEYAEKIRELDKESDYVLIDTPGQMETFLFHEFGVELMEAFPDALGVYLFSPEVLRKPSDFCFAVFFGLMIDLRLGITTVPALNKVDTVEDIEGIRKYLDDIEYLTARLKLEPSTQGLLAYKLCSSLPELAPPTRVLYLSAKTGEGFEDLETVAYEHYCTCGDLT

SEQ ID NO: 25906 - protein, 1467 aa, Yarrowia lipolytica CLIB122
MAHYYPSGVSSVGNFDSLDVEIRSLAEGMVHKPHHRESRYIFDHTFDDEFREEHEDEYDYDMLRKTSFENPDVNPYVEASAEPELDPWSGEFNSRKWIKTVLGLKERFGNSKGITAGVSFKNLGAYGYGSRSDYQKTFLNVIVATGDLLRSAIGAKRTSKIQILRKCDGLVLPGETCVPRDVMTKHCRGEIVYNAEHDIHFPHLTVGQTLMFAALARTPRNRVLGVTREQYARHTRDVTMATLGLSHTINTKVGSDLVRGVSGGERKRVSIAESVVCGAPLQCWDNSTRGLDAANATEFIRSLRLSAQMTGASMFVSLYQASQEAYDMFDKVCLLYEGRQIFFGKAGEATSYFEGLGFERAHRQTTGDFLTSLTNPVERRIKAGWEKLVPRTPEEFESRWRSSRTHALLVYNIDRFNTTHPLGGQGYVEFMKLRKESQARNTRLSSPYLLSWPMQVRLCLWRGFLLVRGDLSMTLMTIIGNFIMALILASMYYNLRESTDAFFSRSALLFLAMLLNAMASVLEIFVLYGQRPLIEKHKRYALYHPFAESIASMLVDLPTKLATLISVNLALYFMTNLRRTPGAFFIFLLFSFTCTMAMSMIFRFTASVTKTMEQALAPASVLVLALVIYTGFTLPVDYMHGWARWMNYLNPVAYAFEAVMVNEFRNRRFPCGLYVPSRSFYNSVPAESKSCVAIGAKLGQDYVDGSVFISTAYKYETGHLWRNLGILWAFAGFFCGVYLLAAEYVTMAQSKGEVLLFKRSQHRKNLKAKPDKRFQDVELGDNLGDHNLDQNLGDNHSTYSYQQPIQAQHSGVFQWTDVCYDIKVAGENKRLLDHIDGYVKPGTLTALMGASGAGKTTLLDVLADRKSTGIVHGDMLVNGQQRNASFQRKTGYVQQQDLHTATATVRESLEFSALLRQPSSVSRADKLAYVDEVISILEMDSYADAVVGVPGEGLNVEQRKRLTIGVELAAKPELLLFLDEPTSGLDSQTAWSIVSLLKKLAANGQAILCTIHQPSAILFQEFDRLLFLAAGGKTVYYGDLGDKASLLIEYFESNGADPCPDNGNPAEWMLEVIGAAPGSRAKKDWPSVWRYSQLRRQQREELDDMRLAFNADSQAALAVGGEDTDFAVSQWTQLYYVTKRLLQFHWRTPSYLWSKMTLCIGCALFIGFSFYKSARDIQGLQNQMFSIFLMFLIFTTVAEQIMPLFMIQRDLYEARERASKTYSWQVFLGGNMLAELPWQIIVAVVVFFCMYYPIGFYRIAAENHQTQERGALYFLFLLVFFIYDSTYAHMIGVMFNNHETAANFAYLLFSFCLMFCGVLATKESMPGFWIFMYRASPLTYFIGGFMATGLAGGKVTCSQHEILQFKPLKGNSCAQYMKPFLDNAGIFKGYLLNETATDMCHYCPIENADAYLDNASIFYGDRWRNFGIVFAYPIFNVCATFMLYYVLRVPGVRYKIASKVRWRRKKQ

SEQ ID NO: 25907 - protein, 370 aa, Rhodospirillum rubrum ATCC 11170
MPVSKKILFLAGDGIGPEVMAQVRRVMDWLNQTGRTAFEVEDALVGGAAYDAQGTPLHDDTVALALAADAVLLGAVGGPKWDASLPFELKPERGLLRLRKDLELFANLRPAMVFDALAEASTLKTELVSGLDVMIVRELTGGVYFGQPRGISALPNGERRGVNTQVYDTHEIVRVAKVAFDLAGKRGKRLCSVEKANVMESGLLWREEVTKLGADYPEIALSHMYADNCAMQLVRQPKQFDVIVTDNLFGDILSDCAAMLTGSLGMLPSASLGAADAAGNRRAMYEPVHGSAPDIAGQDKANPLATILSFSMMLRYSFDLAEEADLVDNAVRGVLAKGLRTGDIFQPGKTLVGTTGMGDALLAEMAQLAN

SEQ ID NO: 25908 - protein, 381 aa, Triticum aestivum
MLSPAGLQNVHGLRRREFRATLAHLHSMASAGMPVDVGAQMFLTTMNVITGTLWGGNIGTESERTAVGKEFRELVAEITEMLGAPNVSDFFPALAPFDLQGIRKKSDALKERFDEIFGRIIEKRVEADHAGGDTAEDFLEYMLKMEKEGGDGKAAFTMTNVKALLMDMVVGGTETTSNTVEWAMAEMLQNRGILRKVREELDAVVGIDGVVEESDLPQLHYLHLVVKETLRLHPALPLMVPHCPSEDTTVGGHRVPAGSRVFVNAWAIMRDPAAWKDPAKFIPERFASQASDGDSGRKVDFTGSELDYVPFGSGRRICAGIAMAERMTAYSVAMLLQAFDWELPEGAALDLTEKFGIVMKKATPLVAVPTPRLSRPELYSA

SEQ ID NO: 25909 - protein, 489 aa, Herminiimonas arsenicoxydans
MALTDFDLVLFGGGGDLSMRKLIPAMYARDRAGDLPATAQIICIGRQNWNDAEFVQALNENARQHINEKVFAQASWDKFCARVRYVSLDATDAATYQPLNDVLRSDTNITRVFYLATPPTLFARICHNLSARGLATEHSRVVLEKPLGRDLASAKEINLEVGQVFKESQIFRIDHYLGKEAVQNLLALRFGNVLFEPLWRREWISDVQITIAEEIGVGNRMGYYETSGALRDMLQNHLLQLLCIVAMEPPLSVSADAVRDEKLKVLRSLKPFTPTTLARNIVRGQYRAGHVEGKAVPAYRQEKNANPESNTETFVAVKAEIDTWRWAGVPFYLRTGKRMADQLAEIVVRFKAIPHSIFTQSNSSFQPNCLVIRLQPDDGLQLNLMAKTPGDGMRLKPVELELDFAETFKAPRMDAYERLLLDVLRGQLTLFMRSDELEAAWEWVEPVLRYWEHEGNEPMPYTSGTWGPAAASALIGRDGLQWREEALPE

SEQ ID NO: 25910 - protein, 518 aa, Herminiimonas arsenicoxydans
MFAQDPARFTKLSTEGAGLFFDYSKNIVNDQTMDLLHALARETRVEAQRDAMFAGEQINRTEHRAVLHTALRRPRSDKLALDGHDIIPDIHAVLDRMAAFSERVRSGTWRGYDGREITDIVNIGIGGSYLGPKMTCQALRSFGHPRLVMHFVSNVDGHDLDALLPRIDPATTLFIIASKTFGTSETMTNARSARAWLLRSTNASQLPKHFVAVSTQLDLVTEFGIAAENMFPFWDWVGGRYSVWSAIGLALVMYIGMDRFREFLAGAHAMDQHFQHTPLEKNLPVILALIGIWNRNFIGSTSISIAPYHQDLRLFPGYLQQLEMESNGKRIKVDGSKVEVATCPVIWGDVGTNGQHAYFQLLHQGTDVAVVDFIAALQPSHTLESHQLLLLANCFAQSEAFMRGRNADEVRADLQGQGLPPEEVEKLIPHRSFPGNRPSNTILMDALTPGTLGALIALYEHKVFVQGVIWGINSFDQWGVELGKLLAKNIAQELAEQARPAQHDSSTNGLIARAREKM

SEQ ID NO: 25911 - protein, 170 aa, Triticum aestivum
  misc_feature (62)..(62): Xaa can be any naturally occurring amino acid
  misc_feature (149)..(149): Xaa can be any naturally occurring amino acid
VNPKVFFDTTIGGQPAGRIVMELFADQVPKTAENFRALCTGEKGTGKSGKPLHYKGSSFHRXIPQFMLQGGDFTRGNGTGGESIYGEKFEDENFNLRHTGPGILSMANARPGTNGSQFFICTVKTSWLDGKHVVFGQVVQGLEVVQAIXKVGSQNGSTKQTVPIADCGQF

SEQ ID NO: 25912 - protein, 226 aa, Glycine max
  misc_feature (145)..(145): Xaa can be any naturally occurring amino acid
MESKEEDVRVGATKFSERQPIGTAAQGDKDYKEPPPAPLFEPGELKSWSFYRAGIAEFVATFLFLYITILTVMGVNRSPSKCASVGIQGIAWAFGGMIFALVYCTAGVVKGFEGNARYEMFKGGANFVNSGYTKGDGLGAEIVGXFVLVYTVFSATDAKRNARDSHVPILAPLPIGFAVFLVHLATIPITGTGINPARSLGAAIIYNRDHAWDDQWIFWVGPFIGA

SEQ ID NO: 25913 - protein, 308 aa, Propionibacterium freudenreichii subsp. shermanii
MIYHDVTEVVGRTPLVRLNHVNDTDAVVLAKLEFYNPANSVKDRIGVSIVDAAEKSGALGAGGTIVEATSGNTGIALAMVGAARGYHVVITMPASMSRERRAVLHALGAELVLTPAVEGMRGAVTAAERIAAERGGVLASQFANAANPAAHHATTGPEIWNDTDGEVAALVSGVGTGGTVSGAGRYLKEQDPRVDVYAVEPDESPLLSRGRAAAHGIQGIGANFVPDTYDAAVVDEVLSVTTDQALAMARRLAAEEGILAGISSGAAVAAALEVGARPQYRGRTIVAIIPDFGERYLSTPLFAGLMDS

SEQ ID NO: 25914 - protein, 252 aa, Triticum aestivum
  misc_feature (229)..(229): Xaa can be any naturally occurring amino acid
  misc_feature (245)..(245): Xaa can be any naturally occurring amino acid
MAAMFSQNPLMNGPNYSFSEAPKTNHGEFREHRFNPYTDNGGSTLAIAGADFTIMAGDTRHTSGYSINSRMSPKVFRIGGTTASQEDATLVLSVVGFAADGEALRDHLDTICKIYRYRHGKPMSVNACAKRLSTVLYGKRFFPYYSHAMLGGLDEEGRGAVYSYDPVGSYEREQCRAGGAAGSLIMPFLDNQVNFKNQYIPGSGEGHELKERERRPLTRTEVETVVKDXAFDGAVERHIEVGDNXQMLIITA

SEQ ID NO: 25915 - protein, 264 aa, Candida albicans SC5314
MKLHIVSENNFPTAAGLASSAAGFAALVSAIAKLYELPQDMSELSKIARKGSGSACRSLFGGFVAWEMGTLPDGQDSKAVEIAPLEHWPSLRAVILVVSDDKKDTPSTTGMQSTVATSDLFAHRIAEVVPQRFEAMKKAILDKDFPKFAELTMKDSNSFHAVCLDSYPPIFYLNDTSKKIIKMVETINQQEVVAAYTFDAGPNAVIYYDEANQDKVLSLLYKHFGHVPGWKTHYTAETPVAGVSRIIQTSIGPGPQETSESLTK

SEQ ID NO: 25916 - protein, 332 aa, Triticum aestivum
MAAAVPIPAPAPAADDEIVYESMPCIRIYKNRVERYFGSEFVAASAHADAATGVASRDRVISPEVSARLYLPHIDPAKPDNAKLPVLVYYHGGGFCLGSAFNPTFHAYFNNLAALAGVLVVSVEYRLAPEHPVPAAYADSWDALAWVVSHAAPAAAGFEPWLADHADFARLYLGGESAGANIAHHVAMRVGAEGLPHGAAIHGLLMIHPYFLGTDKVASDDLDPAARESLASLWRVMCPTTTGEDDPLINPFVDGAPGLDALACRRVLVCIGEGDVLRDRGRAYYDRLRASGWSGEADIWQAPGKGHTFHLLEPCCEEAVAQDKVIAEFLNN

SEQ ID NO: 25917 - protein, 322 aa, Propionibacterium freudenreichii subsp. shermanii
MSAIHDSITELIFNTPLVRAPHYLKAAGAPDADIVLKLEYFNPAGSVKDRIALAMITDAEKRGVLKPGGTIIEPSSGNTGIGLAAVGTARGYKVKVVLPASLSVERRALIQAYGGEVILTPGPLAIKGSIAYAKQLHDADPSSVILGQFDNPANPEIHYKTTGPEIWKDTDGTVDVFIAGIGTGGTLSGAGKYLEEQKPDLKVIGIEPAKSPILEGGKPGPHGIQGIGTGFVPNTLDRSVYDEVVGITDEDSIAQARLLGTAEGIFVGISSGAALTAALQIAARDEYKGKRIVALLPDSGDRYLSTALGQFPELTVHEDVEL

SEQ ID NO: 25918 - protein, 539 aa, Streptococcus agalactiae 2603V/R
MLTVSDVSLRFSDRKLFDEVNINFTAGNTYGLIGANGAGKSTFLKILAGDIEPTTGHIALGPDERLSVLRQNHFDYEDERVIDVVIMGNETLYSIMKEKDAIYMKEDFSDEDGVRAAELEGEFAELGGWEAESEASQLLQNLNISEELHYQNMSELANGDKVKVLLAKALFGKPDVLLLDEPTNGLDIQSITWLEDFLIDFENTVIVVSHDRHFLNKVCTHMADLDFGKIKLFVGNYDFWKESSELAARLQADRNAKAEEKIKQLQEFVARFSANASKSKQATSRKKMLDKIELEEIVPSSRKYPFVNFKAEREMGNDLLTVENLSVTIDGEKILDNISFILRPGDKTALIGQNDIQTTALIRALMGDIEYEGTIKWGVTTSRSYLPKDNSRDFASGESILEWLRQFASKEEDDNTFLRGFLGRMLFSGDEVNKSVNVLSGGEKVRVMLSKLMLLKSNVLVLDDPTNHLDLESISSLNDGLKDFKESIIFASHDHEFIQTLANHIIVLSKNGVIDRIDETYDEFLENTEVQAKVAQLWK

SEQ ID NO: 25919 - protein, 159 aa, Streptococcus agalactiae 2603V/R
MKLKIITVGKLKEKYLKEGVAEYQKRLNRFSKIETIELADEKTPDKASISENQRILDIEGERILSKIGERDYVIGLAIEGKQLPSESFSHLIDQKMISGYSTITFVIGGSLGLSQKVKKRADYLMSFGLLTLPHQLMKLVLMEQIYRAFMIRQGTPYHK

SEQ ID NO: 25920 - protein, 413 aa, Thermococcus kodakarensis KOD1
MKAVILAGGFGTRLRPISSTRPKPMVPVLGKPNLQYLLENIEKIPEIDEVILSVHYMRGEIREFIDEKMADYPKDIRFVNDPMPLETGGALKNVEEYVSDDFLVIYGDVFTNFNFRELIEAHRNNDGLITVAVTKVYDPERFGVVETDENGKVTHFEEKPHRPKTNLVDAGIYVVNKKVLEEIPKGKEVYFEREVLPKFVARGEVYAYRMPRDAYWVDLGTPDDLFYAHQIAMDEIAKDNGYITIKEGAEVPDDVEIQGPVYIDEGAKIGHGVKIKAYTYIGPNTIVEDKAYLKRSILIGSDIIKERAELKDTILGEGVVVGKNVIIKENAVVGDYARIADDLVIYGAKVLPWKKVEEYEAYIKVKLDPTKVRPGQYPDHCPLGLPECIYKKFKAIAGEKPPCDECIENQWLF

SEQ ID NO: 25921 - protein, 137 aa, Campylobacter jejuni subsp. jejuni NCTC 11168
MEKTLSIIKPDAVKKGVIGKILDRFESNGLRIAAMKKVQLSKEQAENFYAVHKERPFFKDLVEFMISGPVVVSILEGEGAVLKNRDLMGATNPKEAKAGTIRADFAESIDANAVHGSDSLENAKIEIEFFFKPNEIC

SEQ ID NO: 25922 - protein, 369 aa, Brassica napus
MSAIHLLRKLSRRPPSRLHRNLLSSTFSMDLPPDLARTTLIRPFSNRPTIFNNTHRLIPSCFRQLNLLPNWVSEKKKSISVSLREFSISVVETNTSDKTFERVVGLNPNPLVIERIHNGEKTIGESVSGGEIIGNEIEKSEETLVREESEAEKEAWRILEDAVVRYCGSPVGTVAANDPGDKLPLNYDQVFIRDFVPSALAFLLKGEGEIVRNFLLHTLQLQSWEKTVDCYSPGQGLMPASFKVRTVALDENTTEEVLDPDFGESAIGRVAPVDSGLWWIILLRAYGKLTGDFSLQERIDVQTGIKLIMNLCLADGFDMFPTLLVTDGSCMIDRRMGIHGHPLEIQSLFYSALRCSREMLSVNDSSSNL

SEQ ID NO: 25923 - protein, 452 aa, Physcomitrella patens subsp. patens
MKKVPEDRYAQWKLLVPALYDWLTNHHLMWPSLSCRWGPQLEAGSSKTRQLLFYSERTDGECPNTIVVAQCDIMKPRTAAAEQISQAFIPPCCMSQRPEFKEGGKSPHLKKLKTIIHPGEVNRIREIPQNSNILATHTDSPKVLIWNTKTQPNRATTSAASESKPDLVLIGHTDNAEFALNVSRTAPYVISGGKTPKSITPTAAGSKQSGTAGGAADTTNVYTRGIFKGHTDTVEDVQFRPSSMNEFCSVGDDSCLLLWDARTGYQPISKVVKAHNADLHCVDWNAHDENLILTGSADNSVRLFDHRKILARGQAIPVEQFEGHSAAVLCVQWCPDRASVFGSCAEDGLLNVWDYEKVGKALDTTNLKQPVKVPPGLFFQHTGHRDKVVDFHWDSRDPWTIVSVSEDANTPGGGGTLQIWRMIDFIYRPEDEVLAELDEVRPQLVSQNTPAS

SEQ ID NO: 25924 - protein, 198 aa, Campylobacter jejuni subsp. jejuni NCTC 11168
MIVTKKALDFTAPAVLGNNEIVQDFNLYKNIGPKGAVVFFYPKDFTFVCPSEIIAFDKRYQEFKNRGIEVIGISGDNEFSHFAWKNTPVNQGGIGQVKFPLVADLTKQIARNFDVLYAEAVALRGSFLLDADGTVRHAVVNDLPLGRNIDEMLRMVDTMLFTNEHGEVCPAGWNKGDEGMKANPKGVAEYLGKNEAKL

SEQ ID NO: 25925 - protein, 388 aa, Yarrowia lipolytica CLIB122
MQGWRVTMEDAHATVLELKDAKGQPEKKKVAFFGVYDGHGGDKVAIYTGDNLHHIVARQEAFAKGDYGQALKDGFLSTDRAILEDAALKHDSSGCTATTAIVSDGKVICANAGDSRTVLGVKGIAKPMSFDHKPQHEGERTRICAAGGFVEAGRVNGNLALSRAIGDFDFKRSPYFPPEEQIVTAYPDVIEHQLTADDEFLILACDGIWDCFLSQEVVEFVRRGIAEKQTLVDICENLIDNCLAPTSDLSGVGCDNMTVMVVALLQGKTEEEWYNMVAERVKNGEGPAASREAVERVAGEEREVTAQQLQQNAQAQQANSASLALQQLLSSGATITDENGMVVLKAENAAELLAKVGFAPEDVGQLVESGDLVEEDVEVGGDRITEEQ

SEQ ID NO: 25926 - protein, 248 aa, Bacillus licheniformis ATCC 14580
MEFNQQTAIITGASRGIGRAIAELLADKGANVVINGTNEELLKSLCTQLNTERKCASYVAGDASLPETASLLIAEAKQRFGRIDILVNNAGVNLRKTTVDTSLEEWKRVIDLNLTGTFLMCQAVIPEMITQGGGKIVNMSSTTSKTPHHNASPAYGASKAGINYLTMHLAKELAEHRIHVNGVCPGPIETDMSKQWSEEYRAAVVERIPLKMLGSPEHVANVVAFLASDKSDFMTGETININGGTYMN

SEQ ID NO: 25927 - protein, 756 aa, Xanthomonas campestris pv. campestris str. ATCC 33913
MPAPMADHLPPPAAATAALHRHRPAVLLPRSPPAARSSSPSIPAYVKFFASCAKGLEYLLADELLALGASKATATISGVNVEGALRDAQRAVLWSRLASRVLWPLTEFDCPDEDALYAGVAELPWHEHLSTGHTLSVDAHVSGTAITHARYAAQRIKDAVVDTIRRQGLERPSVDVESPDLRLNLSLRKGRATISVDLGGGPLHRRGWRMAQNEAPLKENLAAAVLLRAGWPRAYADGGGLLDPMCGSGTLLIEGALMAADVAPGLQRYGSDIPSRWRGFDRDSWQQLVTEARERDSVGRAALKQVIHGSDMDPHAIRAAKENAQVAGVAEAIWFGVREVGDLQTRPQATGVVVCNPPYDERLAADAALYRKLGDTLQRVVPQWRASLLCGNAELAYATGLRAGKKYQLFNGAIECALIVCDPIAVPRRTPLAAPTALSEGAQMVANRLRKNLQKFKKWRAREGIECFRVYDADLPEYSAAIDVYQQADGDRRIFLHVQEYAAPATIPEADVRRRLGELLAAAREVFEVPAERVALKSRERGKGGSKYGRFEQRNEIVNVREHGALLRVNLFDYLDTGLFLDHRPLRGTMAQQSKGRRFLNLFCYTGVASVQAAVAGASATTSVDLSGTYLQWCADNLALNGQAGSKHKLVQADALAWLEAERAHFDVIFCDPPTFSNSARAEDFDIQREHVRLLRAAVARLAPGGVLYFSNNFRRFKLDEEAVSEFAQCEEISPRTIDPDFERHARIHRAWRLTA

SEQ ID NO: 25928 - protein, 279 aa, Lactobacillus plantarum WCFS1
MNNNWLGLTDKVVAITGAVGGMGTKFCEEFAKQGAKIVLIDMIADKTEAYAKKLTEKYGVETLAVKCNTTNEEEVDAAVKAVTDKFGEVDVLVNTAAILRFSPLEDLRLDEWQAALNVNLTGYFLMSQRFGRVMIQQKHGAMVHISTVASRYPETYSGAYSTTKAAVNMMSKQMAAEWGQYGVRSNCVLPCLVKTPLSENFYSDPKVEEGRERLVASRRIGTLDDIANTVLFMASDRSDYTNGGEVTVDGGLNMMISDMIPKPGGRRQYAIDHHQPAKK

SEQ ID NO: 25929 - protein, 335 aa, Campylobacter jejuni subsp. jejuni NCTC 11168
MRLILDTDIGNAIAGANTDDGLALALILSSKEIKLEMLSTVCGNVPSLVAYSVAKDLFQRLNLNIPVYLGANEALKEPSKAWRQRLDESVKNFKLEYLWENIKSPEILENINPDAIFKMGELVSKNPKEISICAIGPLTNIAMTMKIFKDFDINLKELFIMGGSFDMPYYTKDTNFGFDPEAASIVLNSRAKITLIPYNATMQTLLTHEDLKELQGKNILCDFIVETLGVWIDYASKTRGTKGTWIHDALTIACALDSSIADFDECYADVICDSSLARGMSWRCFREPKMSMGVDLSTKNCVKILKNVDNARLLKLIKERLLKGVCYENYESITT

SEQ ID NO: 25930 - protein, 520 aa, Tuber borchii
MGFIIKRPEGESGKALPAILIGLFVAFGGILFGYDTGTINGILAMDFFQSEFATDGRKELTSSQTSLIVPILSAGTFFGALCASPFGDILGRRMGLIASCLVFSIGVALQVAATAIPLMAAGRVIAGLGVGLVSALVPLYQSESAPKWIRGSIVGCYQLAITIGLLLAACANQGTHARNNHGSYRIPLAIQFVWAAILAGGMFILPETPRYYIKKDNMEAAAKSMSRLRSLPADHPAIIEELNEIKAIHDLEMQATGEATYLDCVKPDMIKRLLTGCGIQALQQLTGINFIFYYGTQFFKNAGIKNAFLIGLITNLVNVISTFPGLWMVEKMGRRNLLLFGAIGMCACQFIVAIVGITTVSAIANNVLIAFVCFYIFFFACSWGPCSWVVTGEIYPLKVRAKCLSISTATNWLLNWAIGFSTPYLVAEGPGKPNLGTKIFFVWGSCCFLCIAFVYLFIYETKGLSLENVDQLYMTVGHAWESKKFTPSVSYNSDKMLSNGHGADGKSSELAHIEGGHGEV

SEQ ID NO: 25931 - protein, 1413 aa, Bacillus cereus G9241
MKRGKFGKILIGTLTAGMLLSQGIPYNVLAEEVNTSTLTGIDDANAILKGLTKEQRNALKTLDTKPGFVISPGINTASPNNVNVIIEFKQAPSKIEVLKQAAKGKKVALSNAEQKVEASHKGFKAELEQLQKNKEKGTNVKSAKITREYKNAFNGVAISIPANMIEDLVRTGIVKRVWEDHEVKIDLPKETAKTAVEPKMADSVPQIGVDKLHDEKITGKGIKVGVLDTGIDYNHPDLKDAYKGYRAKQGEDPSKIDPNSIKGWDFVNNDADPMETTYKDWQNSGGYPEIYEGSAYYTSHGTHVAGTISADKKNNVDYAVKGVAPDVDLYSYRVLGPYGSGQTSGILAAIDKAVKDDMDVINLSLGASINDPLYPTSVAVNNAMLAGVVTVVAAGNSGPEEGTIGSPSAAALPITVGASDAAMTIPTFSADAGDVHVDKMMLLGKSFTDKIEDLKGQSLSVVYAGLGKSGDFTGKDVKGKLALIQRGEITFDEKIKNAKEAGAKAVIVYNNVDGEITSYLGESTSSIPSFRLTKVDGEKLQAKAAQGDVALTFGEPSNIKTEGDHLADFSSRGPATKTDDIKPDIVAPGVSIFSTVPEYINDPKDGENYPVAYGRMSGTSMATPHTAGVAALILQEHPNYSPFEVKEALMNTAVDLKEERSVFEVGSGRIDAYRAVHADTSIEVIDKTSNVVDDEEVEIEEKTGSIAFGYKNQIETGPIKDSRKVLIKNSSKTDGKEFNLEVEFSPTSVGVQDAAKNGVKLNVPESIKVAPGTSEEISPEIIIPGNAEFGRYEGYIHITNKNNEKEVYQVPFAVKFTEKGIASVDLLRDAMATDASKFHPFMERPSSPLTFKLNSPLETIDAVVKDRKTGKALGVVGTLNANSLTPNVEYMMFSGMGGYVLPFTGDPTHPIGDKPVMLPDGDYELNFVGYDKEGKSYTKGDNIIIDNVIPEMKFKDVQPGIHEVNDSMFKEEDGQRALWVHGNIYDSTVDALKAKGLQYDQKANQIVYYQNSAFPSGWLNTIQANGDFKFGVLPEEINEPLNLKLFGYDLATAGNMATGYKDYVFVKEGTEYAVPSYNKDKIKLGEKITLTLNLNNVKQLMTGTFEIPYYKQLFKFADVKPNPALTEYVKQHGLNLKLEDPKINEEGAWENKVKVGASLEGKEFKGLDGDTPFLDVTFEMTNDEYFNDLTAFGVDKFSYTKAGASEGIEIPAFKDKSFAIVSKHSTVTGYIGPEAFLNEEGYLGKKDYTKLGAKVYAVGKDGKKYTGTIGDNGQFEIHSVPVSDKEYDIFVEMPGHLNSKLTTKIGKVQDGELVGQNFRADMDDNLAGDVNGDKMVDIQDARIAALSYGKGKVSVKDGDINQDGVVDETDIRFIEKNFLKKSPDAKENQKPKENVGPVTLDKILRSIGLEPKK

SEQ ID NO: 25932 - protein, 178 aa, Triticum aestivum
  misc_feature (145)..(145): Xaa can be any naturally occurring amino acid
  misc_feature (163)..(163): Xaa can be any naturally occurring amino acid
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKXTPEEFRKTFNIKNDFTPXERKRRFRRENQWAFQ

SEQ ID NO: 25933 - protein, 223 aa, Herminiimonas arsenicoxydans
MTQDEMKQAVARAAIEYVVPGEIIGVGTGSTANFFIDELGKIKDRIKGAVASSEATAQRLKSHGIAVFDLNEIDAMSVYIDGADEITAQGAMIKGGGAALTREKIVASVAKQFVCIADGSKLVDLLGNFPLPVEVIPMAQAVVARKLAALGGEPRLRLKDGKPLVTDNGCFIIDVLGLKIQDPAELEAQINNIVGVVTVGLFARRGADIALLGTAEGVKRLTF

SEQ ID NO: 25934 - protein, 248 aa, Ralstonia solanacearum GMI1000
MSARPKLVVGNWKLHGSLNGNAELLEKIKAAGQTRAALAVCAPFPYLAQCQSVLAGSSVAWGAQDVSAETRGAFTGEVAASMLSEFGCGYAIVGHSERRTYHGETDAQVAIKALRALEHGITPIVCVGETLAQREAGETELVVARQLEAVLESLSVEQLGHIVVAYEPVWAIGTGKTATSEQAQAVHAFLRGRVAACDAGVAQRMPILYGGSVKPDNAAELFTMADIDGGLIGGASLKAEDFLAIGRA

SEQ ID NO: 25935 - protein, 407 aa, Bacillus cereus ATCC 10987
MDTLIFEVGTALVLVAFAAILAAKLKFSIIPFLIILGMLVGPHAPDLGLIDLRFIESGEVISFLGRVGVIFLLFYLGLEFSIKKLIKSGKSIAFGGTVHISLNFILGLLYGYVMGFPLLETLIIAGIITISSSAIVAKVIVDLRRSGNKETELILGIIMFDDIFLAVYLSVVSGLVLGGATSFVGALTSVLIAVGYMLLFFVIARKATPFLNKILDISSNEIFIIVIFAILFFVAGFSETIHVAEAIGALLLGLVFSETEHSDRIEHLVVPFRDFFGAIFFFSFGLSIDPFSLGGAVWLTLGAVLITLIGNFTAGMMAGRKAGLSHKASTNIGLTLVSRGEFSIIVANIGIAGGLMAAIKPFSALYVLILASLGPLLTKESGRIYSLLDKVFKWSAKERAKREKEVG

SEQ ID NO: 25936 - protein, 426 aa, Arabidopsis thaliana
MSACINGLCRAVTVSLLLLLLSFSFSSACSNGNCQLLDSCSSATDCVSGLYCGDCPAVGRSKPVCTRGQATSPTSIINGLPFNKYTWLMTHNAFSNANAPLLPGVERITFYNQEDTITNQLQNGVRGLMLDMYDFNNDIWLCHSLRGQCFNFTAFQPAINILREVEAFLSQNPTEIVTIIIEDYVHRPKGLSTLFANAGLDKYWFPVSKMPRKGEDWPTVTDMVQENHRLLVFTSVAAKEDEEGVAYQWRYMVENESGDPGVKRGSCPNRKESQPLNSKSSSLFLMNYFPTYPVEKDACKEHSAPLAEMVGTCLKSGGNRMPNFLAVNFYMRSDGGGVFEILDRMNGPVLCGCETLSACQPGAAYGSCKNVTVQTRTPSMDSTAGSNSGGSYSGSVQFSRSLASVAQLNNIVVFCFSLLPLLIFLL

SEQ ID NO: 25937 - protein, 109 aa, Triticum aestivum
HYDTSLYKKAGWYRSGIPGISSTHASGIEAVKMSKHAGWGVMTSHRSGETEDTFIADLAVGLSTGQIKTGAPCRSERLAKYNQLLRIEEELGDAAVYAGLKFRAPVEPY

SEQ ID NO: 25938 - protein, 418 aa, Ricinus communis
MFGRAPKKSDNTKYYEILGVSKNASQDDLKKAYRKAAIKNHPDKGGDPEKFKELAQAYEVLSDPEKREIYDQYGEDALKEGMGGGGGGGHDPFDIFQSFFGGSPFGGGGSSRGRRQRRGEDVIHPLKVSLEDLYNGTSKKLSLSRNVICSKCKGKGSKSGASMKCSGCQGSGMKVSIRHLGPSMIQQMQHPCNECKGTGETINDKDRCPQCKGEKVVQEKKVLEVIVEKGMQNGQKITFPGEADEAPDTITGDIVFVLQQKEHPKFKRKGDDLVVEHTLSLTEALCGFQFILTHLDGRQLLIKSQPGEVVKPDQFKAINDEGMPMYQRPFMRGKLYIHFSVDFPDSLPPDQCKALETVLPSRTSVQLSDMELDECEETTLHDVNFEEEMRRKQQQAQEAYDEDEDMHGGAQRVQCAQQ

SEQ ID NO: 25939 - protein, 514 aa, Candida albicans SC5314
MSMYPQRTQHQQRLTELLDAIKTEFDYASNEASSFKKVQEDYDSKYQQQAAEMQQIRQTVYDLELAHRKIKEAYEEEILRLKNELDTRDRQMKNGFQQQQQQQQQQQQQQQQQQQQIVAPPAAPPAPPTPVTSLSVIDKSQYIVNPTQRANHVKEIPPFLQDLDIAKANPEFKKQHLEYYVLYNPAFSKDLDIDMVHSLDHSSVVCCVRFSRDGKFIATGCNKTTQVFNVTTGELVAKLIDESSNENKDDNTTASGDLYIRSVCFSPDGKLLATGAEDKLIRIWDLSTKRIIKILRGHEQDIYSLDFFPDGDRLVSGSGDRSVRIWDLRTSQCSLTLSIEDGVTTVAVSPDGKLIAAGSLDRTVRVWDSTTGFLVERLDSGNENGNGHEDSVYSVAFSNNGEQIASGSLDRTVKLWHLEGKSDKKSTCEVTYIGHKDFVLSVCCTPDNEYILSGSKDRGVIFWDQASGNPLLMLQGHRNSVISVAVSLNSKGTEGIFATGSGDCKARIWKWTKK

SEQ ID NO: 25940 - protein, 590 aa, Coprinopsis cinerea okayama7#130
MEDDDLARAIALSLQDQGPPPREVINLDSDPEDDQEAEFQRQLQLALEASKAEERAKKRGKSAEVQEEPKTQEAEPPQVVASSSFLSERAKLERERLERVRKLQEQRGISTSSSTRRSSPDDSSSDDEDSRPHKRPNLGSTTSFGQSNSKASSSSRPAASGAEGELFWNGEFRQTATRGVDPRADGKPTFRLTQVLGEKKDLTFAIISSFALDLPWIYEFFDRSVPVIVVAQPDATGQASMKNVLPNWIKTTPPLRGGYGCQHMKFMLLFHKTGRLRVVVSTANLISYDWREMENTVWLQDVPLRSSSSTAPVRATDDFPGTLLYMLAALNVVPALKIMINEHPNLPIKTIEELRERWDWSKVKAHLVPSIAGKHEGWPSVIKTGHPRLMAVVRKMAMRTGTGSQAKKLTLECQGSSLGNYTTQWLNEFYYSARGESAEDWLDRSKKQREKQPYPPVKIIFPTKKTVQESTFGEQMIIGTLRDSTHASTSQDGSETEDSDDEIQIIQPAVGWAYIGSHNFTPSAWGTLSGSSFNPTLNITNYEVGVVFPLKDDAEVEKVACFQRPPKKYVAGKDEPWIQEESVHHQTQLV

SEQ ID NO: 25941 - protein, 175 aa, Populus trichocarpa x Populus deltoides
MASPTLLTPTSRLKPLSPIKPKPTPTTAFPPPTPPQQQIRNHLLRRHFLSLATAVLTSPLILPVTPAFAASDEEYVKDTEEVIGKVRTTMNMDKSDPNVADAVAVLRETSNSWVAKYRREKALLGRASFRDIYSALNAVTGHYISFGPTAPIPSKRKARILEEMDTAEKALLRGR

SEQ ID NO: 25942 - protein, 120 aa, Cucurbita maxima
MAVEGQVIPLRDAEEFDAIIDKEKESGRLIVIDFTASWCPPCRFIAPVFAELAKAHVHVTFLKVDVDNVKEIAKRFEVTAMPTFVFLKGGNEVHRIVGADKVELGVKVLELSAAPATCAS

SEQ ID NO: 25943 - protein, 429 aa, Burkholderia xenovorans LB400
MTMKNAELKSRKDAATPRGVGVMCDFYAERAENAELWDIEGRRFIDFAAGIAVCNTGHRHPKIVAAIRDQLDHFTHTAYQIVPYASYVELAEKLNERAPGDYPKKTAFFTTGAEAVENAIKIARAATGRPGVIAFTGAFHGRTLMGMALTGKVAPYKIGFGPFPSDVFHAPFPNPLHGVTTADSLKAIEFLFKADIDPKRVAAIIFEPVQGEGGFYPAPAEFVRALRKLCNEHGILLIADEVQTGFARTGKLFAMNHYDVVPDLMTVAKSLAGGMPLSGVIGRADVMDAAAPGGLGGTYAGNPLAVAAAHAVLDIIDEEKLCERATLLGDRIKAKLIALQSDVPQIADVRGPGGMVAVEFCKAGTTEPDAEFTKRVQSRALERGLLLLVCGVYSNVVRFLFPLTIQEAVFDEALAILEDVIKDSVAITV

SEQ ID NO: 25944 - protein, 525 aa, Arabidopsis thaliana
MWIENLCYCCKICDFYVDLFCVKYPPPDVIDISETHHHKLTHIKKWTKFNCIAKCGKKFYGFPYKCLECHLMFDMDCVWNPPEAKNQSEVNISSHPLHPLKLHTSQPPDYSDEKCRLCTRKIEGLFYHCSSCNFSLDMRCVINPPPQFVMDLKVHDHELTLLPRLDSFTCNACGLKGDRSPYICVQCGFIIHQDCLSLPRLININRHAHRVSRTSVLGVVNSVCGVCHQKVDWTWGGYSCQRCPQYVVHSKCATRKDVWNGKELEGVPEEIEDIEPYVVIDDNTIQHFSHKEHYLRFHVNGLLWEENKRCSACTHPVRLQSFYACKDCDFILHQHCAESPKKEWHVLHNDRLTLVTCVANFFSCTACSRLSNGFMYQCDFMKLDVLCGLVSEPYIHPGHPHHPLYYIPQVEEKQCNGCNNREVRVLTCIESGCGYVLCFDCATLPQVVKHRVDGHPLSLCYGEEASGKYWCDICEKETYPKTWFYTCKDHRASLHTKCVLGDLVGLMPRSTIDYYDISYEVVVNI

SEQ ID NO: 25945 - protein, 486 aa, Burkholderia xenovorans LB400
MTTLTLKDPSLLKTHAYIAGEWQGADDGSTFEVKNPATGEIIATVPRMGTAETRRAIDTANAAWPAWRATTAKQRAVILRKWHDLMMENADDLAKILTTEQGKPLAEAKGEIQYAASFLEWFAEEGKRVNGDTIPTPANDKRIVVTKEPIGVCAAITPWNFPAAMITRKVGPALAAGCPIIVKPAEATPLSALALAVLAERAGVPRGVFNVVTGEPKAIGAEMTGNPVVRKLSFTGSTPVGRLLMAQCAPTVKKVSLELGGNAPFIVFDDADLDAAVAGAIASKYRNSGQTCVCTNRFYVHDKVYDAFAEKLRVAVEQLKVGRGTEDGVTQGPLINEAAVLKVESHIEDALAKGARIVTGGKRHVLGHGFFEPTVLADVTPAMKVARDETFGPLAPLFRFSSDEEVIRLANDTEFGLASYFYSRDIGRVWRVAEALEYGMVGINTGLISNEVAPFGGVKQSGLGREGSHYGIDDYVVIKYLCVGGI

SEQ ID NO: 25946 - protein, 252 aa, Thiobacillus denitrificans ATCC 25259
MSLFSQLKEDIAVVFDRDPAARSTFEVVTTYPGFHAVLIHRLAHRLWRMQWKWLARFTSHLGRWLTGIEIHPGATIGRRVFIDHGMGVVVGETAEIGDDCTLYHGVTLGGTSWNKGKRHPTLMNGVVVGAGAKILGPITVGANARVGSNAVVVKDVPEDATAVGIPARILDSAAEKQRNRQAEKLGFSAYAISADMNDPVVKAIHGLIDHSAHIDHRLDLILAQLQKLGVEMPAGQDKPDDFDANYLNKIVD

SEQ ID NO: 25947 - protein, 402 aa, Thiobacillus denitrificans ATCC 25259
MKTIYFDYSATTPVDPRVADKMIPYLTEHFGNPASRSHPFGWEAEAAVEAARGHIAALVGADPKEIVFTSGATESNNLAIKGAGHFYSGTKGKHIITVRTEHKAVLDTVREMERQGFEATYLNVKENGLLDLDEFRAAIRPDTVLASVMAVNNEIGVIQDIDALGKICREKGVVFHVDAAQATGKMPIDLKTLPVDLMSFSAHKTYGPKGIGALYVRRKPRIRLEAQMHGGGHERGMRSGTLATHQIVGMGEAFRIAREEMATENERIRMLRDRLYAGLKDIEEVHLNGDLDRRVPHNLNVSFNFVEGESLIMAIKDLAVSSGSACTSASLEPSYVLRALGRSDELAHSSIRFSIGRFTTEQEVDYAIKLLHEKIGKLRELSPLWEMFKEGIDLNTVQWAAH

SEQ ID NO: 25948 - protein, 517 aa, Zea mays
MDKAYIAALSAAALFLLHYLLGRRAGGEGKTKGSQRRLPPSPPAIPFLGHLHLVKAPFHAALARLAARHGPVFSMRLGTRRAVVVSSPDCARECFTEHDVNFANRPLFPSMRLASFDGAMLSVSSYGPYWRNLRRVAAVQLLSAHRVACMAPAIEAQVRAMVRRMDRAAAAGGGGAARVQLKRRLFELSLSVLMETIAHTKTSRAEADADSDMSPEAHEFKQIVDELVPYIGTANRWDYLPVLRWFDVFGVRNKILDAVGRRDAFLRRLIDGERRRLDAGDDSESKSMIAVLLTLQKSEPEVYTDTVITALCANLFGAGTETTSTTTEWAMSLLLNHREALKKAQAEIDAAVGTSRLVTADDVPHLTYLQCIVDETLRLHPAAPLLLPHESAADCTVGGYDVPRGTMLLVNVHAVHRDPAVWDDPDRFVPERFEGGKAEGRLLMPFGMGRRKCPGETLALRTVGLVLGTLLQCFDWDTVDGAQVDMKASGGLTMPRAVPLEAMCRPRTAMRDVLKRL

SEQ ID NO: 25949 - protein, 316 aa, Triticum aestivum
  misc_feature (12)..(12): Xaa can be any naturally occurring amino acid
MEAAGDEERPLXQHPPPHLHQDGDSRYTNDGTMDVNGQPAVKASTGNWRACFFILGVQFSECLAFFAISKNLVTYLTSVLHESNIDAARNVSTWFGTTFFTPLVGAFLADTYWGRYKTLVVFLSVYTVGMLVLTVSTTLPWMMQSSNHSEIHRIAVYAGLYLTALGNGGIKPCTSTFGADQFDITDPTERVKKGSFFNWSFFSITVGSLLSTTVIVWVQDNVGWGIGFAVPMILTSLGFAVFVTSRRVYRYKTLGESPMTRVSQVVVAAARNCHMELPDNSSALHHLPSPPIETTFKVHHTTQFRFLDKAAIVPPP

SEQ ID NO: 25950 - protein, 128 aa, Thiobacillus denitrificans ATCC 25259
MSYSDKVLDHYENPRNVGAFNKEDEGVGTGMVGAPACGDVMKLQIKVGKDGLIEDAKFKTYGCGSAIASSSLVTEWVKGKTLDQAMEIKNTAIAEELALPPVKIHCSILAEDAIKAAVADYKQKKGLE

SEQ ID NO: 25951 - protein, 324 aa, Candida glabrata CBS 138
MSGIGESRTELLNWLNDLLKLNYKKIEECGTGAAYCQIMDSIYGDVPMHRVRFNSTADYENQINYKVLQSNFTKHNIEKTVYVDKLIRCRFQDNLEFLQWLKKYWVNNKDGTPYDAEARRNYRPISSTNSGTPGTPSGLSSASNSSSTLNISKRRNMSDSTSLSRTQSLSTRYASGTSGNNINRRVTSEQIIALQTELSQSHNKIQEMEQEMGTFKEALTAMEAENNFYFSKLRDIEILVQTTQDFIKEGLYKGDVEELDKFTNKVQHILYATIESASNEETKDTNESNRITTNNTSSGNIASQTLEGESLRSSNNLIIDEETF

SEQ ID NO: 25952 - protein, 208 aa, Triticum aestivum
  misc_feature (111)..(111): Xaa can be any naturally occurring amino acid
NKFVQKSRLVPVRNSRDIVDPRVRVKQVVRNGQNSGGLGKNIDRMFKDAITAGKRVRCETNISAGAVSVSSAAVELAMMKLPKSECLSARMLLIGAGKMGKLVVKHLIAKXCKKVVVVNRSVERVDAIRQEMKDIEIVYRPLTEMYEAAAEADVVFTSTASESLLFTKEHAEALPPISLAVGGVRLFVDISVPRNVGLCLSDCRLHVT

SEQ ID NO: 25953 - protein, 360 aa, Corynebacterium diphtheriae NCTC 13129
MSTTTIVVDMSTQYEKYTSTENGGEFIRDTQYIDDRIVDSVSAPTPLEDGHTLWPAEPRRYRLVAARACPWAHRTVITRRLKGLEDVISLGLVGPTHDWRSWTFDLDPNEVDPVLGIPRLRDAYLKRFPDYPHGITVPAIVEVATGKIVTNDYPSIVCDLNDQWSKYERPGAPDLYPETLREEIDAITKRIFTEVNNGVYRCGFAGSQEAYDKAYDRLFTAVDWLEERLSHQRYLVGKHITIADIYLYTTLVRFDAVYHGHFKCNRNKITEMPNLWGYLRDLFQTPGFGDTTDFTEIKQHYYITHQDVNPTQIVPKGPSLESFFSPHGREKLGDSPFTEGVTPPGEISYEERLKNKIDGQ

SEQ ID NO: 25954 - protein, 533 aa, Campylobacter jejuni subsp. jejuni NCTC 11168
MILLIDNYDSFVFNVKSMLEQLSNDEILVRRNDAISLSEIKNLNPTHIILSPGPKHPSQSGICLEIFKARLNIPVLGICLGHQALALAFDSLVVKMQEPMHAKNSLIKQCRENELFSNLPSNFSVMRYHSLEVKQLSDELEILALDEKGVIMALGHKNLPYYGVQFHPESYFSEYGLQLFSNFLKQDIKKPQKQENPLSFYLQKMSENHFLQSDDFEQICKIIMSKDYEILQVVALLILITEKSLNEKSLSAFVRQILRYSQTFSDESEMIDICGTGGDGFKSINVSTTSAFILAALGVKVAKHGNRAISSSSGSTDVLEALNITTPNTLESVLKQLNNQGLSFLHAPFFHPLVGELKEIRSRLGVRTVFNVLGPLLHPNLKLKYQLMGNYHAPVHRLLIEVLKNLGRKKALVVRGNDGMDELSICDESKIYELCEGEILEYSICPEQFGFKRAFHSEIIGSSAYDNAKDLKDILSGRMQGAKFDLVVLNAMFALYTANKASSPLVAKDMILEAIYSGKVIEYFKEYQAYAKA

SEQ ID NO: 25955 - protein, 308 aa, Prochlorococcus marinus str. MIT 9313
MARKGIILAGGSGTRLNPITQAVSKQLLPVYDKPMIYYPLSTLMLAGIREVLIITTPQDQAAFDRLLGDGSQWGMSIQYAVQPSPDGLAQAFLIGADFLDGAPAALVLGDNLFHGHELVPQLQACNRQGSGATVFVYPVRDPERYGVAEFDASGRVLSLEEKPTQPKSRYAVTGLYFYDASVVAKAHQVQPSHRGELEITDVNRMYLEEGLLRVQQMGRGMAWLDTGTCDSLHDACSYIRTLEHRQGLKVGCPEEVAWRQGWINLQELEQLSMPLRKSGYGHYLMQLVEESVSDHGALQRTVEVADAG

SEQ ID NO: 25956 - protein, 475 aa, Bacillus cereus G9241
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 25957 - protein, 399 aa, Rhodospirillum rubrum ATCC 11170
MNIHEYQAKQVLAKYGVPVLKGGVAYTAEEAEKVALDLAGPVYVVKSQIHAGGRGKGHFKEPSAGDKGGVRVVKSTDEVFSNAKQMLGATLVTHQSGAEGKEVKRVYIEDGCDIKRELYLSLLVDRATSAVTVMASTEGGMDIEEVANHSPEKIFFQAIDQATGISGFHCRNVAFSLGLEGKQVGAFTKLLSALYKCFTETDCSMLEINPLVVTGDGQVIPLDCKMNFDSNALYRHPDIVEYRDEDEEDPMELEASKHDLNYIKLDGSIGCMVNGAGLAMATMDIIKLKGGAPANFLDVGGGATRERVTAAFKIILSDPNVDGILVNIFGGIMRCDVIAEGVIAAAREVSLNVPLVVRLEGTNVELGKKIMVESGLPIISADNLADAAEKVVKAVKEAS

SEQ ID NO: 25958 - protein, 175 aa, Triticum aestivum
MLRAGGSRLVAPGLRRLLGPGAGERAAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 25959 - protein, 349 aa, Herminiimonas arsenicoxydans
MTKLKKTVLSLLLAATLPAFAQSKPVVQFIATGGTIAMKIDPVKNAPVPAISGDDLLATVPDVAKYASIEVNNLSNVPSDYMDPTRWVALTKAVQTALDRPEVAGAIVSHGTDTLEETAYWLDLTVKSSKPVILIGAQRNASVSDFDGPRNLLNAVRIAVDTQSKDKGVLLAMNNQINAARSVTKTHTANVETFKSGDFGFLGEVYPDRVIYASTPVRRQYIPIRTDKMPEVEIFAMYGGANGIAVRNAVDRGVKGIVVEALGMGNMNVAMLDAVKYAVAKKVPVVVTTRVHNGRVMPSYGFEGGGKTSFEAGAVMADDLKAAKARILLMLALQNGVNNQADLQATFSR

SEQ ID NO: 25960 - protein, 138 aa, Actinobacillus pleuropneumoniae serovar 1 str. 4074
MIQQTLCLIKPDATQRNLIGKILSHLEEAGLTIKALKKVQLNQEQAEGFYAEHQGKEFFAPLVEFMISAPIVAVVLEGENAIAHYRELMGATNPEQRKAGTIRALYAISGRENSVHGSDSEQSAKREIAYFFTPNEIL

SEQ ID NO: 25961 - protein, 248 aa, Opitutaceae bacterium TAV2
MHREFGRTQSNWKYDGTRVTPVDVAISENIFRELGAQFPDDELFSEELAETEKPIALSARFAWVLDPIDGTNNYATGIAHCAISLALLEHGVPVYGVIYDMARRVLMHGGPGFGVRDGDREARVSAEAPSPYTLLGFHSPVDHAHAREAAVIVENFKIRGLGSSTLHLAYVAVGILGGVVDHNVRVWDIAAAVPLCLAGGGEVRYVTPSPFPLREFNLRMDRIHFLAGNRAVCDHLSALLELREGRVV

SEQ ID NO: 25962 - protein, 333 aa, Rhodobacter sphaeroides
MGELIEGVWHPNWYDTASNGGRFVRSRARFRNWITADGSPGPSGEGGFPAEAGRYHLYVAHACPWAHRTMIFRALKDLAPLIDVSVVHPEMLEDGWTFDRSFPGATGDRLYGLAFLREIYLKADPGISARVTVPVLWDRKRETIVSNESAEIIRMFNAAFDHITGNRLDFLPEGDLDEIDRLNDRIYGTVNNGVYRAGFATTQEAYDEAAAPLFETLDWLEERLATRRYLVGDRLTEADWRLFTTLVRFDKVYHTHFKCNRRQIVQYPNLWGWLRELWQVPGVAETVHFDHIVRHYYFSHDTINPHRIVPLTPDPDFAAPHGRDQLFQASRLR

SEQ ID NO: 25963 - protein, 539 aa, Corynebacterium glutamicum ATCC 13032
MQARLKAARNVIGAFAGEGPLYPPSDVVDAFEDADEILDEHAEILLGEPLPDTPSCIMVTLPTEAATDIELVRGFAKSGMNLARINCAHDDETVWKQMIDNVHTVAEEVGREIRVSMDLAGPKVRTGEIAPGAEVGRARVTRDETGKVLTPAKLWITAHGSEPVPAPESLPGRPALPIEVTPEWFDKLEIGSVINVPDTRGSRRAFTVTRVFDGAVLAEGPQKAYISNGTLLEHNYDRSRVYGIPAVVQRINLKVGDRLILTDEELTYDPSLGSGRTPRISCTLPQAVDAIKVGHRVLFDDGAIAAVCIDKTSTADGHNDVELEVTHARPQGVNLAAYKGINLPDSELPLPSLTEEDLQHLRFVVKYADIAAISFIRNVADVEYLLQALADIGDPVAVERLGLVLKIETIPGYEGLAQILLTGMRHENFGIMIARGDLAVELGFDRMAEVPQLIMALAEAAHVPTILATQVLENMAKNGLPSRAEITDAAMALRAECVMLNKGPHINDAIKVLTEMSRKLGASQRKSRLLLRKVKSWEE

SEQ ID NO: 25964 - protein, 470 aa, Chlamydophila caviae GPIC
MNKQKRFLSLLFLTLVLLGIWFCPHPEAITPEAWHLFAVFTTTILGIILQPVPMGAIVIIGISILLLTRTLTLEQGLSGFHEPIAWLVFLSFSIAKGIIKTGLGERVAYFFVSVLGQNPLGLSYGLVITDFLLAPAIPSVTARSGGILYPVVMGLSESFGSSSEKGTESLIGSFLIKVAYQSSVITSAMFLTAMAGNPLLAALASNAGISLTWALWAKAAIIPGLLSLVLMPIVLYKFYPPTITSCEEAIRSAKLRLKEMGPLKKGEKIILMIFILLVVLWTFGDLLRISATTAALIGLSLLILTNILDWHKDVMANTTAWETFIWFGALIMMASFLNQFGFIPLIGNSVAAGVAGLSWKVGFPILFLIYFYSHYLFASNTAHIGAMFPVFLAVSISLGTNPIFACLVFAFSSNLFGGLTHYGSGPAPLYFGSQLVSIKDWWRSGFILSIVNIAIWIGIGTLWWKLLGLF

SEQ ID NO: 25965 - protein, 338 aa, Glycine max
MGKVKIGINGFGRIGRLVARVALQRDDVELVAVNDPFITTDYMTYMFKYDSVHGHWKHHDVTVKDEKTLLFGDKPVTVFGHRNPEEIPWKSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 25966 - protein, 163 aa, Ralstonia solanacearum GMI1000
MRHIISVLLENEPGALSRVVGLFSARGYNIETLTVAPTEDASLSRMTIVTTGSDDIIEQITKHLNRLVEVVKVVDLTEGAHIERELMLVKVRAVGKEREEMKRTADIFRGRIIDVTEKTYTIELTGNGTKLDAFLDAIDRTAILETVRTGGSGIGRGERILKV

SEQ ID NO: 25967 - protein, 294 aa, Vitis vinifera
MYQYEKVEKIGEGTYGVVYKARDRVTNETIALKKIRLEQEDEGVPSTAIREISLLKEMQHGNIVRLQDVVHSEKRLYLVFEYLDLDLKKHMDSSPDFAKDLRLIKMFLHQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDFKSAFPKWPPKDLATVVPNLESAGIDLLSKMLCLDPSRRITARSALEHEYFKDIGFVP

SEQ ID NO: 25968 - protein, 422 aa, Triticum aestivum
  misc_feature (159)..(159): Xaa can be any naturally occurring amino acid
MAAASFIKAPAGQNPRLAIHAPGRGARVVRCSLGAAVGGRTEWLSSCAVLSSKVAALGPHSVNGHAAPAPVPNGAVLDLIPVSGVNGAAKNLPAPLRIADLSPAPMHGSELRVAYHGVPGAYSEPARSTRTGPGNAYLGLRRQIPGDHLEVAFQAVELXWIADRAVLPGENSLGGTIHRNYDLLLRHRLHIVGEVQLPVHHCLLALPGVRKENITRVISHPQALAQCEHTITRMGLNVVREAFDDTAGAAEYVANNGLRDTAAIASSRAAELYGMEILADGIQDDCGNVTRFVMLAREPIVPRTDRPFKTSIVFAHDKEGTSVLFKVLSAFAFRDITLTKIESRPHRHRPIRLVDDANRGTAKHFEYMFYVDFQASLAEPRAQNALAEVQEFTSFLRVLGSYPMDMTPMTAGSSSTVTSSDS

SEQ ID NO: 25969 - protein, 420 aa, Synechococcus sp. PCC 7002
MITTQPKPLAEQVRDDFPILHQTVHGKPLIYFDNAATSQKPKAVLDALLHYYQQDNANVHRGIHSLSARATDGYEGARDKVARFINAASRDEIVYTRNASEAINLVAYSWGLSNLGPGDEIILSVMEHHSNIVPWQMIAAKTGAVLKYVPLTQDETFDFEQYQALLSDKTKLVTVVHVSNTLGNVNPVTEIIQAARKYGAKILIDACQSLPHMPVDVQQMDCDWLVGSGHKMCAPTGIGFLYGKRAILEAMPPFLGGGEMIAEVFFDHSTYGELPHKFEAGTPAIGEAIALGAAVDYLSQIGMDRIHAYEAELTAYLFKGLRDIPNLKIYGKQPDAQGEGRAALAAFNVAGVHANDLATLLDHEGVAIRSGHHCTQPLHRLFEASGSARASLYFYNTTAEIDQFIAALKDTIDFFTSMGS

SEQ ID NO: 25970 - protein, 619 aa, Zea mays
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSRDYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRH

SEQ ID NO: 25971 - protein, 319 aa, Burkholderia xenovorans LB400
MIEPEIAAFIERTAAIYPGHSASLTPPEQREIYDRYAAAFTPALPVGVATQDAVFQSGAGHPIALRLYRNRASLHEAAPGTVLYFHGGGFVLGSLDSHQIVTARIAADTGLDVIAVDYRLAPEHRAPAAHDDCLEVTLAALNGRLPFDLRTGATLQLAGDSAGATLAASVAMRLRDDGVQRLRGLALVYPMLGTEPQLPAREAEAHAPMLKLADVHAFRDLYWGAHPPYPTWTIPLEATRFDGLPPVLAVAAEHDPLRDDARVFAERISAAGGEARLWIGAGLVHGCWRALESSPGVQRLHAEVCRFLSARAVPASAAG

SEQ ID NO: 25972 - protein, 389 aa, Escherichia coli
  misc_feature (185)..(195): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIXXXXXXXXXXXVRAAIEYAIANDRDSVTLVHKGNIMKFTKGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25973 - protein, 389 aa, Escherichia coli
  misc_feature (180)..(180): Xaa can be any naturally occurring amino acid
  misc_feature (185)..(201): Xaa can be any naturally occurring amino acid
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIXXXXXXXXXXXXXXXXXYAIANDRDSVTLVPKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25974 - protein, 521 aa, Coprinopsis cinerea okayama7#130
MSGEDSSATTMAVDAVTTTETPASTTTTTAAAAPSETATTTNPEKPIEDGEALAKMEKARQQVEFYFADSNLPYDKFMWTLHTKDPEHWIPLSTIASFKRMREYTALGAEFVLNALRPSTFLELDESGREGAELAGVRVRRKTEVREVKDAFERSVYAKGFPEEDPTLQKRLEEFFATFGKVNSVRMRRDEHKKFKTSVFAEFADFETVDKFLKADPKPTFEGKELLIMSKHDYCEMKIKEKGLTGKAANHRREMLAKGRGFDAFRESSTSSPSSSSKDEPKEILLEYIGNRIPIKKDSEGNGYVEESSIPFVRGATLRFDGCAGDCTWSDIKDPIKTLFDGKPPYIKFTRGDDFGLVGFHKALSEEEVEKVKEAVRKVNGREVRWSVPGEEEEKAFQVERAQVAARGAMAQITGGGKKAGSGGRGGGRGGGRGGRGGRGGRGGGRGGARDNGRKENGKEASGGAKEEKGKAEGGDVEVGEKRKRAVEPDGGPYTGVRGTNAPPAVVASSESAAKKAKTDA

SEQ ID NO: 25975 - protein, 1080 aa, Triticum aestivum
MDGDADALKSGRHGAGDVCQICADGLGTTLDGDVFTACDVCRFPVCRPCYEHERKEGTQACLQCKTKYKRHRGSPAIRGEEGDDTDADDGSDFNYPASGTEDQKQKIADRMRSWRMNTGGSGNVGHPKYDSGEIGLSKYDSGEIPRGYVPSVTNSQMSGEIPGASPDHHMMSPTGNISRRAPFPYVNHSPNPSREFSGSIGNVAWKERVDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEFYFCQKIDYLKDKVQPSFVKDRRAMKREYEEFKIRINALVSKALKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTAIYGYEPPIKAKKPGFLASLCGGKKKASKSKKRSSDKKKSNKHVDSSVPVFNLEDIEEGVEGAGFDDEKSVLMSQMSLEKRFGQSAAFVASTLMEYGGVPQSSTPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 25976 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYPIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 25977 - protein, 174 aa, Corynebacterium diphtheriae NCTC 13129
MQQQETFRHILSVLVQDVDGIISRVSAMFTRRSFSLVSFVSGKTEMHGINRITIVVDASTQDIEQITKQLNKLIPVLKVVRLDEDVTVARALMLVKVSADASNRPQVVDAAKIFRAHVVDVAPDSVVIEATGNKGKLRALLDVLEPFGIRELISSGQIALNRGSKTMAPQSSRS

SEQ ID NO: 25978 - protein, 251 aa, Prochlorococcus marinus str. MIT 9313
MLNNLRADFAIIRERDPAARGLVEILLCYPGVHALMMHRLSHRIWSTRLPLIPMKLLARLISHFSRSLTGVEIHPGAKIGNGVFIDHGMGVVIGETAEVGDRCLLYQGVTLGGTGKDHGKRHPTLASNVVVGAGAKVLGALHIGSNTRIGAGSVVVSDVEANSTVVGIPGRVIHQSGARIEPLAHSALPDAEANVIRNLMGRIDLLEANMETMRRKMQAIKDGNSYNEELFGESQNLKDKEIIEYIGDKKI

SEQ ID NO: 25979 - protein, 535 aa, Bordetella parapertussis 12822
MPIIESRIDTRSQDYADNARAMQAQLDDLNQKLARTAQGGSETARAKHVGRGKLLPRERVEQLVDPGSPFLELSPMAAHGMYGDEAPGAGMITGVGRIAGTECVIVCNDATVKGGTYYPMTVKKHLRAQEIAAQNRLPCVYLVDSGGANLPRQDEVFPDRDHFGRIFYNQAVMSSQGIAQIAVVMGSCTAGGAYVPAMCDESIIVRDQGTIFLGGPPLVKAATGEEVSAEDLGGGDVHTRLSGVVDHLAANDMHALQLARNAVARLNRAKPAALALAPVREPRYDASELNGIIPADTRKPYDVREVIARIVDGSEFDEFKARYGTTLVTGFAHIHGMPVGIVANNGILFSESAQKGAHFIELCAQRKIPLVFLQNITGFMVGRKYENEGIARHGAKMVTAVATAAVPKFTILIGGSFGAGNYGMCGRAYSPRMLFMWPNARISVMGGEQAASVLATVKRDGIEARGAQWSGAEEDAFKQPIREQYEREGHPYYATARLWDDGIIAPADTRRVLGLALSAALNAPIEDTRFGVFRM

SEQ ID NO: 25980 - protein, 408 aa, Thiobacillus denitrificans ATCC 25259
MAGGEGSRLQPLTADRCKPAVPFGSRYRIVDFVLSNLTNSDIRSIYVLVQYRPQSLIEHVRKAWTVTSLFADQFLTVVPPQMTKTSTVFGGTADAVYQSLDLMNMHRPDLVAIFGADHIYRMDVRQMVRFHCEHDAEATVAALPVSLNQASSFGIIETDAQNRIIGFDEKPKAAKPMPDDPDHAYASMGNYLFNADVLREALEEAHRRGETDFGRHVLPRLAQSHGVYAYNFATNEVPGTKRYEEQAYWRDVGTLDTYFDAHLDVLGLEPRFDAFNPQWPIYSSHYQGPTARVLRAELDNVLLGAATIVTGAKIRNSILRREVVVEPGAEIEDSVIMDYVCIGAGAKLRRVIIDRHNVVPPGARIGYDHDADRAAGYHVTEGGVVVAPLGDVRFYAREASRHSGGYSE

SEQ ID NO: 25981 - protein, 232 aa, Zea mays
MSEAAVRVIGLWPSPFVIRVLIALKLKGVEFEFVEEVVGRKSELLLRSNPVHKKIPVLLHHGKPISESLIVVQYIDEVWSSGAPAFLPVDAHARAVQRFWAQYVDDKLPWAIRILKGTDDGGMEQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 25982 - protein, 431 aa, Rhodospirillum rubrum ATCC 11170
MATEIIVPQLGESVSEATVAKWFKKVGDAVAADEPLVELETDKVTVEVPAPAAGTLSEIIAAEGAEVAVGAVLALLAGAGEGAAPAKPAAAPAEKKAEPEKKPEAEKKAGPEKKAEPVAAAAPKAASAPLDYPLPPAVRKLVDDNALDPARIPATGKDGRLTRDDVVAFLKAGAPAGAPASAPAPASAPAAGPAREAGPREEKVKMTRLRRRIAERLKEAQNTAAILTTFNEVDMTNLMALRNQYKESFEKKHGVKLGFMSFFVKACVKALQEMPAVNSEISGDSLIYKNYYDIGVAVGGAQGLVVPVVRDCDAKSFATIEADIAGYGKKARDGSLTMEEMAGGTFTVSNGGVYGSLMSTPIINPPQSAILGMHKTMMRPMVMPDGSIAARPMMYLALSYDHRIVDGKEAVTFLVRVKECIEDPARLLLDA

SEQ ID NO: 25983 - protein, 466 aa, Rhodospirillum rubrum ATCC 11170
MSDFDVVVIGGGPGGYVCAIRAAQLGLRVACVEKRPTLGGTCLNVGCIPSKALLQSSHLFDEANHGFAAHGITVGTLGLDMKTMMARKDEVVEANTKGIVFLFKKNKVTHVVGSARIAGAGQVVVSGEGGEQTLTTRAIVIATGSEVTPLPGVTIDEERIVSSTGALALAKVPKSLVVIGAGVIGLELGSVWRRLGAEVTVVEYLDHILPPMDGEVRKQSQRILEKQGLRFKLGRKVTAAERKGEGVSLTVEPAKGGEAETLEAETVLVAVGRRPFTDGLGLEEVGVEKTDRGFVKVDGDFQTAIEGIFAIGDVIGGMMLAHKAEDEGMALAEMLAGESAHVNYGAIPSVVYTWPEIAGVGKTEEMLKKDGVAYKVGKFPFTANARAKANGDTDGFVKILSNAETGRVLGCHIIGAQAGDLIMEVVLGMEFGASSEDIARTCHAHPQLGEAVKEAALAVNKRTIHM

SEQ ID NO: 25984 - protein, 479 aa, Bradyrhizobium sp. BTAi1
MSFVQKHQLWSAEQTEAALRMRRIAEEQGLKTIRFSFPDQHGILRGKALAVDAALSSLEDGCSITTTLLAKDTSHRTVFPVFTAGGGFGMSEMQGGSDALMVADPTTFRVLPWAPGTGWVLCDLYFANGAPVPFATRNLYRSALAALDQRGYQFKAGLEVECHIFKVEDPRLAPGDAGSPGQPGVPPTVSLLTQGYQYLTEQRFDQMQPALETIRANLTALGLPLRSIELEYGPSQCEFVLQPGIGMEPADTMVLFRSAVKQIAQRHGYHATFMCRPRIPNVMSSGWHLHQSLVARDGSNAFMTSETDGLSALGRHYMAGLLAHARAAAVFSTPTINGYRRYRAYSLAPDRAIWGRDNRGVMIRVLGGPGDRATRLENRIGEPAANPYLYMASQIAAGLDGVDRKLDPGPSADVPYETKASLLPKSLHEAVDALKADAFFRNAFGATFIDYYTFIKTAEIDRFNAEVSDWEQREYFEMF

SEQ ID NO: 25985 - protein, 339 aa, Corynebacterium diphtheriae NCTC 13129
MKLAVIGGDGIGPEVTAEALKVLNAVRDDIEVTDYDLGARRYLRNGELLADADLVSLREHDAILLGAIGAPGEVPPGVLERGLLLKMRFALDHHVNLRPSKLYPTATSPLANPGDIDFVVVREGTEGLYCGNGGTLREGTPHEIASEVSQNTRYGVERVVRDAFERAQNRKKHLTLVHKTNVLVNAGGLWQRTVNEIATEYPEVTVDYNHIDAATIYMVTDPSRYDVIVTDNLFGDILTDLAGAVTGGIGLAASGNIDATGVNPSMFEPVHGSAPDIAGQGIADPTAAILSAAMLLRHVGDESNAQRIEAAVTYDVAERPAGPVKTVEVGDRIVAALQR

SEQ ID NO: 25986 - protein, 591 aa, Idiomarina loihiensis L2TR
MADQIELKVPDVGGEEVEVIEILVSEGDTVEQEDGIVTVESDKASMDIPASSGGKITELKVKVGDTISEGDVLAMIEASGGADESDESDSEEEAEDKTDDKADEEATKDKAEESEDKQEEEKDEDSEPEKKSSGGGSKVIDVEVPDIGDEEDVEIIEILVSKGDSVSAEDGLITLETDKATMDVPCPEDGEIEEMLVKVGDKVSQGSVIAKLKVSGGADDSEAEEKDSAKEEKSESNKESDKDSGKKSEDKDQKKDSGSSVKPSSERQPPVPDHPSQRSDRKEGILHASPAVRRVAREFGVDLSQVKGSGPKDRILKEDVQEFVKYELSRPKAVAGATGQGGGGLQVIDPPKVDFSKFGEVEEVQLSRIQRKSGPNLHRNWVTIPHVTQFDEADITELENFRKSENEVAKKKDLGFKITPLVFILKACAKGLREFPTFNSSLSESGESLYMKKYVNIGVAVDTPNGLVVPVIRDVDKKGIYELSEELVEISSKARDGKLKATDMQGGCFSISSLGGIGGTAFTPIVNAPDVAILGVSRNEMKPKWNGKEFEPRLTLPLSLSYDHRVIDGAEAARFTAYLSGVLGDIRKLVL

SEQ ID NO: 25987 - protein, 475 aa, Idiomarina loihiensis L2TR
MSDKITTQVVVLGSGPGGYSAAFRAADLGLDVVLIERYSTLGGVCLNVGCIPSKALLHMTKHIEEAQHLAEEGIEFGEPKIDLDKLRKHKEKVVGQLTGGLGQMSKMRKVKVVNGYGKFTGSNTIKVEGDDGETEVKFDNAIIAAGSQAIKLPFIPHDDDRVWDSTDALELKEIPKKMLLLGGGIIALEMGQVYASLGSKVDVVEMTDQLVPPADADIIKNFNKQIKGRFENIMLNTKATNVEAKKDGVYVTFEGDKAPKDPVKYDAVLVAVGRAPNGNKIDADKAGVNVDDRGFIKVDSQMRTNVDHIFAIGDVVGQPMLAHKAVHESHVAAEVISGKKHFFEPKVIPSIMYTNPEVAWAGVTEKEAKEQGIEYDAVTFPWSASGRAIASNAQQGMTKLIFDKNNRIIGGSMCGTNAGELLGEVCLAIEMGCDAEDIALTVHAHPTLHESVGLAAEIQEGAITDMPNPKAKKKK

SEQ ID NO: 25988 - protein, 407 aa, Thiobacillus denitrificans ATCC 25259
MSQASLKKKALDYHRLPRPGKLEVVSSKPCATQADLSLAYTPGVAQPVLEIAKNPAKAYDYTNKGNLVAVITDGTAILGLGDRGALAAKPVMEGKAVLFKQFADIDVYDIEVNARTPQDFIKVVEAIAPTFGGINLEDIAAPHCFEIEAALKKKLDIPVFHDDQHGTAVIICAGLINALHVQGKTLDSAKIVCLGAGAAGIASMKLLLAMGARKSNILLVDSKGVVHKGRTDLNAFKKGFARATKLRTLEDAMNGADVFVGVSGADLVSPAMVKSMADNPVVFALANPNPEISPAKAMAARSDLVMATGRSDYPNQVNNVLGFPFIFRGALDARAREITQDMLIAAVNALAELAREPVPAAVLKAYQLKKLKFGPDYILPKPFDPRLAERVPQAVAKAARKAVRKRR

SEQ ID NO: 25989 - protein, 479 aa, unidentified eubacterium SCB49
MKQFDQFINGKFVKSTSTEVTEILNPCTEEVLSTIPYGSVKDANDALEAAQNAQHSWKSLPAIQRAGYLNKMATVIRENRVFLAKTLAAEQAKVMGLAQVEIDVTADYFDYYAGFARRIEGEIIQSDRAKEHIFLHKSPIGVAVGILPWNFPFFVMARKVAASLITGNTCVIKPSCIAPNTILEWLELIQKIELPSGVLNVVCGSGPIVGNALCKSPTTGIISLTGSVFAGQQVMEAASQNITKVSLELGGKAPAIVCADANLELAVKAVVDSRIIFSGQVCNCAERVYVEESIHDQFLEMVTAKMKAIKVEDAFSDNNPDMSALVSKAQLDKVSEMVEFAKKEGAEIVLGGSRSSQFDKGYFYQPTLVSNVKQDMQIMQEEVFGPVLPVMKFSTLDEAIALANDSEYGLTSSIFSENFNKVMHAAEELQYGETYINREHFEAIQGFHAGWKKSGLGGADGKHGMEEYLQTKVVYAQYR

SEQ ID NO: 25990 - protein, 115 aa, Triticum aestivum
  misc_feature (9)..(9): Xaa can be any naturally occurring amino acid
  misc_feature (11)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (23)..(23): Xaa can be any naturally occurring amino acid
  misc_feature (33)..(33): Xaa can be any naturally occurring amino acid
  misc_feature (41)..(43): Xaa can be any naturally occurring amino acid
  misc_feature (47)..(47): Xaa can be any naturally occurring amino acid
  misc_feature (54)..(54): Xaa can be any naturally occurring amino acid
  misc_feature (61)..(62): Xaa can be any naturally occurring amino acid
  misc_feature (64)..(64): Xaa can be any naturally occurring amino acid
  misc_feature (68)..(69): Xaa can be any naturally occurring amino acid
  misc_feature (72)..(72): Xaa can be any naturally occurring amino acid
  misc_feature (76)..(76): Xaa can be any naturally occurring amino acid
  misc_feature (79)..(79): Xaa can be any naturally occurring amino acid
  misc_feature (82)..(84): Xaa can be any naturally occurring amino acid
  misc_feature (86)..(86): Xaa can be any naturally occurring amino acid
  misc_feature (89)..(89): Xaa can be any naturally occurring amino acid
MAALGSKLXQXXAKGXEXTRXEXRKGCAYHKTXMEKNKQFXXXPPTXEKCQELXKELFYTXXAXLPGXXEEXWKEXEQXKQXXXRXRKXLNGGGGQGWPRPGGLGGGEPRGSTHG

SEQ ID NO: 25991 - protein, 284 aa, Triticum aestivum
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMRDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 25992 - protein, 289 aa, Clostridium perfringens SM101
MRINRNDLCWCNSGKKYKKCHMEFDERIENLAREGFEVPTRDIIKNEEQIEGIRKSAEINNAVLDLVAEKIKAGMSTEEINKIVHDYTVSRGAIPAPLNYGGFPKSVCTSINDEVCHGIPDENIILKEGDIINVDVSTIYNGYYSDASRMFIIGEASENAKRLVKVAKECLEKGIEAVKPWGFLGDIGAAIQEHAEKNGYSVVRDFGGHGVGLKFHEDPFVYHYGDAGEGMVLVPGMIFTIEPMINEGKYDVFVDAENDWTALTMDGSLSAQWEHTILVTEDGIEIIAK

SEQ ID NO: 25993 - protein, 809 aa, Cryptococcus neoformans var. neoformans B-3501A
MHPAPADAHAQRPPKKIGPDTSIKDTWAKLAAAIREIQNHNASRLSFEEHYRYAYNLVLFKHGDQLYSGVKTLVVEHLDRLAHDRIVPAFPRSGGTRGAGKLGGGAEAIERATEGDRFLKAVKGVWEDHTGSMRKLKDVLKYMASLDKVHAPTAGVPPVYELGLSLFLTHIIRQPTIHTHLISTLLSQVQLEREGFTITRSTVRECIDILLRLRVPEREGGGNVYQQDFEPEFLRRSGEWYEYEAGEELVHGDASLYLSNVSRRLAEEHDRTIHYLSPSTLPHLESLLISSLLTPHLVTVLNMPGSGLVQMVDKDRYGDLKRLYELFGKVPGDQGVAALKHAVAADIDLRGKAVNAGTADVDPNTANPKPTPPLTLALQWVHSILLLFDKYTLILASSFSSSLALQSTINSSFQTVINAHPRAPEFLSLYIDETLKKGKGAKGVGIAGAGKGVTEEEMEEAKEKTIRIFRFLTDKDKFERYYKNHLARRLLSGKSVGGDAEQEMVGRLKKEVGFQFTHRLEGMFTDMRLSDEAANIFGNDPRYNDIPFTLHVSVLTSSNWPPSTLLSLPLTFPAPLLPALEHYQTFYDSRHSGRRLTWQGLLGSADLKVRTRKGQWEVNLSTIGMVVLLAFSDLKPGDVLSYHELKAQTSLPDAELARTLQSLACGKHRLLVKHPKGREVEQGDTFEFNEAFSSPLARIKILQISSSASSAASTSASSARGVGVENAQEREETERQIEEERKHQVEACIVRIMKDRKTMRHNDLVSEVAHQLAKRFMASVPMIKKRIEGLIDREYLERTEDMGSYRYLA

SEQ ID NO: 25994 - protein, 215 aa, Aspergillus nidulans FGSC A4
MAKETRFYPYTSNGGATLGVSGPDFAILAGDTRSTAGYNINTRYEPKVFTIQDARDRSIVISVIGFAADGRALKERLDAIVAMYKYQHGKNIGLRACAQRVSTMLYEKRFFPYQLQTMVAGIDADGQGAIYYYDPAGCIEKRSHCAAGEASSLMLPFLDSQAPRLQPLSLQTAQQLVRDAYTGATERHIEVGDHLQMLVVTREGVSEQLVDLKKD

SEQ ID NO: 25995 - protein, 170 aa, Bacillus cereus ATCC 10987
MIYPYKEKNPKIASSAFIADYVTITGDVSVGEESSIWFNTVIRGDVSPTIIGDRVNVQDQCTLHQSPQYPLILEDDVTVGHQVILHSCHIKKDALIGMGSIILDGAEIGEGAFIGAGSLVSQGKKIPPNTLAFGRPAKVVRELTEEDRKDMERIRTQYVEKGQYYKSLQK

SEQ ID NO: 25996 - protein, 318 aa, Synechococcus sp. RS9917
MVAASSGVASVLSPLKGRDFLSSADVSAEQTAALLELARQLKCGDRRIDLGNRVLGLIFTKASTRTRVSFQVAMARLGGQTVDLNPQVTQLGRGEPLEDTARVLSRFCDVLAVRTFAQQELVDYAHWATIPVVNALTDLEHPCQALADFLTLQEAFGDLQGQTLAYVGDGNNVAHSLMLCGALLGVNVRIGCPDGFEPLPGVLDQARELAVAGAEISVTSDPIAAVRGAQALYTDVWASMGQEQEQAERERAFQGFCLNEALLAEADPRAIVLHCLPAHRGEEISAGAMEGAASRIFDQAENRLHAQQALLACLMGGL

SEQ ID NO: 25997 - protein, 517 aa, Triticum aestivum
  misc_feature (240)..(240): Xaa can be any naturally occurring amino acid
MDKAYIAVLTIAFLFLLHYISGKISNGRRGKGAVQLPPSPPVIPFLGHLHLVEKPFHAALRRLAARLGPVFSLRLGSRRAVVVSSAECARECFTEHDVTFANRPRFPSQLLVSFDGAALATSSYGPHWRNLRRVAAVQLLSAHRVACMSGVIAGEVRAMARRLFRAAAAAPGDAARVQLKRRLFELSLSVLMETIAQTKGTRSEADADTDMSVEAQEFKKVVDEIIPYLGAANTWDYLPXVLRWFDVFGVRNKILAAVSRRDAFLHRLIDNERRRLDHAGTEGDKKSMIAVLLNLQKTEPEVYTDTMITALCANLFGAGTETTSTTTEWAMSLLLNHPAALRKAQAEIDAAVGTSRLVTADDVPRLAYLQCIVSETLRLYPAAPMLLPHQSSADCKVGGYNVPSGTMLMVNAYAIHRDPAVWERPLEFVPERFENGKAEGRFMIPFGMGRRRCPGETLALRTIGMVLATLVQCFDWERVDGAEVDMTEGGGLTIPKVVPLEAVCRPRPAMRDVLQSL

SEQ ID NO: 25998 - protein, 129 aa, Triticum aestivum
  misc_feature (38)..(38): Xaa can be any naturally occurring amino acid
MQGYRNIMDNCQDNAMVLKEGLERTGRFNIVSKDQGVXPLVAFSLKDSSRHDEFEISEFLRRFGWIVPAYTMPPDAQHVTVLRVVIREDFSRTFAERLVIDIEKVLHELDALPSRSSGPRPAAPQRRHG

SEQ ID NO: 25999 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMKGAKLL

SEQ ID NO: 26000 - protein, 876 aa, Coprinopsis cinerea okayama7#130
MANIQYLGIPNDVHDNRVYELIMRQEPKQARMCGVGGKADRRPIDPPPIVQLRVIDPAANERRRRNEANGSPAPNADDDSLDNSYAQSFLQNPYYFMFASLAKPDDDAELHWLKDGRTRCTTGSVVSSLYHLKDPQNNNEDAGFFVFPDLSVRTEGSYRLKLSLFEVVGNNVRHCKSIYSAPFYVYTAKKFPGMEESTPLSCSLADQGIKIRIRKDIRVRKRPNQGYDLPLPLPMDEQQDDEEDDQIIRREPKRTRTDDGSLDNARTNGTVSSALAPLGQQPQQPQQQSWPPPTGQDPALGPSIPPPPNATMSSTLTVGDVPGSGTMNMTSSPSIPGPPATYDSRAPAQYPPYDQTSQPMQQTQPQQPYRDPNQPSAAPQQPPPQHMPPPPPAVQHQPQPQPPQQPQPQQQVYQQPPAQHMPPPPGHVHAQPPPPPHGHMAPAPPPPPQGYAPYPQTWGAPPPPQQPVYDGYYHHQQHAPPVPQHHYAAHPNAYAQPPPPPAHVTPRYDYYQQQHPPMPAQYGYYDQSGQMHHQQLPPQQQQPAPQYAVPPHHQGVPPHHQPPPPHPQYVQPPPVGTAPQQPVPGQTAAPALPPPATGSPNVAPPPIAQQTQQHQQPPQQPPPQQQAQPPAVTPNYDYSSSYRPATGSPQPRPPYAPPHPQQTQPPPPPPYTPYTAPPPPHMQQRMNPYPPPPAPYYYGTPQQPPPATANVNGDWSTNGYTQQQPPASAWPDYSQPQPPMQPQHQPPHIQQPNPIQPQPSLPPPVPQTPTSSSSSLMGATNGDRIQLAPLRSGSSGHASSASGPPSTGAGSPQQQQNGYVMSPVRSNSRDGYGPSVTPPSRERDDRSGGRESSRESDGRKKNPLAINSIISDDHTR

SEQ ID NO: 26001 - protein, 439 aa, Brassica rapa
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 26002 - protein, 205 aa, Candida albicans SC5314
MSSEKEYKPVTVDKPIPNTYDLGNLATFDPNPLDNEKLLSKDESIKEDHLQSVTRDNVQLLINQILSLPVKTTTETHGSSTGQNSTMTLIQLPEPTTILPREKPIPKAKPLTKWQQFAARKGIKPKAKDGKMVYDEDTGEWVPKWGYKGKNKSIDDQWLVEVDDKVKNTEDELIDPRTLKRAERKKLIKKNELQHKRNLRNQGAV

SEQ ID NO: 26003 - protein, 966 aa, Zea mays
MDLSRFASGVGPSRVAPRAGLQIGAAENGFRACSLRRARHRGGGNGNLTAAASTLRGRGGLFYLAPTRRSHPSLRLFYLLPTRGSHLSLRARWRPRCQGNDSLAYVDGPLETAKGSGEVDDNVPTSSGSDDDRGLADVDGLREMLQRSRNELEVARVNSTMFEEKAQRISESAIAFKDRADGAQRDVCAAVATVQEIISKEADAKEAVQKATMALSMAEARLQLAAEALEANRGSVGPTEVSIEGMEQEALLSAQEEIKDCRAALSRCAEELSRVQDKKMELQKEVDRLTDLAGKAQMDASNAEEDVANIMVLAEQAVALEMEASQRVNDAEMVLLKAEKAIASIDTVVELPSPAEEQRSTEEDSVSEGYEYSSDVTDDVYVRDEVSSIERLMVGDLTVQGFEQLEPSREIYDEESSNKMSVEPQKEAESDSDKSKQGKKQEMERKEHTKEPLSAPKALVKRSSRFFSASFFSSKVDGEFTPTSVFRGLMKSVQKQAPKLVVGILLLGAGAFFLNRAEKSQLFQQQGIATSIGKVTSTTKPIVLEIRRIPQRVKKLIELLPHQEVNEEEASLFDILYLLLASVIFVPLFQKIPGGSPVLGYLAAGVLIGPYGLSIIRNVHETKAIAEFGVVFLLFNIGLELSVERLSSMKKYVFGLGSAQVLATTAAVGVIAHCFAALPGPAAIVVGSGLALSSTAVVLQVLQERGESTSRHGRATFSVLLFQVGFQAIAEAMGMAAVKAVAAITAIIAGGRLLLRPIYKQIAENQNAEIFSANTLLVIFGTSLLTARAGLSMALGAFLAGLLLAETEFSLQVESDIAPYRGLLLGLFFMTVGMSIDPKLLLSNFPAISVILSLLIIGKTLLVTFVGRVFGVSAIAAIRVGLLLAPGGEFAFVAFGEAVNQVSSTLDLLLMYTIVDHRNIYNCFVGISMALTPWLAAGGQFLASKFEQHDVRSLLPVESEPSVFPV

SEQ ID NO: 26004 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVINFLREEMGVKKIRFPEHCGIGIKPCSEEGTKRLVRAAIEYPIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 26005 - protein, 284 aa, Candida albicans SC5314
MEKLLHWTIAQQSGDKAALEKIGEPDQKALNQLFGGPDEATLMKESIKVVESTDVSLEDKEIALENFEMLIENLDNANNIGNLKLWNPLIDILAKEDTPVELKVLICGIIGTAVQNNPKSQEDFNETEGLSELIELAQDDKKFELQSKALFAISSFIRNFQPGYAKFEKLQGLKLINFDNKNNKYQLRILSLISSILSNGLDDSLKAQFKEAKLPHYLASVLNEDSNTSLVDKSLNIVSQLNQLNYEFSLEEKYEINRGIQVVEGLSEKLNIDDLNNAKQATSS

SEQ ID NO: 26006 - protein, 596 aa, Physcomitrella patens subsp. patens
MAASTLAHCACHGSCVAAASDDAVVLDRFQGLRKPAFISSRRGSVSWRGATKPNLSWDGARVEVPVRATALRPGRYVKEQGGAIVPISPEDGRINFLEDEVKVRSFEELPNESRGGMWVKPSFQRKTKIVCTIGPTSNTKEMIWKLAEAGMNVARLNMSHGDHASHKKVIDLVREYNKEANANVIALMLDTKGPEVRSGDLPQPIMLKKGDPFTFTIKRGVGTDTCVSVNYDDFVNDVESGDTLLIDGGMMSLEVKSKTHEEVLCEVVDGGELKSRRHLNVRGKSATLPSITEKDWEDIKFGVENKVDFYALSFVKDAQVVHELKSFLKGKSADIHVIVKIESADSIPNLQSILDAADGAMVARGDLGAELPIEEVPLLQGEIIRSCRAMGKPVIVATNMLESMITHPTPTRAEVSDIAIAVREGADAVMLSGETAHGKYPLKAVRVMHTVAMRTEATMPEEEAPSNLGRAFKTHMSEMFAFHATLMSNTLGTSICVFTRSGFMALLLSHYRPAGTIFAFTNDKKVQSRLALYHGVRTLHINFTNDAEETFVYALSILQKKGMVQDGEEVALVQSGRQPIWRSEYTHHIQVRKVRA

SEQ ID NO: 26007 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 26008 - protein, 417 aa, Candida albicans SC5314
MSLSNKLSVKDLDVAGKRVFIRVDFNVPLDGKTITNNQRIVAALPTIKYVEEHKPKYIVLASHLGRPNGERNDKYSLAPVATELEKLLGQKVTFLNDCVGPEVTKAVENAKDGEIFLLENLRYHIEEEGSSKDKDGKKVKADPEAVKKFRQELTSLADVYINDAFGTAHRAHSSMVGLEVPQRAAGFLMSKELEYFAKALENPERPFLAILGGAKVSDKIQLIDNLLDKVDMLIVGGGMAFTFKKILNKMPIGDSLFDEAGAKNVEHLVEKAKKNNVELILPVDFVTADKFDKDAKTSSATDAEGIPDNWMGLDCGPKSVELFQQAVAKAKTIVWNGPPGVFEFEKFANGTKSLLDAAVKSAENGNIVIIGGGDTATVAKKYGVVEKLSHVSTGGGASLELLEGKDLPGVVALSNKN

SEQ ID NO: 26009 - protein, 451 aa, Synechococcus sp. CC9311
MTAPFLLVAVSLRLLLVRHGLSSFNVERRIQGRNDLSTLTATGEDQARRIGKALADVPINAAYSSPLQRAAATAAGVLSVREDGLSPVLDDGLLEIDLEPWSGLTADERAIKDPEGFTTWRQRPEALELTRADGTHYQPVTELMVQARAFLKGLMDRHPVTSDDTVLVVGHNAILRCLILVLLGEPQGGFRRLRLDNASLSVFNLSPGPNGYQVQIECLNNIAHLEPALPAKGSKARLILVRHGETDWNRQGRFQGQIDIPLNSNGHAQAEAARSFLEGVTLDRAYSSSMSRPRETAEGILKSHSGVPLTVTDGLMEIGHGLWEGKLESEIREGWEELLQAWKEAPETVQMPEGETIQDVWERSVDCWNTIADGLKPSETALVVAHDAVNKTILCHLLGLAPKDIWSVKQGNGGVTVIDMPEDPSQPAVVSCLNLTSHLGGVLDRTAAGAL

SEQ ID NO: 26010 - protein, 279 aa, Bacillus licheniformis ATCC 14580
MVSSLKDTVTLHNGVKMPWFGLGVFKVEEGSQVVESVKAAIKNGYRSIDTAAIYQNEEGVGKGIKESGVPREELFITSKVWNSDQGYEKTLAAFDESLRKLGLDYLDLYLIHWPGKDKYKDTWRALEKLYKDGRVKAIGVSNFNVHHLESLLEDAEIKPMVNQVEFHPRLTQTELRDYCKKQGIQVEAWSPLMQGKLLDDQVLTDIAKKYNKSVAQVILRWDLQNEVVTIPKSIKEHRIIENADIFDFELSAEDVEKINALNKDERVGPDPDTMVNGFE

SEQ ID NO: 26011 - protein, 126 aa, Azoarcus sp. BH72
MPTIEITEDNFNDVLEQNPIVFLDFWATWCGPCRSFGPVFEAAAEAHPDIVFGKIDTDAQQGLANSFNIRSVPTLAAVRDNIMVFRESGALPASALQQVIDGVRSLDMDEIRADIAAQQAEGKTAG

SEQ ID NO: 26012 - protein, 410 aa, Oryza sativa
  misc_feature (294)..(294): Xaa can be any naturally occurring amino acid
MGRKRAVLVGINYAGTEGELKGCLNDVARMRRCLVDRFGFDEADIRVLADADPSTPQPTGANIRLELERLVGDARPGDTLFFHYSGHGLQLPIETGGDDDDIGYDECIVPCDMNLIKDQDFTELVQKVPDGCLFTMVSDSCHSGGLIDKTKEQIGSSTKQSKIQQRERELRRQQAPSPGTCSCASLLQIALRHLPRRGGQRIIGSRSRDGVGEDQPPRSQAELLAADATRASIKNRSLPLSTFVEMLRERTGKDDVGVGSIRTTLFHHFGDDASPKIRRLVNAMLGRRHGSATXASEEHPDKAKPERVDGEGEAAAAKQGAPETRPLPRNGVLISGCQTDETSADATTPEGVSYGALSDAIQSVLAEERRGKVTNMELVRRARELLAKQGYTQQPGLYCRDKHANVAFIC

SEQ ID NO: 26013 - protein, 309 aa, Kluyveromyces lactis NRRL Y-1140
MSGWNTIESDAGVFTRLITDLGVEGLQFEDIPYLQYLEEESVSSLLKGVVFLFPYEVSLYQGSEPVQGTYETDSDKLFFSQQTIQNACATQAVINILFNLAKEDEESVTLGPELSQFYEFVKDFHQAELIGETINNSELIRNVHNSFTPPNLFVMDEDPYRNRGKPEEVFHFVGFIPYRSRIYELDGLRPYPIDHGPFTDFAKDVQNILQERMNILVQLGVHKFNIIGVIKDKLEFLQNQLQKEDINDSEEFILAEQLQEELNKREKWNEEITFRRHNLTGLVLELAKQTCSSMSQQEFQDALVHASDK

SEQ ID NO: 26014 - protein, 395 aa, Acidobacteria bacterium Ellin345
MLHKNRLYTPGPTQLLPSAQFAMAAATMHHRTADFRDLYVRTLADLKSFIGTQNDVILMACSGSGAMEASVSNLTSPGDKVLVLTAGKFGERWSSLAKAYGVKTEVVSAPYGETWTLDAVKEKLDGVSVVYMQGTETSTGVRHDVEGVAKLLKGTDTLLVVDAITGLGTTHFDVDGWGVDVIIGGSQKAVMIPPGLAFLSVSERAWKKMDATKNPRFYFDLRKERKSAAKGESAYTPATSLIAGLGAALDFIRGMGNGNLSDGRHALVENAETAAAMTRAAAEALGLTMFAKHSPAAAVSAINAPAGVDSGAIVKGFRNQFGAVVANGQGDEMKGKIFRVAHLGYYDYLDTIAIVGALEHVLASISKPAHVEFGPGLRAAQFVYAQRATFAAATV

SEQ ID NO: 26015 - protein, 474 aa, Rhodospirillum rubrum ATCC 11170
MAKNNLGTITQVTGAVVDVKFEGELPSILSALETDNHGNRLVLEVAQHLGESVVRTIAMDSTEGLVRGQQVTSTGGPITVPVGPQVLGRIMNVIGEPVDERGPVVTAQRYPIHRQAPTFAEQATETEILVTGIKVIDLIAPYTKGGKVGLFGGAGVGKTVLIQELINNVAKGHGGYSVFAGVGERTREGNDLYHEMIDAGIIDLEGDKSKVALVYGQMNEPPGARARVALAGLTQAEYFRDEEGQDVLFFVDNIFRFTQAGSEVSALLGRIPSAVGYQPTLATDMGALQERITSTKKGSITSVQAIYVPADDLTDPAPAASFAHLDATTTLNRSIAELGIYPAVDPLDSTSRALDPLVVGEEHYKVAREVQRVLQTYKSLQDIIAILGMDELSEEDRLVVARARKIQRFLSQPFHVAEVFTGSPGKLVSLEDTIKGFKGLVEGEYDHLPEQAFYMVGNMAEAIEKAKKMAAEAA

SEQ ID NO: 26016 - protein, 473 aa, Lactobacillus plantarum WCFS1
MNQPAVHPNKPIADVSSKPKTSTIANSLPNLPLKTIFAITFGFCGVNMAFSLQSSQMSRIFQTIGADPTKLGLFFILPPLAGLFVQPLVGKYSDRTWTRFGRRMPYLLFSAPLAALVMVLLPNAGSFGFGYASTAALLFGAIAILFMDLSSNVCMQPFRMIIGDMVNENQKDKAWSWQQAFSNLGGVLATILPFVLTYFGVANTAQKGVVPLSVRIAFYIGAIILLGISAYTIHTVKEYDPDTYALYHHINPEQHKHTKPIWQLVKEAPKAFWEVALVQLFAWIGIQYMWTYTTGAIAENVWHTTNAASAGYQAAGNWYGILTFIQSMAAVLYGFLVLSRTNPYKRKFWYRFGLASFAVGLVWVFFIHNQYLLIAPFCLIGIGFFTVHVEPFNIFTSSLDGANEGSYIGIFNGTICLPQILASVASFMVFKFVGNSMPGMMLIAGISMFIAVLAISIIKQDNPQEDLSENPTK

SEQ ID NO: 26017 - protein, 172 aa, Synechococcus sp. CC9311
MDLHHYVQDIPDFPKPGILFRDISPMLRDPVGWAEVMDRLGVLCDSLKPDLIVGIEARGFIVGMGLATHKKLGFVPVRKPGKLPGKVYGIDYALEYGTDRLEIHADAMRGQPRILVVDDLLATGGTASATADLVKQAGGQLVGCAFIVELTELKGRGRLPGDIQVESLIHYS

SEQ ID NO: 26018 - protein, 366 aa, unidentified eubacterium SCB49
MTTSDFLPKPYVNLPENGSITCQSPSNIALVKYWGKYGEQMPQNASVSFTLSNCRTETTLTYTKKENNGSYAFEVYLDGNREVGFEPKIKKFFDRIVQYVPFIRAYSFKIDTKNTFPHSSGIASSASGMSALAVCLVAIESQLLGATNLSTAEETKNSTTQKASFLARLGSGSAARSLEGPLVVWGEHPNIKGSSNLFGVKYEGEVHENFRNYQDTILLVDKGEKQVSSTVGHDLMNDNPYAEARFKEANDNLLKLTTVFKNGNVDTFIKLVESEALQLHGMMMASKPYFILMKPNTLEIINRIWAYRNETESKVCFTLDAGANVHVLYPENEKTVIQEFIKNELSSYCKNGEYIHDVCGLGASIL

SEQ ID NO: 26019 - protein, 481 aa, Roseovarius nubinhibens ISM
MRRHRNVKIVATLGPASETYETIRALHEAGADVFRLNMSHGDHAGIREKHRIIREVERDLNSPIAILADLQGPKLRVGTFGNGPEELAQGATFRLDLDKAEGDGSRVCLPHPEIFAALQPGAHLLVNDGKIRLRVRECGADFAECEVVIGGVISDRKGVNVPDVELPLAALSEKDRKDLEFVCQLGVDWLALSFVQRPEDVTEARELANGRAAILSKIEKPSAVERFSGILAASDGIMVARGDLGVELPVQNVPPIQKRLVRACRAAAKPVIVATQMLESMIESPMPTRAEVSDVATAIYEGADAIMLSAESAAGSYPVEAVRTMDNVAREVEGDPTYTQIIEASRKAQRNTVADGIVAAAREIAETADIKVICCFTQSGTTALLTARERPRVPIMALTSLRGTARRLALSWGVNCVMTEELTRFKLAVVNAARAARAEGYAEALDQIVVTAGVPFNVPGTTNILRVAPCQESLIYSTDPG

SEQ ID NO: 26020 - protein, 775 aa, Oryza sativa Japonica Group
MARPRFEEDDEDEFFDSREVMSPASVSSPASSGRYDGPMLEVWATDPCSVHERRQRFIKSLGLSDSSPSAGGGGDRPDEEPCSRSSAAEEILPCSPTVELVSAVPSFACRGEEPGASGGGGGAEVLDCVFKNLDDGTVFVVDEMGKDGSFRSLRDRRSNRTVTAAEFERTYGSSPFICELMRRVDDSDESSAVEKALVRGRRRRRRFGWLRRLGIRGCVVDVEEDDETNSTSSSSCRSCSGKVDRVKVRHYKKRSKELSAVYRGQDIKAHEGAIVTMKFSSDGQYLATGGEDGVVRVWRVVEGERPNELDFAEDDPSCVFFTVNENSELAPVNSSEGSKSKHYKNSKVSTDPACVVIPHRTFALSQEPVHEFYGHDDAILDLSWSKNRDLLSSSMDKTVRLWQVGCNSCLKVFSHTNYVTCVQFHPTSDNYFISGCIDGLVRIWDVRRCQVVDWADTKEIITAVCYRPDGKAAVVGTITGNCRHYDASENHLELESQVALNGRKKSPLKRIIGFQYCPSDPKKLMVTSGDSQVRILDGLHVISNYKGLRSSSQVAASFTPDGDHIISASDDSSIYMWNYANQIAPVTNHVKTVWSNEHFSCHDVAIAIPWNASQTRNSISLACSITSSQQEVLDEFHNEHDSSSCSHTEDSPDGDSLYQLPSGNFTLSSAFFAESAPRGSATWPEEQLPSNSTTQSTLRKSQYKFLKASCQNAATHAWGQLGPCPCSDLGLLSPACTVTSLFFQIPPQVLPIEVIFPGSLLVLFVSRTIAQQSQK

SEQ ID NO: 26021 - protein, 823 aa, Pneumocystis carinii
MDYLKKVRLWSEEEVGEWLESNNFGDYMDIFKENNINGDILLECNAAVLKELGVKKLGDRIRLSVCIKGLREKCIESARKSKMSFLMIDNQIQGFSFTLQSPTDPLIPVKSSELASPTSNFQLDNSYSDACCFDSLNNFHSVLSNISCSTKSISRNSSISTQKVFEKSPIFLETNVMQSDSIKKNCLKFIGEKGQTRIVNISLCYTADAILSKALKKFNITENPSEWRVFITNEDGSFECISNDTLLTISRQLSRPERERLILKRKSDPLTQEEFKKSQTIAREQRDAIYHTAVMAKTSGNLRKLETFFGEKLAPTLTSSFTTPLPSPLPKDNKYGNITHIRNFFGQRPPSELINSNLAEYFPGHEKKVLEQTIKNSIKSNHLNSFKGSNFDTPSSTLTYDLSSIPAVGEERIQYEGRRLSGVSHTLSLSRFISTRFPTLLESSILRENSSHHTLSSSSKLNSEGNTQDSKPSFRKKLEEKASSDETFKSESPNMLMEPSILSDFYDASLETDRDLLDDNIFENNEAKDFNTEKEIENNNSGPTRWIKGALIGSGSFGSVFLGMNALSGELMAVKQVEIPSIDIQGCKRKRAMLDALQREISLLKELHHENIVQYLGSSMDETHLTFFLEYVPGGSVTALLNNYGAFEEPLIRNFVRQILKGLNYLHNKKIIHRDIKGANILVDNKGGIKISDFGISKKVEANLLSMTRNQRPSLQGSVYWMAPEVVKQTLYTRKADIWSLGCLIVEMFTGKHPFPKMNQLQAIFKIGQYVSPDIPEHCTSEARHFLEKIFEPDYHARPTAADLLKYSFLGPMVSSPLTDAKK

SEQ ID NO: 26022 - protein, 651 aa, Raphanus sativus
MCKRTLQHPQVETPPPQPFLISLKNTLNEIIFADDPFRKIRNESKTSKKIELGLRHVFPILEWARGYNLEYLKSDVISGITIASLAIPQGISYAQLANLPPILGLYSSFVPPMVYAVMGSSRDLAVGTVAVASLLTAAMLGKEVNAVENPKLYLHLAFTATFFAGLMQTCLGLLRLGFLVEILSHAASIGFMAGAATVVCLQQLKGLLGLSHFTHSTDVISVLGSILSQSHMWRWESGLLGCCFLFFLLTTKYISNKRPKLFWISAMAPLVSVIFGSLFVYFLHAQFHGIQIIGELKKGINPPSITHLVFTSPYVTLALKTGIITGVIALAEGIAVGRSFAMYKNYNIDGNKEMIAFGMMNILGSFSSCYLTTGPFSRSAVNYNAGCKTAVSNVVMAVAAAVTLLFLTPLFYYTSLVVLSSIIIAAMLGVIDYEAVMHLWRLDKFDFFVCLSAFFGVVFGTIEIGLILSVGMSVMRLLLFVGRPEIHVMGNIQNAEIYRNIEQYSQATTLSGLIILHIDGPIYFANSSYLRDRVGRWIDEEDERLRKRDENSLQYIILDMSAVGNIDTSGISTLEEVNKILRRRDLKLVIANPGAELMRKLSKSKFIDTIGKDWIHLTVAEAVSACDLMLHTAKPDSPEKISGGVPEFNNV

SEQ ID NO: 26023 - protein, 617 aa, Triticum aestivum
  misc_feature (579)..(579): Xaa can be any naturally occurring amino acid
  misc_feature (594)..(594): Xaa can be any naturally occurring amino acid
MAPRDSKEMLLQRAAESAIRSIGLGYDVAADVRLKFCKQRGSPDPSLIELDRDGTQDIVLPGSLTTVAGVPKSIKCDKGERMRFRSDVLSFQQMSEQFNRELSLSGKIPSGLFNNMFEFTGSWQKDAASTKSLAFDGWCITLYTVALSKAQIVLRDHVKQAVPSTWEPAALARFIQKFGTHIVVGVKMGGKDVIYLKQQHSSSLQAVDVQKRLKEMSDRRFLDANGQSDISFRDAYGKEDKSDRREQRLRFVESSPLNSYASKEDLVVLPRRRGGRDKDMISHSEWLSSVQSEPDVISMSFIPITSLLNGVPGSGFLNHAINLYLRYKPPIEELHQFLEFQLPRQWAPVYSDLPLGPQRKKQSSASLPVNFIGPTLYVCTNMVDVGKRPITGLRLFLEGKKSNKLAIHLQHLCSLPQIIQLEDDPFNNRTPEPFDRKYVEPIGSWKRFSHVCTAPVESEDASIVTGARLEVISQGFKKILFLRLHFSKVVNAHSVRQPEWEGSPNLIQKSGLISTLISTHFSTAVQKPMPRPADVNINSAVYPGGPPAPVQPPKLLKFVDTTEMVRGPQDLPGYWVVSXGAKLHLERGKISLRXVRYSLLTAMLPGRRRITRFDDEF

SEQ ID NO: 26024 - protein, 301 aa, Bacillus cereus ATCC 10987
MRRWGIELLILAVVIIWGINFTIAKYGLLEFTAIEFTALRMISAAPLMLLLTFFIEKSVYMERKDIPRLIIVSVVGIVLYQTLFMETVKYTSATNASLLISISPIFTTVFAIILKQEKFSSRKLIGSIIAFCGAALVLVAGNSLASSFYGNGIGLITSICWGLYPVLASPLIKKYSALRVTAWSALVGAIPLLLLSGPYVFIMPFHITHGITLFALLYSIFFVTVFGLVMWYVGVQKIGASHTMVYMYITPLVAVLFAAVWANEYVSFQQIIGGIIIFFGLWFVKSEKVKVHSTAGEPISK

SEQ ID NO: 26025 - protein, 280 aa, Propionibacterium freudenreichii subsp. shermanii
MIIPTTPTPTVELSGGTRMPMLGMGTWPLKGEECRAAVASAIEQGYRLVDTAEAYGNEEAVGKAVREAGPDRAEIFVTTKFSKQWHSRKGVHEALEHSLERLGLDYVDLFLMHWPMPGEGSYVDAYRGMVELKEQGLAKAIGVSNFKVHHLDDLITEGMTPEVNQIQLDPSRPRLEVRDFLDNHDIVTEAWSPLGRGADGVLNAPAVLDAAKKHGITPAAAVLAWELNQGIVTIPKSANPEHQRTNLEAIGVELSAQEMKAIDALADPNAKIDDSDKTGN

SEQ ID NO: 26026 - protein, 127 aa, Oryza sativa
MAAAASSAVLLLPNSRAPAALSRRRAPVPRRGFVVGFEGRSRRGAAGTVRACFNPPGDERILREALKEPVAFMGGVFAGLLRLDLNEDPLKEWITRTVEASGVAEDSRTDESSEGSQNDAAPQFEIE

SEQ ID NO: 26027 - protein, 538 aa, Coprinopsis cinerea okayama7#130
MSFSFLASWIQQSSNSQSYVFDTAKLFFLGTLVEAGRRFLQWLAERVRFQYSVTAHFTEGDPAYEWIVMFLTEENIWKRSRDFHINAKSSTRRWGITLGENAPGSDHVDFVPTYELPHLFRWKGLWIETKRNTGAMIQPPFGGFSPGAIVLTIYTLNVKDLQEFVEEARVRYIEHGRSSVILHSASQPNFGPGFVWSSVKRKLRRPMDSIILEEGMLDSIVQDAKDFIEMEDWYIEAGIPHRRGYLLHGPPGTGKTSTIHALAGELGLEIFSLSLSAGFVDDAFLQQASSTIPKKAIFLIEDIDCAFASREDDETNTSGGASSNGFLGLPFMPLRRSNVTLSGLLNVIDGIGSEEGVLFFATTNHINRLDPALLRPGRIDRKIEYKLTTAAQATALFSRFFPAARTTLGKESTESDKAARLQELAVRFASRIPEHKFSTAELQGYLLSCKGSPEDAVSGIDLWVQQELDDRRSRQAKESDAAQLSSTMHDHQEPQPVLAPVVSPSTSQSSVSRKTRAVLTPPSTPPLGAKEHVPFTAQ

SEQ ID NO: 26028 - protein, 259 aa, Bordetella parapertussis 12822
MISLPYLQRFALSGQVALVTGSARGLGLRIAQALAGSGAHVLLNGRDAHAVEAAVSDLCQQGLRASALPFDVSDEQATEQAFARIDAEHGRLDILVNNVGARNRKPLAETSPAEIRAMMDTNLVAGILLARLAAQHMVRQRYGRLIAITSVAGELARANDAVYPAAKQGLTGMMRALAVEFGRHGITSNAIAPGAFATETNAAMANDPQAGAAMAARNPTGRWGDPEEIAGAAVFLASPAASYVNGHVLVVDGGLSVQF

SEQ ID NO: 26029 - protein, 490 aa, Bordetella parapertussis 12822
MQDFPNILQRWYSMKQHFIDNASVPGSSGERIPVIDPSTGQEFDSIARGNAADIDLAVQAARRAYEGAWGRLSAAERGRLMLALSLKVLEHRDELTALESRDCGKPLKQARADVLAIARYFEYYGGAADKLHGETIPYQQGYTVLTLREPHGVTGHVVPWNYPLQIFGRSVGAALAAGNACVVKPAEDACLSLLRVAELAAETGFPAGALNIVTGYGHEAGDALTRHPGIDHISFTGSPRVGVLVTQTAAERHVPVTLELGGKSPQIVFADADLDALVPVAVNAIVQNAGQTCSAGSRLLVERGAYERVLERLGAAFAALRAGPAQSDLDCGPLIRKTQQERVRGFLDLARGDGIATVAQGRIVPEAPAEGYYQAPTLLRDVPVDHPLAQEEVFGPVLAAIPFDDEADAVRIANATEYGLAASVWTRDGGRQLRIARKVRSGQVFINNYGAGGGIELPFGGVKASGHGREKGFEALYGFTVLKTISIKHD

SEQ ID NO: 26030 - protein, 242 aa, Arabidopsis thaliana
MDHLQESFRGSELCILCDIEACVIYYGPDGELKTWPKEREKVEDIALRYSQLNEALRRKKSVTLYDFLNKKKDKTNLEKKAMITDNDDLKTCLKNVNVLKSPIADHYFNDQISQLIQSLEPHVSKVQERIRFVESQKHKETKLDHQSLASIYSLNQSLNPSQFTLFLYNHGDNTMSQIPNMFMNNNNFQHSFVSNTQDYSALQESVNNNYGLMPNVLCGYDQNLFTSDITNNNLLIDNSMYL

SEQ ID NO: 26031 - protein, 252 aa, Bordetella parapertussis 12822
MRLNGKTAIVTGAGSGFGEGIAATFAREGAKVVVADINEAGGQRVAAAINAAGGQAVFVRADVSDNAAVANLLAATLKAFGGLDIVVNNAGTTHRNRPMLEVEEDEFDRIYAINVKSIYLTARHMVPHFRAHGGGSFINIASTAAIRPRPGLTWYNGSKGAVVTTSKSMAAELGPDNIRVNCVNPVIGATGLLADFMGVPDTPENRKRFLATIPLGRFSTPQDIANACLYLASDEAAFITGACLEVDGGRCV

SEQ ID NO: 26032 - protein, 230 aa, Bordetella parapertussis 12822
MSNVVPTPVSPLFAQPFATRLERALQHLRIGRPVILMDDFDRENEADLIVAADKLTVPVMAQLIRDGSGIVCLCLPGETLDRLELPPMVDSNRSRYSTAFTVSIEAREGVTTGVSAVDRVTTIRAAIAPGARSGDVVSPGHVFPLRAQPGGVLTRRGHTEGSVDLAALAGLRPAGVLCELMNADGTMMRGASLERYAAKEGLVALAIDELAAHLQARGATGAPAELAVAA

SEQ ID NO: 26033 - protein, 523 aa, Rhodospirillum rubrum ATCC 11170
MTSQMPPFRRPRPVVLCILDGWGHRDDPTDNAIALANTPTWDRLMATCPHSLIATSGADVGLPAGQMGNSEVGHMNIGAGRVVMQDLPRIDAALADGSVAHFPALVRFIDALRASGGTAHLLGLLSPGGVHSHQDHIAKLARVIAAAGVPVKIHAFLDGRDTPPRSALGFLETFAAAAGPEAPIATVSGRYYAMDRDKRFDRVRLAYDVLVSGKGESAADAASAVSQFYDSKDKGDEFVLPTAIAGYDGMKDGDGVFMVNYRSDRAREITQALLDPTFDGFERQPPHFAGALAMTEYSTAHNAFMDVLFGPESLNNILGQVVSEAGMTQLRIAETEKYAHVTFFFNGGRETSFPGEERILIPSPKVATYDLQPEMSAPELTDRLVEVIDAGRFDVIIVNYANGDMVGHSGILEAAIKAVEAVDGCLGRVEEAVVRAGGTMLVTADHGNAELMRDPVTGEPHTAHTTGRVDLLLVNGPEGASLADGRLADLSPTLLALIGLPQPAEMTGKTLVAKAAVAVGASH

SEQ ID NO: 26034 - protein, 166 aa, Synechococcus sp. CC9311
MTSSVPSLRIGNGYDVHRLVPDRPLILGGQLLEHPAGLGLDGHSDADVLVHAIMDALLGALSLGDIGKYFPPSDPQWKGADSLVLLEQVVALVKARGWGVVNVDAVLIAERPKLKPHIEAMRSAIALRIGVAPDQVGVKATTNEQLGPEGREEGISCQAVALLQAL

SEQ ID NO: 26035 - protein, 183 aa, Zea mays
MDRGFHSNSMLWLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEETEDETGEPNPSNPANSNPSYSQDQSNKEQQQQHTPQHGQRVSFQLNAVAAAAAAAKRPRMTIDQLNMG

SEQ ID NO: 26036 - protein, 380 aa, Acidobacteria bacterium Ellin345
MTTNSSIHPPQRLLFGPGPTQVAPSVYAAMSQPIVSHMDPYFFQTSEAVQDMLRTVFGTKNPLTFAISGTGSGGMETAISSLVEPGTKVCVFANGFFCDRMTEMAKRNGGNVVRLEKPWGEVFTDAEAAEFIAHEKPQVVMYVQAETSTGAFQQGTGICKAAHDAGALVIADVVTSLGAMPVKVDETGIDIAYSCTQKGLSCVPGLSPITVSPRAAEYIEARKTPNRSWYFDLKLLNDYYKVSHRYHHTASATLFYALREALSLITQEGVENRWERHRRMHHAFVSGIEKLGLKMHVAPEHRIVNLNTPRVPEGVDDAKVRKLLMDEHGIEIMGGFGPLAGKVFRIGIMGPLATPEHVENFLKVFANALERSRTTAAVSN

SEQ ID NO: 26037 - protein, 352 aa, Lactobacillus plantarum WCFS1
MEAVVKTESGYDNMELKQIPIPEVTGDKVLLKVAYTGICGTDIHTFKGQYANAVTPLVLGHEFSGEVVEVGPDVKTLKPGDRVTSETTFATDGTCVYCQDKEYNLCPNRVGIGTKANGSMANYVLTREESAHILPDNVSYKMAAMSEPLASCVHAMYQKTPFTLHDTLLIMGPGPMGLLSLQIAKEIGAFVIVSGITKDADRLQIAKELGADIIVDTQKEDLAKVVMDATDGVGVTKVYDCSGATPAVNSALPLIRKGGTFQQVGLFAKPMNELDERSIIQHEITYRGSRSQNPYDWAIALHLESKGAINQDAMITKVFDLEHWRDAFDAMMAGKELKVMIASNPDDPDLAD

SEQ ID NO: 26038 - protein, 233 aa, Chlamydophila caviae GPIC
MKEDPYLEVKRHLAREAAALVTSGMLLGLGSGSTSREFIKAVAERKKQENLDIRAVASSKESYSLASSLGIPLIDDEEFINTDLAVDGADEIDPQLRMIKGGGGAIFREKILLQSSQRRLILADESKSVKVLGKFGLPVEISPFGRSSIIATLENFGYLGNLRKNPRGGFFITNNGNYIYDIHTPNVYPHPEEDLLKLLQIHGIIEAGFVIENVEVWLGYTNGQIGKKNTGGL

SEQ ID NO: 26039 - protein, 336 aa, Idiomarina loihiensis L2TR
MKTIDVVGIGNALVDQEFEVSEDFLKKHDLKKGMMELIDEYAQNTLIAELSQLGELKKQSGGGSAANSLVAFAQFGGKAYYCCKVADDEAGMFYRQDLEKIGIETSLHQQKNPGTTGRCLVMVTPDAERTMRTHLGITADLSSAEIDDHAIAAADYLYIEGYLITSEIARGAIQHAKKVARENNTKLVMTCSDPAMVKFFRSGIDEILDGGVDLMFCNREEAELLTGKDDPQAALSVLLKQADTVAITLGKDGAVIANRERQVHIPGVPVKAIDTNGAGDMFAGAMLYGLTRNMSLEDAGRLASHAAAELVTEFGPRLNKDRQQQLIERVMSAQTA

SEQ ID NO: 26040 - protein, 519 aa, Oryza sativa
EDTDRNHTRVNDDTRAGAMGLPGRRNPLLSARRAAASLRRSRRLPVYVAAVFFVASVLLMFRDEILYLTTARSPSSSLPTTGGSAGGAGLARKEELVSVNKPVLLGHGGKPEKHHSVTERHRPKVSAKRRPNKKAAKAARKKFMASPSVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVIRRPTGKTWEEYDEVGRIEAYRRVLDTWATWVNDNVDPARTSVFFMSVSPLHISPEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAGHVA

SEQ ID NO: 26041 - protein, 433 aa, Arabidopsis thaliana
MRRRRCDLQPKRTRMCDLQPKRTSMCDLPPKLVGEKIITRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 26042 - protein, 98 aa, Brassica napus
TTFNCLGLTAKVIDRTKTMADVYGAFYDFSCMLKTKVDKNDPNASNTLNRLEAVEKVCKDTGVLQKRKSYVNDEGQSNVYIVMLVILLAIVFAYLRAN

SEQ ID NO: 26043 - protein, 392 aa, Bacillus anthracis str. Ames
MKLFQPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPVCFTNPGDTILVPDPGYPDYLSGVALAKAQFETMPLIAENNFLPDYTKIDDSIAERAKLMFLNYPNNPTGATASKDFFDETIHFANKHNILVVHDFAYGAIGFDGQKPVSFLQADGAKDTGIEIYTLSKTFNMAGWRIAFAVGNESVIETINLLQDHMYVSIFGAIQDAAREALLSSQSCVIDLVNSYESRRNALISACHSIGWNVDIPTGSFFAWLPVPEGYTSEQFSDILLEKAHVAVAPGVGFGEHGEGYVRVGLLHTEDRLREAINRIDKLNFFKK

SEQ ID NO: 26044 - protein, 430 aa, Francisella tularensis subsp. holarctica
MNFISTRDKNIKVSLSEAMQSGLALDGGLFVPERFPTVNWQSFAKDISYAKFAANTLREFFKGDQLEDSLDKICNNAFTFEAPVRRLDKTTSVLELFHGPTLSFKDFGARFLANCLSSIDSEKPFTILVATSGDTGSAVAAAFHGKSNIRVIVMFPKGKISKRQEKQITCWGDNIQAVEVEVEGVFDDCQSLVKEAFKTPWWTERTKLNTSNSINIGRLLSQSTYYAYTSWQHYLQTGEKANYIVPSGNIGNITAAFWAKQMGFPIGEISMSLNANDTVVDYLETGKFNPKASVETLANAMDVGNPSNFERLLYLLGNYENFKANVKAICVSDFEIIEEIKQVYRQYHEVVCPHTATGFVAKNQLDSNKDYIIVATAHPAKFESVIEPILDIQVPPTPALQKLLDKEQNKVVINKSMDELCEVYTKAFEA

SEQ ID NO: 26045 - protein, 248 aa, Populus trichocarpa x Populus deltoides
MGSNSIVSNRWMSEKMNCLDLSPNSKSDNEEEEVHVLAVDDSFVDRKVIERLLKISSCKVTAVDSGWGALKLLGLLDDDEEDKSSSSSSSSSSSAGFEGLKVDLIITDYCMPGMTGYELLKKIKESSSFREIPVVIMSSENVMARIDRCLEEGAEEFIAKPVKLSDVKRLRDYYMATREIRSVQSSSNVNKRKLQESFDVSTSSSPPSISPSPSPSSASPPSLFSSSAPCSPSSLDSPTRRIKMTSFD

SEQ ID NO: 26046 - protein, 286 aa, Francisella tularensis subsp. holarctica
MLLWPAEWEEHSATWMIWPARIDMWPNITKAYEIYAKVANTIAKYEPVNMVVNQHQLDIAKNYLVKNITLISEVVDDSWARDIMPIFSFKADKLIANNFDFNCWSNKFSPFDNDRRLKNDIAKQQKWQVNSSKMILEGGAVHSNGQGVLLTTKECLLNLNRNPNMQKEQIESELISILGVKKILWLPYGVAGDFDTDGHVDNVACFANKNTIIIQSCYDENDENFARHQANMTYLDKYASEFNIVEIPQPRAQYFAGERLALSYLNFYIVNNAIIMPAFGDPNDVL

SEQ ID NO: 26047 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLV

SEQ ID NO: 26048 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVPAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 26049 - protein, 149 aa, Synechococcus sp. CC9311
MGFPGMNPSRCRIIAIGKVRKSWVQDGIELYRKRLPGLTIVELRDSNPEKEAESIRQTLRRDEWPVMLMEQGETLTSINFSERLRSLGSQRLAFVIGGADGLTAELKALAHWKLSLSPMTFPHELARLLLIEQLFRAQAILQGSPYHRA

SEQ ID NO: 26050 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANERDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 26051 - protein, 154 aa, Campylobacter jejuni subsp. jejuni NCTC 11168
MNIIEGKLNLDSNTKIAIINARFNHIITDRLVEGAKDAFLRHGGKEENLSLILVPGAFELPYALKKAIESKKFDAICCVGAVIRGSTPHFDYVSAETTKGIANVSLNHNIPVSFGVLTTDTIEQAIERAGSKAGNKGFEAMTTVIEMLNLSKEL

SEQ ID NO: 26052 - protein, 333 aa, Candida glabrata CBS 138
MFIPTTQKVVLIDGKSDDYDVIKYQDFAVPSIGSTDVLVKNKYAGVNFIEAYFRKGYYPCELPYVLGREASGEVVQVGSEVKDFKIGDKVAYLGGSTFAQYTKKSTENHIMNLGQSCPDEDLKLYGSSLVQCLTAISFIDEAYKVMEGDYILVYAASGGVGSILCQLISQRKAHVIAVASSAEKLAMAKENGAEFLINYAEDDILEKVMQYTNGKGVHAAFDSIGKDTFETDLAALRRKGTLVSFGNASGMVPPFAINKLSPKNLKLLRPQVYGYLGTRSEWDHYCSIFKHFVQSKSLKVDISGIYPLSEYAEVAKLLERRQTTGKVTLEIPQ

SEQ ID NO: 26053 - protein, 485 aa, Cola nitida
  misc_feature (3)..(3): Xaa can be any naturally occurring amino acid
  misc_feature (10)..(10): Xaa can be any naturally occurring amino acid
SGXSTLEKEXLGRISQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITFTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMES

SEQ ID NO: 26054 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 26055 - protein, 487 aa, Dombeya sp. Chase 273
  misc_feature (3)..(3): Xaa can be any naturally occurring amino acid
  misc_feature (9)..(9): Xaa can be any naturally occurring amino acid
GVXTLEKEXLGRISQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALAMAEYFRDVNEQDVLLFIDNIFRFVQAGSEISALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESNLK

SEQ ID NO: 26056 - protein, 381 aa, Thermus thermophilus HB8
MRLHPRTEAAKESIFPRMSGLAQRLGAVNLGQGFPSNPPPPFLLEAVRRALGRQDQYAPPAGLPALREALAEEFAVEPESVVVTSGATEALYVLLQSLVGPGDEVVVLEPFFDVYLPDAFLAGAKARLVRLDLTPEGFRLDLSALEKALTPRTRALLLNTPMNPTGLVFGERELEAIARLARAHDLFLISDEVYDELYYGERPRRLREFAPERTFTVGSAGKRLEATGYRVGWIVGPKEFMPRLAGMRQWTSFSAPTPLQAGVAEALKLARREGFYEALREGYRRRRDLLAGGLRAMGLRVYVPEGTYFLMAELPGWDAFRLVEEARVALIPASAFYLEDPPKDLFRFAFCKTEEELHLALERLGRVVNSPREAEGGAVSG

SEQ ID NO: 26057 - protein, 480 aa, Campylobacter jejuni subsp. jejuni NCTC 11168
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVVNIDNQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGIDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQIAYYLQ

SEQ ID NO: 26058 - protein, 341 aa, Roseovarius nubinhibens ISM
MKALVKSRPEPGLWMEHVPVPEPGDDEVLIKVRKSAICGTDVHIWKWDEWSAKTVPVPMVVGHEFCGEIVDTGRAAIKYKIGQRVAGEGHVVCGTCRNCRAGRGHLCRNTLGVGVNRPGSFAEYLCIPESNVVPIPDDIPDEIAAIFDPFGNAVHTALSFDLVGEDVLVTGAGPIGIMGALVAQKAGARKVVITDISPYRIALAQKLGVQHVVNAAEENLKDVMARLGMTEGFDVGLEMSGAAPAMRDMIDKMNNGGKIALLGIAPTEFAVDWNKIIFKMLNVKGIYGREMYETWYKMIALVQSGLDLTPLITHRIGIDAFEDGFAAMLSGEAGKVVMDWG

SEQ ID NO: 26059 - protein, 482 aa, Eriolaena spectabilis
TLEQRNLGRISQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALAMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESN

SEQ ID NO: 26060 - protein, 398 aa, Synechococcus sp. WH 5701
MRLDVVSLAPESFAPLTSLGVIGRAFNAGIAELHTHNPRDHASDRYRKVDDQPYGGGAGMVLKPEPLFAAFESIPVLERRRVLLLSPQGQPLRQADLQRWATDHDQLVLLCGHYEGFDERIRTLADEEVSLGDFVLTGGELAAMVLINGVVRLLPGTVGSAESLLEESHSALLLEHPHYTRPAEFRGLAVPQVLRSGDHGAIARWRAEQQQERTKRRRPDLYRRWQEQQQGRSQMRIGNGYDIHRLVPGRPLILGGLTLEHPAGLGLDGHSDADVLVHALMDALLGALSLGDIGQHFPPDDERWRGADSLVLLEQVVALVRERGWQVVNVDTVVIAERPKLRPHIAAMRVAIAQRMGLDPDQVGIKATTNETLGPTGREEGIACHAVALLEPWGGGNG

SEQ ID NO: 26061 - protein, 454 aa, Rhodospirillum rubrum ATCC 11170
MTVLPPADGGALLREEVRRFREAHPDIAYVDLLSLDLPGHFYGKRLPIAMLDDIAAGAPLKLPQNAIILGATGGVYPIGRYALEDGDPDAPRRLVAGTLAPVPWESRPTAQMLVTSSGTDHPVCFEPREVLNGVVERLRAKGLFPTVAFELEFYLLSQDRPDGLIAPPRDPLSGRADLHPAMHIERLSRFSDVLHAIIDAAQAQGIETTAMSAEVGLGQYEINFAHCADPLRAADWSALFCRATRGVAMRHGYQATFLSKPYLQSAGSGMHLHVSLCDERGANLLAPENALGLKRAVAGCLALMPASVALFSANHNAFRRSASGAVNTAAGGCWGWDDRSAGIRIPPSGPAALRLEHRVAGADANPYLALAAILAGMDYGLECALDPRPTREEAPSASVALPGDMLEALRTMDASAELRARLGDEFVTVYTTMKRQDHLAFLGMISPREYDWYL

SEQ ID NO: 26062 - protein, 424 aa, Arabidopsis thaliana; identical to SEQ ID NO: 1483

SEQ ID NO: 26063 - protein, 257 aa, Bradyrhizobium sp. BTAi1
MYLEKFKLDGKTALITGGAQGIGLACVEALAEAGAHVVIADRDAKAAADAQAAMKARGFDTATALMDVTNSAQVTQIADDLAARHGKVDILVNNAGIARSETPAETVTDEHWLNVLDVNLNGTFWCCRAFGKHMLAAKSGTIVNIGSMSGFIVNKPQEQCFYNASKAAVHHLTKSLAAEWGARGIRVNAVAPTYIETPLNAFVKNNPRMYDAWIGGTPMGRMGQVEEIASVVLFLASEAASLMTGSVVVVDGGYTCW

SEQ ID NO: 26064 - protein, 484 aa, Dais cotinifolia
  misc_feature (479)..(479): Xaa can be any naturally occurring amino acid
GVSTLEKKNLGRISQIIGPVLDVAFPPGKMPNIYNALVVKGRDTAGQQINVTCEVQQLLGNNRVRAVAMSATDGLMRGMEVIDTGTPLSVPVGGSTLGRIFNVLGEPIDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEKDLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKVTXLEMES

SEQ ID NO: 26065 - protein, 111 aa, Brassica napus
KQRYAVTDMRKLANRMAFGTPEESSLGDGLGEGYGMLGQAGSNRLRISSVPSKLKINPTIAKKLKERNYAGGATTSGLTSSLAFTPVQGIELLEKDPPPDTNTRPEKKNRK

SEQ ID NO: 26066 - protein, 315 aa, Bradyrhizobium sp. BTAi1
MILSCGDALIDFVPARLADGRDGLRPVVGGSCLNVPVGLARLGAPAGFVGGISTDLFGSMIAAHAQASGVDLSHATRSADQTTLAFVRHVGGEAQYAFYDAETAARKWTYRHGSIPFTSIDAIHVGSTTLIHDLGAAETRALIAATQGGVTISFDPNCRPNLVQDKAAYRVQMDGFAASADLIKMSDVDFDYLHGHDDYAARAEALLARGAKLVVVTRGPKGALGWHAGAGAAEVAAPAVEVVDTIGAGDSFQAGLLFALHRLGRLGKAALAELTATELRKVLAFAAACAAVTCTREGADPPRWADMTATWNDLG

SEQ ID NO: 26067 - protein, 324 aa, Synechococcus sp. WH 5701
MSPRPFPIAFARFRRLSLLVLMPLLVSGLLLLSSPAPSWAARGGRIGGGSFRSAPSMPRSYSGGGGSYRGGYGGGGYRGGYGGGIGFPFLIPIFGFGGGGLFGFLILMAIAGFLVNALRGAGGGMTSGGGSLAAAPRADGPVSIAQLQVGLLASARELQDDLRRLAATADTTGSTGLQRLLQETSLSLLRQPDLWVYANSELGQVPFASAESTFNRLSMTERSKLRSEVTSNVGGRRFQDEAAASGPTDATSDFIAVTLLVASRGRIPLKTISSADDLRDALGVIGAVSANDLIALEVIWQPEGKGEVLSTEELLTAYPQLQHL

SEQ ID NO: 26068 - protein, 123 aa, Bupleurum falcatum
RHFSEVKVPILMEFHRHIYNNSWHFSCGTKEYKILMDEFHHVSNAFLELGKGYQEAIEDITMRMGAGMAKFICKEVESIDDYDEYCHYVAGLVGLGLSKLFHASGAEDLATDALSNSMGLFLQ

SEQ ID NO: 26069 - protein, 322 aa, Synechococcus sp. RS9917
MPNPRSQSPLHPWLQRGLSILMIPLLIISVLIIQPQVSEAASGGRIGGGSFRAPSMPRSGGLNRSYGGGYSRGYGGGIGFPFIIPIFGFGGGGLFGFLILMAIVGVLVNAFRGAGSGAGSGGGNAIGSDRVNTINPGPVSLIQVQVGLLASAKALQSDLRQLAATADTSQASGLQRVLQDTTLALLRQPELWVYANAECGSVPFRAAESTFNRLSMTERSKLRQELTSNVGGVRSTTGDLAQRGDADATSEYIVVTLLVASRRPMTIKQTENGEALREALRILGSTASSDLIALEVIWQPDGSGDVLSADELVTAYPNLQHL

SEQ ID NO: 26070 - protein, 337 aa, Corynebacterium ammoniagenes
MNADSTSPAQKIILDCDPGHDDAIAMLLAHGNPNLELLAVTTVAGNQTLEKVTTNARAVARVAGITDIPFAAGASRPLVGPQLIPDEIHGDSGLDGPQLPEPSVPLEEIHAVNLIAQVISENEPGSVVIIPTGSLTNIALFARMYPQLVERVGGITLMGGGHHTGNMTPASEFNILADPEAAAIVFEESWPVTMVGLDVTHQVLAVPERMEQLKAIGTDVAQFIAELVEFFGASYMKERNYPGPPMHDPLAVAAVADPSILRTVHAPIYVETQGQHARGQTIVDFRRTWSNNDPSGLGVTDDPDFEAPNTAVAVDVDAEKFWDLLVDALTRIGNTNF

SEQ ID NO: 26071 - protein, 334 aa, Triticum aestivum
MPAVTTHASAGVMDPGSDIIEYERPGVVRVYKSGRVERFDGTDTNTVPPCPSGDPAYGVASKDVVLDASANISARLYIPAAEPGKKLPVVVYFHGGGFLVQTPASPFYHAYTASLAAAAPAVVVSVDYRLAPEDRLPAAYDDAFAALKAVVASCRPDGAEPWLAAHGDASRVVLAGDSAGGNIAHNTAIRLRKECIEGYGDGVSGVALLHSYFWGTEQVGGEPTDAAYRGEFERLWDVACGSQFGPDHPYINPATSPGEWSQLGCGHVLVTTAELCWFVNRARAYAEGIKACGWDGVVEFHETKGEEHVYFLFKSGCDNAVKELAVVADFVGRC

SEQ ID NO: 26072 - protein, 675 aa, Cryptococcus neoformans var. neoformans JEC21
MFSRVLKSTNSQQQPSSQAPTSPTKSSRSGHTKSQSTAAPSPSKIPVPSTPSSRSSFLPTGSKENLPAIPPSPSQQNNERSNYLSFLFSQNQAGTPTTPVKVNKTAPSHVAPNPGHAHHGPETVAQREEKPVYPRDSEDVHMVTMKNTVNPVMLKQLASIPQHNQAASSAPSVAQKQSNPPNSYAAQRGGAYQPDDVHMKTAARHDTRYEKERGLQLWERELLETPEVKRKATVAQIYFLDYYFDLLGYIANRRKRLETFKADTAARNVTGPDYVKELSSYNGRERVLLRKRRTKLRIDQFRIIAQVGQGGYGSVYLARKADTNEICALKKMRKGTLAKMDEVKHVLVERDILTAVKTPWLVRLLYAFQDIEHVYLAMEYVPGGDFRTLLNNSGVLKEEHARFYGAEMFNFLVDGTGHVKLTDFGLATGSLNPQKIEEMKSKLDQVKDENLVFRSTLERRTIYRSIRATEPRYADSVVGSPDYMPPEVLRGKTYTYSADYWSLGCILFEFLCGFPPFSGSTPEETWANLKNWTRVLRRPVYDRPEDLIFNLSDVAWDAVTALISHPKDRVASLQEVQSLPFFSSLPFASLRQLEAPFVPVLDGETDVGYFDSFSSPEDMAKYAEVFKKQRDVEAVEERGIGKRNNWVGFTFGKNANVTVPYRGIKPEGEALQTIF

SEQ ID NO: 26073 - protein, 144 aa, Streptococcus intermedius
FKNLHKPTDNDLKKLFIRGQYTSGKVDGKKYISYRSEPNVNPESTTETFASGAFFVDSERFRGVPFFFRTGKRLTAKGTHVNIVFKQVESIFGSSLQPNVLTIYIQPTEGFSLSMNGKEVGEQFSLAPLTLDYRTDATASGASP

SEQ ID NO: 26074 - protein, 137 aa, Brassica napus
DEFERGVEAKEMPCKHKFHVKCIVPWLEIHSSCPVCRFELPSGNDDGDDESKVVSERGTRTVPESSNREEVVEDVGSVERGREEDVRSGNGRRFSIPWPFSGFFSSSSSSSSSSPSSSGSAQSGENNVYSRSYGSSR

SEQ ID NO: 26075 - protein, 161 aa, Synechococcus sp. RS9917
MQLRIGNGYDMHRLVPGRPLILGGQKLEHPDGLGLDGHSDADVLVHAIMDALLGALSLGDIGQHFPPEDPRWRGADSLVLLEQVVALVRDRGWGVANVDSVVIAERPKLKPHIEAMRRAIAMRLGIAPEQVGVKATTNEKLGPEGREEGISAQAVALLQAL

SEQ ID NO: 26076 - protein, 477 aa, Roseovarius nubinhibens ISM
MSSATHYDLIIIGSGPAGRSAAIQAGKLKRRVLVIDRKDRLGGVSVHTGTIPSKTLRETVLNLSGWRERSFYGRSYRVKDDIEAQDLKSRLHMTLDYEVDVLEHQFNRNHVDTLNGLARFTGPKTVEVATEAGETTSLTADRFLISTGTRTYRPDYVPFNGTTIVDSDEFLELARIPRSLTVVGAGVIGVEYATMFAALDVRVTLIEPRDSFLDFIDRTLIQEFTHQIRENGVDLRLGSPIEKIEDAGDHVEITMGNGRHVRSEMLLFAAGRMGATQKLNLSAVGLETDHRGRIEVDRKTYQTKLGHIYAAGDVIGHPSLASTSLQQGRVAACHALGVPTLSESPWYPYGIYSVPEISTCGMSEEEMQERGIPYEVGIARFRETSRGHIMGLEHGMLKMLFSLKTRRVLGVQIVGEGATELIHIAQAVLNLKGTVDYFVQNTFNYPTLAEAYKIAGLDAFNRMPIPEEFKPPKPEAD

SEQ ID NO: 26077 - protein, 107 aa, Lolium perenne
MAEEYRCFVGGLAWATNDQSLEQAFSQFGEITDCKIINDRETGRSRGFGFVTFSSSESMKNAIEGMNGQDLDGRNITVNEAQSRSGGGGGGYSRGGGGGDSGGNWRN

SEQ ID NO: 26078 - protein, 570 aa, Bacillus anthracis str. Ames
MTLNIQGIAASSGIAIAKAFRLENPEFNIEQKSITNEAAEIARLEAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTNSEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTLNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEVGTTVSDSIEVGMMVEIPASAVLADQFAKEVDFFSIGTNDLIQYTMAADRMNEQVSYLYQPYNLSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 26079 - protein, 585 aa, Mycobacterium avium subsp. paratuberculosis K-10
MLSGRPNGEQGRRVATVRSGTMRSMGAQTALTLLLAAIAVIVLVDWISERTRLPSATLLVLVGIGQALLPGPTIGLEPDVVMTCILPPLLYHAALESSLVGIRRNLRTVVSLSVVLVLLTAASVGVAFSLLVGGATLAVGMVLGAAVAPTDPVAALAVARKEGLPLNIVTLIEGEGLLNDATALTTLAVAVTVARGAAFSAPSAIREFVLAAVGGLVVGQVFAYARRLLRRWRHDVLTANAISLATPFLTYLVAEKLSASGVLAVVVCGLIVGHDSPRVESGASRLQTRAVWRLVNFLLEGVVFLLIGHQVPVILDELGGYALSTILVAVGVTVAVVLLVRPLWLLLTQALPRSLHTRLGNVDDSATDSAEPRPERTRERLSGREIVVLSWAGTRGVVSLAAIFAVPVLTEGNAPFPDRDLLLFCTLVVVLVTLIGQGVTFGPLVRALGLRAKTTDELRLRNRARAAALRAALDRLDSLDPEDGADVDPRVIDGVRQQLSAQLERYEHRLTLLSDVDELPAAPAYEAAVGLRRVAIDAQRDELVRWRDAGMLPDQSLRAIERELDHEESMLPMGLPRSPRRSQKR

SEQ ID NO: 26080 - protein, 373 aa, Coprinopsis cinerea okayama7#130
MATPKKPTWNASLYASHRPVYPPKLFDQILEFHRQKGGQFDHALDLGCGTGQASQYLRGRFKRVTCVDPGATMIESAKKALVGDYESRSNSKGQHDTTYTFCVSPAEDLHQAVPEDGTVDLVIAATSCHWFDMTKVWPEIGRILRKGGTAAFWSYVECLLPAFPSTERLIKEYGGFEEYVTASTNFLDTIGQYYPRPQKTRAERFLVDLPSPEEVLGPQSGEGCLVDFERRYFTGPYPIPQRKTNEVEDPAERKVYPVIMSLNWTWLQLLGHIRTWSAHNAYQEQHPDDLNAPEDTQFLEEDLDAIRGTSYDESFIRGGDVSIRFWKNLREAAARDIAVSSSKGGNGEVDGGVKLLDKITVDFPMPLLLVGKS

SEQ ID NO: 26081 - protein, 139 aa, Zea mays
MESAVNPKAYPLADAQLTMGILDIIQQAANYKQLKKGANEATKTLNRGISEFVVMAADTEPLEILLHLPLLAEDKCFLLLDLFLCDKNVPYVFVPSKQALGRACGVTRPVIACSVTSNEGSQLKQQIQGLKDSIEKLLI

SEQ ID NO: 26082 - protein, 392 aa, Roseovarius nubinhibens ISM
MLSNLSQQPEDKILALMAQYRADPRDTKVDLGVGVYKDASGHTPIMRAVKAAEKRLWEEEQTKSYVALAGDPGFSDAMVSLVLGDAVARDAVAAAATPGGTGAVRQAFELIRMANPKARIFVPNPTWPNHLSILKYLGMETVTYRYFDSATGAVDFAGMQEDLAGLTAGDVVLLHGCCHNPTGANLTLPEWQAVIAVLNDKGAMPMIDIAYQGFGDGLDADAAATRLVAKSCPETLIAASCSKNFGIYRERTGILMAVSQGQTAVAQDNLNFLNRQNFSFPPDHGARLVTMILNDDALRADWQAELEEVRNGMLGLRESLADELRKLSGSDRFGFVAQHRGMFSRLGATPEQVAHMREHHGIYMVGDSRINIAGLNVKSVPILAKAMIDAGV

SEQ ID NO: 26083 - protein, 373 aa, Zea mays
  misc_feature (233)..(233): Xaa can be any naturally occurring amino acid
MSAFSSLLLPSFFLFPGQPLQLLPNPPTRFSRLRCHRRDSTSVATMVKSKAIRVHELGGPEVLRWEEVEVGEPGEGEIRIRTTAVGVNFIDIYFRKGVYAAPTMPFTPGMEAVGVVTAVGPGLTGRKVGDVVAYAGNPMGSYAQEQILPAAVAVPVPPSVDHKQAASVMLKGMTAHVLLRRVFKVESGHTILVHAAAGGVGSLLCQWANALGATVIGTVSNQEKAAQAAQDGXCHHPIIYTSEDVVARVKDITSGKGVNVVYDSVGKDTYKASLECLASRGFLVSFGQSSGKPDPIPTSDLASKSLFLTRPSLMHYTATRDELLESAGEVFANVANGVLHVRVNHTYPLSEAAQAHADLEGRKTSGSIVLIPG

SEQ ID NO: 26084 - protein, 466 aa, Coprinopsis cinerea okayama7#130
MPEDSERLGNLALHYHLPLPIYHPLPVVLDRGLGAKVWDPEGKEYIDMLSAYSAVNQGHCHPAILQTLHEQSMKLTLSSRAFYNSVFGRFAKLITEMFGYDMVLPMNTGAEAVETALKLARKWGYKVKGIPEGKARIFSAEGNFHGRTLGVISMSTDPESRTGFGPYLERVGPYYTTEEGGDGDNEAEVKTIRYGVIEDVEKVFELYGEETAAFLVEPIQGEAGIVVPPEGYLAKVHALCKKHNVLLICDEIQTGLCRTGKMLASEWENVRPDIVLLGKALSGGMYPVSAVLSSSSIMLTIQPGEHGSTYGGNPLGCAVAITALTVLQSERLAERAERLGQIFRLGLNEFKKHAYAGQGHSVAGKGGKLIREVRGRGLLNALVFEESASEKGRSAWELCLLLKHRGVLAKPTHKNIIRFAPPLVIEEDDLRKGIDIIGECLRDLDVLESIPGDTEEEKRHVDGLTL

SEQ ID NO: 26085 - protein, 274 aa, Physcomitrella patens subsp. patens
LAQAVMLPAVGGVCHVWMHGLNITEVYGAEKLHKVINNRPGGQSLITVCNHVASMDDPLVMAALLPPRLFLQPKSLRWTLCATDRCFTNAAFSAFFHSVKVLPLKRGAGLQQEGIDIALSKLKRGDWVHIFPEGSRSRDGGKTIGTVRRGIGRLVTDVERTPLVVPFVHVGMQDLMPIGSKFPAVKKKVSVLIGDPIDLDDLVKESSMKFGSKGELYDAIAFRVGQRLKVMKEELDQLVAVREIQLGGEEAEKLHSLERAQELLQYVDWESQGV

SEQ ID NO: 26086 - protein, 135 aa, Zea mays
  misc_feature (16)..(16): Xaa can be any naturally occurring amino acid
  misc_feature (32)..(32): Xaa can be any naturally occurring amino acid
  misc_feature (52)..(52): Xaa can be any naturally occurring amino acid
MAIKREIFTAATFDFXGGSFPAKICIEPSDPXDVKTAKGKKKHAFKSKSRFXQLEFAQNKRQNAWQQFLTKGKAQKVGFFSGCKKESIFKFPGDPKGKVGVPGSGKGLTHFQRREKHLPLKGGAGDSPDYYQELT

SEQ ID NO: 26087 - protein, 464 aa, Rhodospirillum rubrum ATCC 11170
MTVVDRGTAHWQKLDADHHWHPFTNTKALNQKGARVIVRGEGVYLWDSEGNRILDGMAGLWCVNLGYGRTELAEAAAAQFATLPFYNTFFQTTHTPAVELAHLIASVTPGDLNHVFFASSGSEAVDTALRMARAYWVVAGKPSKTWVIGRKNAYHGSTLAGASLSGMSGMWKYGAPLVPDIAHIAQPYWYGEADAAETDPEAFGLARARLLEAKILELGAENVAAFIGEPIQGAGGVIVPPASYWPEIERICRKYDVLLIADEVICGFGRTGSWFGSQTFGITPDIMTMAKGLSSGYLPISAVAVGNRVADELINGGGEFTHGFTYSGHPVSAAVAKRTIEILRDEKIIERVHDDIGPYFQERLRTLEDHPLVGKVDGVGLIAGIALVASKSPKRFFEKGDEVGLICRDHCFAEGLVMRAVGSRMVCAPPLIISRDEVDELVRLARRCFDLTLRDVGPLIETAK

SEQ ID NO: 26088 - protein, 487 aa, Colona floribunda
  misc_feature (3)..(3): Xaa can be any naturally occurring amino acid
  misc_feature (10)..(10): Xaa can be any naturally occurring amino acid
SGXSTLEKEXLGRISQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKL

SEQ ID NO: 26089 - protein, 398 aa, Lactobacillus plantarum WCFS1
MNYLLQLVLILLLTKLGAHIAATFNLPSVIGELLVGILAGPAVFHILTYSTFIQYFAEIGVIILMFIAGLEGDLKLLFRYWKPALTVATLGVIFPTASAVLLCVGMFDFSLTTSIFLGLILSATSVSITVQVLKEMDYLNTREGAIILGAAVADDIICVVLLGISTSLFGTASAHNQSLVAMVLPKVLFFVVVIALAKWFVPLFLRGFNKVNASENITTAAMVLCFGFSFLAVKLGMSDVLGAYIAGLAISETRFKAQLVAKVEPIGYAVFIPAFFVSIGLEITFKGMQNDLVFIGLLLVLAILGKQIGGAIGGKLFGLTWNEANIVGAGMVSRGEMALVVANVAVSAGLIDHNHYTAMIVVTVMATLIAPSMLKTFIQHGKRAVSHISLNKTSEAKS

SEQ ID NO: 26090 - protein, 250 aa, Thermus thermophilus HB8
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQAIRKALSERYGEAFASRVRILYGGSVNPKNFADLLSMPNVDGGLVGGASLELESFLALLRIAG

SEQ ID NO: 26091 - protein, 528 aa, Synechococcus sp. CC9311
MSSVQSEGQRKPAIVILDFGSQYSELIARRVRETEVFSVVLGYSTSAEELRALAPRGIILSGGPSSVYADEAPLCDPAIWDLGVPVLGVCYGMQLMVQQLGGQVVAATGKAEYGKAPLKVDDPTALLTNVESGSTMWMSHGDSVEALPDGFLRLAHTANTPEAAIANHKRRLYGVQFHPEVVHSTGGMVMIRNFVYHICGCEPDWTTEAFIDEAVANVRDQVGQKRVLLALSGGVDSSTLAFLLKKAIGDQLTCMFIDQGFMRKGEPEFLMEFFDRKFNIHVEYINARERFIKKLDGITDPEEKRKIIGTEFIRVFEEESRRLGPFDYLVQGTLYPDVIESAGTNVDPKTGERVAVKIKSHHNVGGLPKDLRFKLVEPLRKLFKDEVRKVGRTLGLPEEIVSRHPFPGPGLAIRILGEVTEEKLDCLRDADLIVREEVNAAGLYHDIWQAFAVLLPVRSVGVMGDKRTYAWPIVLRCVSSEDGMTADWSRLPYDLMEVISNRIVNEVKGVNRVVMDITSKPPGTIEWE

SEQ ID NO: 26092 - protein, 434 aa, Erythrobacter sp. SD-21
MHEETANALSAFDIAALLVVASALLGWFNHHFIKLPHVIGLTVMGAVAAIGLMAVDAIIPGITLDNWVADTLEQMNFTDTLLQGMLSFLLFAGALHVDLDRLKVAWLPVLLLSTVGVMISTVLVGLAMWGVGSLIGLGFAPIWYFVFGALIAPTDPVSVLGVLKEENVPKSLQSAVAGESLFNDGVGIVVFIILLGAAVSGSEFSFLEGAELFAIEAGGGILVGLVAGYLGYRALAGMDEYTLEVLITLAVVMGGYALCSQLHISGPLAMAVAGLLIGNHGVTYAMSDVTRDYLLKFWELLDELLNSVLFLLIGLEMIVLTVGGDVLLFGLLAIPLSLAARAVGIFVSTKTIPAARLQDKGAGRVLWWGGLRGGISIALALSLPAGETRDYILAATFAAVLFSVLVQRATLGRLIDKLKRDHAPAVEEGAETVH

SEQ ID NO: 26093 - protein, 307 aa, Arabidopsis thaliana
MNNDTSKKLGTLVSDDGPVNVYVWDMDETLILLRSLLNGTYAESFNGSKDVKRGVEIGRMWEKHILKICDDFFFYEQVEECNEPFLESLRQYDDGKDLSRYEFKQDDFSTPTDDLNKRKLAYRHRAVAERYEKGLCQFIDSESMSGLDELYNVTDEYTDRWLSSARAFLEQCSCVEESSDGTSAIEQSSQDIHILVTSGALIPSLVKCLLFRLDTFLRHENVYSSIDVGKLQCFKWIKERFNHPKFRFCAIGDGWEECAAAQALQWPFVKIDLQPDSSHRFPGLTPKTVSYYFAAVYGNSDADSSKE

SEQ ID NO: 26094 - protein, 144 aa, Streptococcus constellatus
FKHLHKSTDNDLKKLFIRGQYTSGKVDRKKYISYRSEPNVEPESTTETFVSGAFFVDSDRFRGVPFFFRTGKRLTAKGTHVNIVFKQIESIFGSSLQPNVLTIYIQPTEGFSLSMNGKEVGEQFNLAPLTLDYRTDATASGASP

SEQ ID NO: 26095 - protein, 127 aa, Brassica napus
MESKKVMEEEEEMWRREIVTSVMRIVSTRLPQRDLISLLLVSPWLYRTLVSYPSIWLNIDLRERTNAGDRLLAALSLPRYRQVKHINLEFSQGVEDTHLQLVKSQCHDALSSLECLNLNGCQKISDS

SEQ ID NO: 26096 - protein, 469 aa, Synechococcus sp. RS9917
MAPSLQRREADQRIQFILRLAIAAALGGFLFGYDTAVINGAVSSIQATFNASAMGLGLAVSSALLGSAAGALGAGWLADRIGRRRSMWLAAVLFIASAVGSALAPTLRDLVIWRVIGGVAVGFASVLAPAYIAEISPANLRGRTGSLQQLAIVVGIFIALLFDYVIVLATVDQEPLSSVGPLPAWRWMLMSELIPALLYGGMVLRIPESPRYLVQIGCIEHAREVILKTLGEPTQEVIDRIQASLGHRNGGQIQDLFSKRSLLLPVVWTGVLLAIFQQFVGINVIFYYSSSLWKAVGFSTTDSLSITVVTSITNVVTTFLAIATIDRLGRRPLLLAGSVVITISLGLMSWTFAGAPIVNGEPQLTGAASLVALISANVFVFAFGFSWGPVMWVLLGEMFSNRIRALALGLSATVNWLANFLISTTFPVLLQSSGPALAYGLYATAAAISFFFVLFMVRETKGRELEDMA

SEQ ID NO: 26097 - protein, 512 aa, Zea mays
MAATDDGAVDSASAAAAARAVEEARALLPAPAPDYDDEDLEERAYEAAEKVIVSISGGPDPEDVDGDGDGAELCSSSGSSPPPFSWRKLWLFTGPGFLMSIAFLDPGNLEGDLQAGAVAGDTLLWLLMWATAMGLLVQLLAARLGVATGRHLAELCRDEYPDWARRALWLMAEVAMVGADIQEVIGSAIAIKILSRGYLPLWAGVVITALDCFIFLSLENYGVRKLEAVFALLITTMAVSFAWMFTDTKPNGKDLLIALVQSRKIDQNKEYQVREALRYYSIESTIALVVSFMINLFVTTVFAKGFYGSKEAGNIGLENAGQYLQEKFGGGFFPILYIWGIGLLAAGQSSTITGTYAGQFIMGGFLNLRLKKWVRALITRSFAIVPTITVALFFDTSDSALDILNEWLNVLQSIQIPFALIPLITLVSKEQVMGVFKIGPNTQAVTWTVATLLITINGYLLMDFFSSEIRGPLSGSLLCVAVLIYASFVLYLILRGTELSEKIAKAIRGSFS

SEQ ID NO: 26098 - protein, 369 aa, Ficus carica
MGLAENQLCFDLVQDWILNNPRASICTPEGVDEFRDIAIFQDYHGLPEFRKAVAEFMGQVRGNRVTFDPDRIVMSGGATGAHEMVTFCLADPGEAFLVPVPYYPGFNRDLRWRTGVQLIPVHSESANNFKVTREALEEAYEKAQEENIRVKGLLITNPSNPLGTILDRETLRMIVRFINEKSIHLVCDEIYAATVFNQPPFVSISEIIAEDTDIECHTDLIHIVYSLSEDMGFPGFRVGVVYSYNDAVVNCARKMSSFGLVSSQTQHLIAAMLSDDVFVTRFLAESARRLERRHNGFTRGLAQVRITCLESNAGLFLWMDLHRLLKEQTLDAEMALWKVIINEVKLNVSPGFRFIAPNRAGSAYGSPAV

SEQ ID NO: 26099 - protein, 366 aa, Ficus carica
MGLAENQLCFDLIEDWIRKNPIASICTAEGVKNFKDVAIFQDYHGFSEFRKAIAKFMSKVRGGRVTFDPDRIVMGGGPTGANELVMFCLADPGDAFLVPSPCYPGFVRDLGWRTGAQIVPVHCDTQQFQVTKQALESAYEKAKNDKINVKGLLITNPSNPLGTTLDRETLRNLVSFVNDKNIHLVCDEIYAAAAFDFPSYVSVSEVIEEVENCDKDLIHIVYSLSKDMGLPGFRVGIVYSYNDAVVSCGRKVSSFGLVSSQTQHLLAAMLNDDVFVSNFLSESSKRLKNRHDYFAKGLEEVGINCLKNNAGLFFWMDLRRLLKEQTFDGEMALWRVIVNEAKLNVSPGSSFQCSEPGWFRVTFACS

SEQ ID NO: 26100 - protein, 371 aa, Ficus carica
RGSMGLAENQLSFDLLESWLAKNPDAAGFKRDGKSIFRELALFQDYNGLPAFKQALVDFMSEIRGNKVTFNPNHIVLTAGATRPTRPSCSASPTPGTFLLPTPYYPGFDRDLKWRTGVEIVPIQCTSSNGFQITEEALNQAYQEAENRNLRVKGVLVTNPSNPLGTTMTSNELDLLVTFVEAKDIHLISDEIYSGTVFISPGFVSVMEILKNRNYDEFSEVRNRVHVVYSLSKGSRSPGIPRRSDLLQRRDGLAAATKMSSFGLVSSQTQYLLSAMLSDKKFTKKYITENQRRLKKRHGMLVSGLQKAGIGCLKSNAGLFCWVDMRHLLRSNTFDAEMELWKKNVYDVKLNISPGSSCHCTEPGWFSVTFA

SEQ ID NO: 26101 - protein, 234 aa, Arabidopsis thaliana
  misc_feature (48)..(48): Xaa can be any naturally occurring amino acid
  misc_feature (87)..(87): Xaa can be any naturally occurring amino acid
  misc_feature (92)..(92): Xaa can be any naturally occurring amino acid
  misc_feature (105)..(105): Xaa can be any naturally occurring amino acid
  misc_feature (134)..(134): Xaa can be any naturally occurring amino acid
  misc_feature (163)..(163): Xaa can be any naturally occurring amino acid
MASSMLSSAAVVTSPAQATMVAPFTGLKSSAAFPVTRKTNKDITFPNXPSNGGRVSCMKVWPPIGKKKFETLSYLPDLSDVELAKEXVDYLXSANKWIPLCLKFXELEHGFVYGEHGNTPGYYDGRNWTMGKLXLFRWTDSPQGLKEIENCKKEYPGAFIRIXIPNTPQGQGISFIGKNPPTSPKVNFFFKKFLRNNPGPFISNWAGVFFPFWKKFFSGWAKGGFFEKWNFNFP

SEQ ID NO: 26102 - protein, 100 aa, Synechococcus sp. CC9311
MFQVADFKVTILSKGEETVINCPDDQYILDAAEEHGIDMPYSCRAGACSTCAAKVTAGSIDQSDQSFLDDDQIAAGFALLCVSYPVSDCSVIANAEDDLY

SEQ ID NO: 26103 - protein, 466 aa, Zea mays
  misc_feature (155)..(155): Xaa can be any naturally occurring amino acid
MGGCFSQEEHRLQSRPAEAAGPDGLQKSKSDSKATASVLAPPKAVVDLQVEGYGNVNIFTYDELSAATKNFRPDQILGEGGFGVVYKGVIDENVRAGFPSRQVAVKELNPEGFQGDKEWLAEVNYLGQLSHPNLVELIGYCCEGSHRLLVYEYMXACGSLEKHLFRRVCLNMPWSTRMKIALGAARGLEYLHRAERSIIYRDFKTSNILLDADYNAKLSDFGLARTGPSGDQTHVSTRVMGTYGYAAPEYVMTGHLTARSDVYGFGVVLLEMIIGRRAVDDSRPSREHNLVDWARPLLVHNRKLFRIIDPRMEGQYSTKAATEVASLAYRCLSQNPKGRPTMSQVVETFEAVQNMPECQDILLQNGITGAVTLYEVPKEPADRVELEKAKQEPAVKTAAIPPVNGKPAPQSRRTRPGNGRSKSEPSLECKMYIPSPDSDEQQLGLEALASPNGSMKDHPDEDLYKI

SEQ ID NO: 26104 - protein, 624 aa, Oryza sativa Japonica Group
MESAHGGSDRPGSMDSQEPRVDAEQKPVLSDNPEEQTIPSKDEKVLEPTISHDSNGINLPSEGQAQAGTSNIGGGHNAAYPQTMYSSQAQPFYYQGPGYDNPSNEWDGYPPYVSVEGLEAGPAVVYNDDPQLMYHGGYGYDPYAHYSPISTPVPAAVSGDGQLYSPQQFSFSAPYYQQSVPPGMPYLSSPTPISQGEAMVPIDPTQGAFIAETLSPNSFLFGPRPEWFRSSEGNGSFPSPAASPQPAGGVSGPFGQSNFPMASGMQSPQHRPFYGFGTPSDSYGRVFSHGGYFPQATNYGGPFPSFGLNGTSSIPMEKGRRRGRGNALLCSCNGSLDFLNEQSRGPRATRPKKQPEDGGKDEKPSAGVDCELYNRPDFVTEYKNARFFIIKSYSEDNVHKSIKYGVWASTTNGNKKLDSAYREAKEKEEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKDHEEDASILDDFDFYEERERALLDNKARLHQQHQLPSSTVVEPKKPLTVATDLVGHITKSFAQAVRLGEAKNVSPNSADKGASGDSSVAAKPLEVKEAGLA

SEQ ID NO: 26105 - protein, 321 aa, Bacillus cereus ATCC 14579
MRIVNKKIIFFGDFGIDDAVALIYANKTCKLDILGIVAEYGNVSRDIVTENVYFLERYYATQVKIIEGASRPMTAEEPLFFPEIHGDHGLGPIIPPEMRICKRENFCELIKLIEPCPEDIIIVATGRLTTLATLFLLYPNIMDRICSYYIMGGAFLFPGNVTPVSEANFYGDPIAANIVMKYAKNASIYPLNVTQGALITPEMANIIDKQGTGQAKLIKPMIDFYYENFYKKEYPGIGGSPIHDLLPFISFINDSIFEYKKSAVWISTTNDVTRGQSVADFRKIAEPTRFDDRPIQRIAVGFNYAAFKEEFMRTILKPDCS

SEQ ID NO: 26106 - protein, 284 aa, Synechococcus sp. CC9311
MIELLLTGSLAFIMFSLGLSLKPQDFEVAFHQPKALIAGAIAQFLMLPLIAFVLLRIFGLQGDFALGVMILSCCPGGITSSLVTKLSRGDVALSISYTALASLVTAATLPLILSLTAPILIPQQDVGLSIFSLSLKVFSLATLPVLLGVWIRQWNPKLAVRWQLPSSQLANGLFVAVLIGVLIGQWDVFIAYLPVLGPVLLLLNLLMLIIGLAVGHLLKLNKSQITSLSVEAGFQNGTIGIVVGSLISEQLVQGGLSRFSLPSAVYSVLMLVTIIPFVLWRRSL

SEQ ID NO: 26107 - protein, 722 aa, Mycobacterium avium subsp. paratuberculosis K-10
MTGSGSARQLTLTARLNTSAVDSRRGVVRLHPSAVAALGIREWDAVSLIGSRTTAAVAGLAGPEIPSGTVLLDDVTLSNAGLRDGTAVVVSPVTVYGARSVTLSGSPLTTRSVSPVTLRQALLGKVLTVGDAVSLLPRDLGPGTSTSEATRALAAAVGISWTSELLTVTGVDPDGPVSVQPNSLVGWGAGAAPAAASRASVEEARPQTVVEELKGCQPQAAKLVEWLKLALDEPHLLKTLGAATFLGVLVTGPAGVGKVTLVRAVCGDRRLVTLDGPEVGALGADDRLKAVASAVQTVRDGGGVLLITDVDALLPATAEPVASLILAELRGAVASEGVALIATSARPDQLDARLRAPDLCDRELSLPLPDAATRKALLESLLRNVPTDGLDLDEIASRTPGFVVADLAALIREAALRAASRASSDGRPPALHQEDLTGALSVIRPLSRSAAEEVSVGDITLDDVGDMAQARQALTEAVLWPLQHPDTFARLGVQPPRGVLLYGPPGCGKTFVVRALASTGQLSVHAVKGSELMDKWVGSSEKAVRELFRRARDSAPALIFLDEVDALAPRRGQSFDSGVTDRVVAALLTELDGVDPLRDVVVLGATNRPDLIDPALLRPGRLERLVFVEPPDAAARREILRTAGKSIPLSADVDLDELAAGLDGYSAADCVALLREAALTAMRRSIDATDVTAADLAAARENVRPSLDPAQVASLRAFAEAP

SEQ ID NO: 26108 - protein, 336 aa, Synechococcus sp. CC9311
MSRDLSTSVNNIKDVIPTMQYASLSNGDRMPLLGLGTGKSESRQVYKSVREAIKIGYRHIDCASIYGNEEEVGDAIRDAIQNHEITRSELWITSKLWSNCHGKNHVEAALSQSLQNLGVDYLNLYLIHWPVGIRPEKTFAESVDDLLTPEESPISETWEAMESTRDKGLTKHIGVSNFTVKKLQQLVSHCKQKPEVNQVEHHPLLQQPTLIEYCASEEILITAYSPLGSMDRPQSLKVKDAPAVLDHPVIRAIAETRGCSPAQVVLAWDVQRGISAIPKSVKPSRLLENLQAADIQLSNTELQKIEALDQNFRLVNGAFWVMEGGPWTLQSLWDTP

SEQ ID NO: 26109 - protein, 341 aa, Aeromonas hydrophila
MTILVTGGAGYIGSHTLVELLGAGQQVVVLDNLSNSSPESLKRVERITGKPVTFVEGDVLDRACLQQLFAAHKIESVIHFAGLKAVGESSQIPLTYYQNNITGTLVLCEEMAKAGVFRLVFSSSATVYGDPASVPLREDFPTSATNPYGRSKLMVEEILRDLSKSDPRWAIVLLRYFNPVGAHESGLIGEDPNGIPNNLLPYISQVGVGKLKELGVFGNDYPTPDGTGVRDYIHVVDLALGHLKALARIAADTGVFTYNLGTGQGYSVLQMISAFEAVSGRTIAYQIKPRRPGDIAECWAEPHKARDELGWQAERGLEQMMVDTWRWQSQNPNGYGPTAKP

SEQ ID NO: 26110 - protein, 222 aa, Physcomitrella patens subsp. patens
MPGSNIVLTAGADVGRLALVKSAEFIKSSSKESECPSEGYPEFALVGRSNVGKSSLINSLVLRKELAQTSKKPGKTQLINHFLINKKWYLVDLPGYGFAKAPTAVRTDWNEFTKDYFLQRETLACVLLLVDASIEPQQIDLDCVDWLGRNKIPVTIVFTKCDRKKKKKNGGRKPQENIEDFLDRLKPLYDEIPPWVMTSSATNQGREELLRHIAQLRIFWAR

SEQ ID NO: 26111 - protein, 442 aa, Arabidopsis thaliana
  misc_feature (229)..(229): Xaa can be any naturally occurring amino acid
  misc_feature (242)..(242): Xaa can be any naturally occurring amino acid
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQVKPLSANLRSQALLCIXYKTEMLRDLDDMXQGFGNVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAGGVTVSYFEWVQNIQGFMWEEEKVNLELQKYMTRAFHNIKTMCHTHSCNLRMGAFTLGVNRVARATQLRGWEA

SEQ ID NO: 26112 - protein, 428 aa, Erythrobacter sp. SD-21
MDGKPIAPPRTVGFAGMSLLQINGMIGSGIFALPAVLVAGVGSFAPVLMLLGGVLFLPLALVFAWLAARFEMSGGPVLYGKTAFGSFAGFQAGWGRYVSGSVAMAANTHVMVAYFAAIFPVLQDPFWSTVTAVAVIAALTIINLFSMRGSVNALGGLTALKLVPLAILIGAALLGNFGAPEIVLPEFSQVETVVLLLFYAFIGFEGVTVPAGELKNPKRDLPRVLVTVLAGVTVLYAIIIWAYLAIGASPNADESALAASAQAALGDLGTLMIVLGAGFSILANSFSGVVVVPRMAYGMAQQGMLPEWFERIHPRFLTPANAILFYGAASCLFAMWGGFLVLAAASTLSRLLTYVITAAALPVIEKREGHLNPFRAFVALLALAASVWISSHASEEAWTIFGILLAVGTLLYFVARRGSVDEPIAESS

SEQ ID NO: 26113 - protein, 342 aa, Herminiimonas arsenicoxydans
MTGYQEILTDPSYSNQLVTLTYPHIGNTGVNAEDVESFKIHAAGLIIKDLPILVSNFRSTQTLSDYLKSENIIGIAGIDTRKLTRILREKGAQSGAILAGEDATAEKALALAKTFGGLAGLDLAKVVSTKASYPWNETEWKLGKGYGKQITPKYHVVAYDYGVKFNILRMLAERGCKVTVLPAQATAAEALALKPDGIFLSNGPGDPQPCDYAIAATKELIERGIPTFGICLGHQIMALASGAKTFKMGFGHHGANHPVQDLDSKKVLITSQNHGFAVDAATLPANCRVTHVSLFDGSLQGFERTDQPAFCFQGHPEASPGPHDIAPLFDRFVAMMEKNKNA

SEQ ID NO: 26114 - protein, 577 aa, Zea mays
  misc_feature (383)..(383): Xaa can be any naturally occurring amino acid
  misc_feature (404)..(404): Xaa can be any naturally occurring amino acid
MEEAPPSSSPPSPPVMLLLLLLLIVSSPCSSSALLSPKGVNPEVQALMTIKNTLKDPHGVLKNWDQDSVDPCSWTTVSCSLENFVTGLEVPGQNLSGLLSPSIGNLTNLETILLQNNNITGLIPAEIGKLTKLRTLDLSSNHLYGAIPTSVGNLESLQYLRLNNNTLSGPFPSASANLSQLVFLDLSYNNLSGPVPGSLARTFNIVGNPLICGTNNAERDCYGTAPMPPYNLNSSLPPAIMSKSHKFAIAFGTAIGCIGLLVLAAGFLFWWRHRRNRQVLFDVDDQHMENVSLGNVKRFQFRELQSATGNFSSKNILGKGGFGYVYRGQFPDGTLVAVKRLKDGNAAGGEAQFQTEVEMISLALHRNLLRLYGFCMTATERLXDDCCEAIVGDFGLAKLLDHRXSHVTTAVRGTVGHIAPEYLSTGQSSEKTDVFGFGILLLELVTGQTALEFGKTANQKGAMLDWVKKTHQEKKLDVLVDQGLRGGYDKMELEEMVRVALLCTQYLPGHRPKMSEVVRMLEAGEGLAERWEASHSQSQSADSHEFKVPDFTFSRCYSDLTDDSSLLVQAVELSGPR

SEQ ID NO: 26115 - protein, 307 aa, Clostridium perfringens SM101
MDINLDALVEANRKYTKDGHVATYIPALAKVNPNQLGVCIYDLKENKKFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAEDLARLGAVLANEGVMPWNGERLFSVETATVVKSLMTTYGLYDESGAFSVHIGLPSKSGVGGGILSSVPNKCGIGLFSPALDVPGNSVTSMKLLKEIADKLKLDIFR

SEQ ID NO: 26116 - protein, 188 aa, Roseovarius nubinhibens ISM
MFIQTESTPNPATLKFLPGQTVLDAGTADFPSAEAAGKSPLAERIFKIAGVTGVFFGHDFVTVTKDEGTEWDHVKPAILGAIMEHFQSGKPVMLDAGGDPQSGHAEHTGEDGEIVNQIKELLDTRVRPAVAQDGGDITFHGFDRGVVYLHMQGACAGCPSSTITLKMGIENLLRHYIPEVTEVRPVAV

SEQ ID NO: 26117 - protein, 448 aa, Streptococcus pneumoniae TIGR4
MREYDIIAIGGGSGGIATMNRAGEHGAKAAVIEEKKLGGTCVNVGCVPKKIMWYGAQIAETFHQFGEDYGFKTTDLNFDFATLRRNREAYIDRARSSYDGSFKRNGVDLIEGHAEFVDSHTVSVNGELIRAKHIVIATGAHPSIPNIPGAELGGSSDDVFAWEELPESIAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTRNRQESRFKLITAGSEEKVVGLHGIGYGVDEMIQGFAVAIKMGATKADFDATVAIHPTASEEFVTMR

SEQ ID NO: 26118 - protein, 518 aa, Clostridium perfringens SM101
MSILIVKNMNHGFGDRAIFEDVSFRLLKGEHVGLIGANGEGKSTFMNIITGKLMPDEGDVQWSNKVRVGYMDQHAQLEKGKTIREVLREAFQYLFDMEVEMNGLYERMGEMSEDEITKALERTATIQDMLDHNGFYMIDAKVEEVAAGLGLRDVGLDKDVTDLSGGQRTKVLLAKLLLETPDILLLDEPTNYLDEEHIAWLKNYLIGYENAFILISHDIPFLNSVVNVIYHVENRALTRYTGDYDNFMRVYEANKKQLEAAYERQQAEIAKLEDFVARNKARVATTGMARARQKKLDKMDRIELAAEKPKPEFNFKQGRTSGKLIFEARDLVIGYDEPLSKPLNIRMERGQKIALVGANGLGKSTLLKSLMGLIKPISGEVETGDYQSIGYFEQEIKEANYNSCIEEVWQEFPGYTQYEVRSALAKCGLTTKHIESSVAVLSGGEQAKVRLCKLINKETNILILDEPTNHLDVEAKDELKRALKEYKGSILLVCHEPEFYRDVVTDVWSCEDWTTKIV

SEQ ID NO: 26119 - protein, 145 aa, Bacillus anthracis str. Ames
MKTLGYILMENGEKIDLEFFPEEAPKTVENFKKLAEQGFYDGVTFHRVIPGFVSQGGDPTGTGAGGPGYSIPCETDGNPHRHLVGSLSMAHAGRNTGGSQFFIVHEPQPHLDGVHTVFGKATSGIETVLNMRQGDVMKEVKVWEE

SEQ ID NO: 26120 - protein, 437 aa, Streptomyces clavuligerus
MFHPVLPRGREDRTVLVSGRGCTVRDTEGRTYLDASSVLGLTQIGHGREEIAQAAAEQMRTLGHFHTWGTISNDKAIRLAARLTDLAPQGLQRVYFTSGGGEGVEIALRMARYFHHRTGSPERTWILSRRTAYHGIGYGSGTVSGSPAYQDGFGPVLPHVHHLTPPDPYHAELYDGEDVTEYCLRELARTIDEIGPGRIAAMIGEPVMGAGGAVVPPPDYWPRVAALLRSHGILLILDEVVTAFGRTGTWFAAEHFGVTPDLLVTAKGITSGYVPHGAVLLTEEVADAVNGETGFPIGFTYTGHPTACAVALANLDIIEREGLLENAVKVGDHLAGRLAALRGLPAVGDVRQLGMMLAVELVSDKTARTPLPGGTLGVVDALREDAGVIVRATPRSLVLNPALVMDRATADEVADGLDSVLRRLAPDGRIGAAPRRG

SEQ ID NO: 26121 - protein, 622 aa, Streptococcus agalactiae A909
MSDFLVDGLTKSVGDKTVFSNVSFIIHSLDRIGIIGVNGTGKTTLLDVISGELGFDGDRSPFSSANDYKIAYLKQEPDFDDSQTILDTVLSSDLREMALIKEYELLLNHYEESKQSRLEKVMAEMDSLDAWSIESEVKTVLSKLGITDLQLSVGELSGGLRRRVQLAQVLLNDADLLLLDEPTNHLDIDTIAWLTNFLKNSKKTVLFITHDRYFLDNVATRIFELDKAQITEYQGNYQDYVRLRAEQDERDAASLHKKKQLYKQELAWMRTQPQARATKQQARINRFQNLKNDLHQTSDTSDLEMTFETSRIGKKVINFENVSFSYPDKSILKDFNLLIQNKDRIGIVGDNGVGKSTLLNLIVQDLQPDSGNVSIGETIRVGYFSQQLHNMDGSKRVINYLQEVADEVKTSVGTTSVTELLEQFLFPRSTHGTQIAKLSGGEKKRLYLLKILIEKPNVLLLDEPTNDLDIATLTVLENFLQGFGGPVITVSHDRYFLDKVANKIIAFENNDIREFFGNYTDYLDEKAFNEQNNEVISKKESTKTSREKQSRKRMSYFEKQEWATIEDDIMILENTITRIENDMQTCGSDFTRLSDLQKELDAKNEALLEKYDRYEYLSELDT

SEQ ID NO: 26122 - protein, 438 aa, Rhodococcus sp. RHA1
MNDVSLHQRHRAVMPDWLSTYYEDNPLELVSGSGRHVTGGDGRTYLDFFGGLLATMIGHDIPEITEALRRQAGQLLHSSTLYLIRSQVELAEKIAARAPVDNPRVFFVNSGSEAVETALLLTTTAQQSNQVIALRGSYHGRSFGTVATTGIRGWSATSLSPLQVTYAHSGYKYRSPFGHLDDHAFNTACRDELQTMIETSTSGNIACYLAEPIQGAGGFATPPDGFFLAMKEVLDAYDIPFVSDEVQSGWGRTGRSYFGIEHYGVRPEAITFAKGLANGLSIGGVVAENELMNCLTANSISTAGGNPIAMAAGNAVLDFIESHDLQANAADVGHLLSTGLQELATRHPLIGDVRGAGLMLGVELVENGTKKPAVAATNTILTQCRERGLLIGKGGLSGNVLRVTPPMTVTIEEAKQALGILDDVLSYVASRAEPQPIH

SEQ ID NO: 26123 - protein, 204 aa, Oryza sativa Japonica Group
MDTGNKGTATPVLLNVYDLTPANDYLYWLGFGVFHSGIEVHGMEYGFGAHDFPSSGVFEVESKSCPGFIYRKTVWLGTTDMSHGEYRSFIEKLAGKYHGNSYHLVSKNCNHFTDDVCKNLTGKPIPSWVNRLARVGSFFDCLLPESVQVSPVGRVPTLRPVADDDLDSISTVSDNNEEDKHLLPAPSNDLHSVDVPLKLAKDVL

SEQ ID NO: 26124 - protein, 286 aa, Sinorhizobium meliloti
MEFHGMGQQHQRSPASKPIVVKYGGHAMGNAELGRAFASDIALLKQSGVNPIVVHGGGPQIGAMLNKMGIESKFEGGLRVTDEKTVEIVEMVLAGSINKEIVALINQTGESAIGLCGKDGNMVFAEKAKKTVRDPDSNIERVLDLGFVGDVVEVDRTLLDLLARSEMIPVIAPVAPGRDGHTYNINADTFAGAIAGALNATRLLFLTDVPGVLNKKGELIKQLSVAEAHALIADGTISGGMIPKVETCIDAIKTGVQCVVILNGKTAHAVLLEILTEHGAGTLIVP

SEQ ID NO: 26125 - protein, 339 aa, Sinorhizobium meliloti
MSLLEKFERYPLTFGPTPIEHLPRLTAALGGKVEIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYRDG

SEQ ID NO: 26126 - protein, 137 aa, Zea mays
  misc_feature (45)..(45): Xaa can be any naturally occurring amino acid
MSAYCGKYKDELIKSAAYIGTHGKGILAADDFSETMGNRLSSINXDNPEENRRALHKLLFCCPDTIHYISSGILYQDTLYQNTKDGKPFDDVLKEGGILADIKVDKGTIEAAGTGNGNPTHGRDDLDKRCHHYYEGR

SEQ ID NO: 26127 - protein, 400 aa, Bacillus cereus ATCC 14579
MMTYTLATRMKAFQSSIFSELGAYKKEKIAAGHNMIDLSIGNPDMPPADFVRETMVHTASEKESYGYTLSGIQEFHEAVTEYYNNTHNVLLNADKEVLLLMGSQDGLVHLPMVYANPGDIILVPDPGYTAYETGIQMAGAISYYMPLKKENDFLPDLEVIPEEIADLAKMMILNFPGNPVPAMAHEDFFKEVIAFAKKHNIIVVHDFAYAEFYFDGNKPISFLSVPGAKEVGVEINSLSKSYSLAGSRIGYMIGNEEIVRALTQFKSNTDYGVFLPIQKAACAALRNGATFCEKNREIYQERRDTLIDGFRTFGWNVDKPAGSMFVWAEIPQGWTSLDFAYALMDRANVVVTPGHAFGPHGEGFVRIALVQDKEVLQQVVENIRNSGIFVLEKVNELVKN

SEQ ID NO: 26128 - protein, 174 aa, Synechococcus elongatus PCC 7942
MATITLPTWVTLTRLFAVPILLVGMEQPGLLPTWVPLVVFLLAAATDWLDGWLARRLNQVSDLGKVLDPLVDKLLVLAPLLVLVAQQVVPTWAVFLILARELTIAGWRVNQPKISGANLWGKLKTVVQIACDRAVIATPQSAFFTPRAGLLLDCRCSDLDLRLDLPATKQDYLG

SEQ ID NO: 26129 - protein, 625 aa, Robiginitalea biformata HTCC2501
MNLLSAENLAKSYGERTLFSGLTFGVNQGQKVALIARNGTGKTTLLDILAGKDSPDSGSVTYRKNLRRAYLEQHPDLNPDLTVAQTLFDTGNETVRILARYEEALEHPEDTRGYQRAFEAMERANAWDLETRFSQILSRLRLHDQKQRVSSLSGGQRRRLALAHALIEEPELLILDEPTNHLDLDMIEWLEEYFANRPVSLLMVTHDRYFLDRVCTDILELEGGELHHYPGIYQDFLREKEAREQIASTTAKKTRSLYKQELEWMRRQPKARTTKSKSRIEDFEELKKEALSRRKEREMELEINMERLGTKVVELHNISKSYDGRELFSGFTYHFKRGERIGLIGPNGSGKTTFLDLVTGNLESDTGKVVHGETLQFGYYTQHGLEASPGKKVIDAVREFGDYIPLKKGRQLSAQQLLERFLFDRKAQYDYIEKLSGGERKRLFLCTVLIQNPNFLILDEPTNDLDIVTLNVLEEFLLDFPGTLLIVSHDRYFMDKVTDHLFVFDGKGGIRDFPGNYSDYRLQAEVPSGAPAPEVSDAATSVTRDTPANSGARKGKRNYNQEREYRQLETEIGKLEARKREIETGFSDPSLPGEEMDRLSRELSDLLQELEEKTARWFELAAIEE

SEQ ID NO: 26130 - protein, 99 aa, Zea mays
TNDLPHMTFVSSRDDVGKCMAFYFAQGILQHDPFKVLDQRGVADLLNFATERGLNASPNLKVAICGKHGGKPSSVAFFTKAGLNYLSCPPFRVPIARLT

SEQ ID NO: 26131 - protein, 215 aa, Campylobacter fetus subsp. venerealis
LFFITVGMQINFEIIFENLLMIIVILVDVMVIKIAVVYALLATYLKKRVAIKTALSICQIGEFALAIFALLNVNNMLNSETSQILTAVVIISMVATPLILKNIGHLADRLEEESEIPEFEKLKVQDLSDHFIVCGYGRLGQEVVNRLKAQGLLYLVIESDISLVQLGRSRGENVFFGNATQKITLEKASIKTCAAIILTVSNEQKLEMIANSIKD

SEQ ID NO: 26132 - protein, 514 aa, Acidobacteria bacterium Ellin345
MATITHPYALSNPMSLLTDKPREEFTRADLLDVIEQKEIERITFHYTALDGKYKELKVPVANRRQAERILADGERVDGSSLFRDMVDVNLSDLYVVPVYKSAFLNPFGEPSLELTCRYLNVRGEMVDFAPDAILHNAAELFRRSTGCELWALGELEFFLLSDAGPSLFRLPMQRGYHASGPFVKSGAVLDEIVRLLTQITGAVKYAHNEVGCIDAVRSDLEEIRGKSAEQLEVEFLPAPVEDAGDFLVLARWLIRNVAYRHNCVATFTPKIEEGVAGNGLHVHMEVRRDGRNIMRDRGELSAEARQVIGGLCTYADSLTAFGNTVSSAYLRLVPNQEAPTRVCWSDLNRSTMIRVPLGWSEVGDLSRRINSQQLEESVNEDGRQTVELRSPDGSAFAHLLLAGITMAAEWGMTHEQSLQIAADLYTKGNIFHDETVLSRLRSLPRSCVESARILSEKRDFYERDGIFPASMIEYMAKLLRAEDDEGMNRKLIDLPADDRLHETRKIMHKDLHRH

SEQ ID NO: 26133 - protein, 1252 aa, Coccidioides immitis RS
MEKDTIKDRSQTKRQPFRDASNRLNIVHNSSRQTRYDHVALSSEKQMTSSDPPDALNGHDFPPATAENKRISAVLDYHSDPRRNSAISTTSTNSGRSRRKTHIGPWQLGKTLGKGSTGRVRLAKHSVTGQAAAIKIVSKQSAALAQSQSIAAMDKNIDVAPGSRTIPSGIEREVVIMKLIEHPNVISLYDVWENRGELYLVLEYVEGGELFDYVSERGPLPEIEAVRLFRQIIAALSCCHQYNICHRDLKPENILLDFRKNIKLADFGMAALQPAGHWLNTSCGSPHYASPEIINGQRYHGDKADIWSCGIILFAMLAGFLPFDGGDLANTLKLVKRGEYIIPPWFSPEAIDLIQRILQKRPENRISIDQMWLHPLLMKYQAHPIFANSPMDSIGPPPPLPSKDFKKIVTHRRDIDLEVLRSLQTLWHEKRKEDLIENLLNDKPNHEKLFYKALLKFREEQLENYEGPPLGYSSSDYHHISRPLFRLQRRMPSNHGESNVWRRSKFSIATNSSGMREGSSRGPTSAPTIASYDPYRSSRTAIAEPKVEYANVTIHRHQSNDSSAALNSKSSPPTGKLSMDRASVNMRSSPNGGPGTSSRRSSLASYQSRSSVGSHCQRAKSRHSYKRNVSFRHLRGHNPNRDDKRIGMPPGHSQYSLCQERNKMGKRESERVKRLSSERFSSPSLPSPPTCVRPATNKVGELEVGAKPRQSYQYWKEEARKVSQELEQICEEAFNSSSLSSSYTIETGSKYPESPVTSISTPGNLNRYYGQTNTKPVRGQTFESSSSYATRELAETRRRLIEHSKKARADGLPSHLSEVISHLDRLIEGKPSHSVAKNAALAAEAARPPHNVTRNLPSILEERHSVKDFLSGETTSSYIPPPLDLDVWEKKTIRVVPDSTNNLDNIRPLTIRKKRTTLELPTPSNESTSFSQPQRSLSQSLTRNRSTGRRSNTGRFFSGLEPIEENPKSSKKNEFRNSGDTRKWSRFKYRSQSYSDVGPPTPPKDDVPLSRQSSISHMTSGASQGTEEYPVVEDDNLNWIKKNKPVETGKKLLKLFGMKKREKAVHEFGQESNCFNISVTSLDNKDESDIFGTKNHFLSNTQNEAGSPTHPASSQNWFMKFFRIKAASKVIALNAPKARARKEVIKILREWKKYGMEGIRVDKQNSVIRGRVGELNFLRLRPVEFSAELFTVLEYGRHVSLSLIRLKQERGAASSFRKVVETLIAVLKQRKLLVEDTVKAKKMAKVLSLTGQ

SEQ ID NO: 26134 - protein, 522 aa, Trametes sp. 420
MAKFQSLLTYIILSLAATAFAGIGPKTDLTIADGDVSPDGFTRAAILVNNQFPSPLITGNKGDRFQLNVVDNLTNHTMLKSTSIHWHGFFQHGTNWADGPAFINQCPIASGHSFLYDFQVPDQAGTFWYHSHLSTQYCDGLRGPFVVYDPQDPHASLYDVDDDSTVITLADWYHTAARLGPAFPLGADSTLINGLGRSTSTPNAELAVIKVTKGKRYRFRLVSLSCDPNHVFSIDGHTLNIIEVDSINTEPHTVDNLQIFAAQRYSFVLTADQDVGNYWIRANPNFGTTGFADGVNSAILRYDGAAEDEPTTSQTPFSNPLVETDLHTLDALTVPGTATRGGVDLAINMAFNFNGTNFFINGASFTPPTVPVLLQILSGASAAQDLLPSGSVYALPSNADIEISLPATAAAPGAPHPFHLHGHAFAVVRSAGSSTYNYDNPVWRDVVSTGTPANNDNVTIRFRTDNPGPWFLHCHIDFHLEAHLSFRSLFLNPRRHGQVSVSAHLHHPLSRRDRVRWHRSKD

SEQ ID NO: 26135 - protein, 708 aa, Erythrobacter sp. SD-21
MGLLAVIYGFVTSRQVLSAGAGNEKMQEIAGAIQEGAQAYLKRQYTTIAFVGVVVAVLVGVFLGIIPVIGFVIGAILSGVAGFIGMNISVRSNVRTAAAAQSGLQQGLTLAFRAGAITGMLVAGLALLAIAVFFWYLTGPAGHAPNSREVIDGLVGLAFGASLISIFARLGGGIFTKAADVGADLVGKVEAGIPEDDPRNPAVIADNVGDNVGDCAGMAADLFETYVVTVGATMVLTALLFGDALGDLLMPMMALPLLIGGACIVTSIIGTYFVKLSKGGTNVMGAMYKGFLVSAILAIPLIWIVMNYALGGMGTELGGSTVGIDPGAPLAEEGTAEQVIGFTGWDLFWCALIGLAITGLIIWITEYYTGTNYRPVRSIAKSSETGHGTNVIQGLAISLESTALPTLVIVAGIIATFQLAGLMGIAYAATAMLALAGMVVALDAYGPVTDNAGGIAEMAGLDDSVREKTDLLDAVGNTTKAVTKGYAIGSAGLGALVLFAAYTTDLAEFFPNADVDFSLENPYVIVGLLLGALLPYLFGAMGMTAVGRAAGDVVKDVREQFAADAGIMAGTSKPDYARTVDLVTKAAIKEMIVPSMLPVLAPIVVYYAIFFLAGQENAFAAVGALLLGVIIGGIFVALSMTAGGGAWDNAKKYIEDGNHGGKGSEAHKAAVTGDTVGDPYKDTAGPAVNPMIKITNIVALLLLAALAA

SEQ ID NO: 26136 - protein, 496 aa, Arabidopsis thaliana
MAKPEEVSVPIFTSLEPVYGEGSLLQEATQRFDVLKANFNDVFGASPQLFARSPGRVNLIGEHIDYEGYSVLPMAIRQDTIIAIRKCEDQKQLRIANVNDKYTMCTYPADPDQEIDLKNHKWGHYFICAYKGFHEYAKSKGVNLGSPVGLDVLVDGIVPTGSGLSSSAAFVCSATIAIMAVFGHNFEKKELAQLTCECERHIGTQSGGMDQAISIMAKTGFAELIDFNPVRATDVKLPDGGSFVIAHSLAESQKAVTAAKNYNNRVVECRLASIILGVKLGMEPKEAISKVKTLSDVEGLCVSFAGDRGSSDPLLAVKEYLKEEPYTAEEIEKILEEKLPSIVNNDPTSLAVLNAATHFKLHQRAAHVYSEARRVHGFKDTVNSNLSDEEKLKKLGDLMNESHYSCSVLYECSCPELEELVQVCKENGPLGARLTGAGWGGCAVALVKEFDVTQFIPAVKEKYYKKRVEKGVVKKEDMELYLFASKPSSGAAIFNL

SEQ ID NO: 26137 - protein, 368 aa, Arabidopsis thaliana
MSSSNEPPRKTDQPSSSSASASASPSLFLSLPLEIISMILARVPKRYYPILCSVSKNMRSLVRSPEIHKARSLLGKDYLYIGFIDENYRPVYDYWYTLRRIENSTTENLFESIEFPYPSEPNRFSMNAVGPKIFFISESCTPSSRLSIFDTRFGELRQGPCLLVKRGYNCVGLVGGKVYVIGGYQDDEIAAESFDLNTQTWEAAPIPDEKESHRWICKANVSFDRKVCALRSREGMTCYDTRDGSCQRSEMPNDQWSRVGLCVIDNVLFVYFSRFGLMWYDSKLMLWRVVYGFDLDNARSVGIGEYYGKLAFIWEKPSLNVSESKEIWCRMIGLLRSEVGIHGAAEPSQLVEIVPNGYRMCHCLSLSG

SEQ ID NO: 26138 - protein, 494 aa, Sphingomonas sp.
MTSVSSSPITDTILNFIDGSYREGSEGKSFSNVNPATGAEIGVVHEASQADVADAVAAAKAALTGPWGKMTTAERVKLITAVATEIERRADDFLAAEVADTGKPRHVASHIDIPRGAANFRMFADVVSTMPGESFNTPTPDGGQAFNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLGYYRRAVEDGATVVTGGGVPEISGAEAGGFFVEPTLWIDVAHGDTVMREEIFGPCCGILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 26139 - protein, 348 aa, Brassica napus
  misc_feature (53)..(53): Xaa can be any naturally occurring amino acid
  misc_feature (325)..(325): Xaa can be any naturally occurring amino acid
MAPTGEKPLIVSFGEMLIDFVPTESGVSLAEAPGFLKAPGGAPANVAIAVSRXSAERSAFVGKLGDDEFGHMLAGILRKNGVADQGINFDTGARTALAFVTLKADGDREFMFYRNPSADMLLRPDELDLELIRSAKVFHYGSISLIVEPCRSAHLKAMEVAKEAGALLSYDPNLREPLWPSKEEAKTQIMSIWDKAEIIKVSDVELEFLTGSNKIDDETAMSLWHPNLKLLLVTLGEKGCRYYAKNFRGSVDPFHVNAVDTTGAGDSFVGALLNKIADDHSILEDEERLRKVLRFANACGAITTTKKGAIPALPSEAEVLSFLEXSRKQKTTLKLSPSKSVFAYVILL

SEQ ID NO: 26140 - protein, 338 aa, Treponema denticola ATCC 35405
MLKEIRGKSAKNLRGRSFLKLLDFTTDEIRYLLDLSKNFKDMKRAGIPHRYLEGKNIVLLFEKTSTRTRCSFEVAGYDLGMGVTYLDPNSSQMGHKESIEDTARVLGRMYDGIEYRGFSQELVETLAEYSGVPVWNGLTDLFHPTQMLADLLTIEEKFGYLKGLKFTYMGDARNNVANSLMIACVKMGMHFTACSPKHLFPTEDLVAEAKKIAAQTGGSVTLTENVSEGTKGAHVLYTDIWVSMGEPDSVWEERIKLLKPYQVNKAAMDNADKDAIFLHCLPSFHDLKTTKGQEINKKFGLPEMEVTNEVFESHKSVVFDEAENRMHTIKAVMYATMC

SEQ ID NO: 26141 - protein, 603 aa, Ostreococcus tauri
MGGAVRRTRAGRFGAASATETAKAEDDEVASAEVGVSVGASAMGGAEDEASGTACPYTAAKEALGLAPPPPTRRDENGNPAMVDNVSFLKSLIKASQHPVGMPIAMLDWAAEKGECVGIKNAIGPFCVSILDPEIVEYVCFTNAKNYRLRMLPDAFRYVIQNKGITGSDGQYNRDHRLMCQKPFINSFSLAEFSSTVEERIAHMCNTWQQAHAMGGGKPYEINIDYDSQQVTLDVIGKVAFAYDFKRCEAHEAKTLRGEADEDGNVSKLLAAYNGSSEIMGELFITPGPILKLQNFLGLGRVRELKEQYAILESVGTKLMSERRAIVKERLAAGDEEDYCLLDVLVKAKDADGQPLSDADLWGDINDIMAAGHRTTASNFTVNLWHVARYEHIQEQIEKEVAALGGRPPTFQDVQEGKLPYTQRVVKESLRKYAPINLFPRLAEGPDTLPSGHKVEEGDFILLSTYAMGRNPRVWEDPNKFDPDRFTDEALYAQAEKQASAVARGDPAKLEQARERMRRRMNAGRDFTYTPFGAGPRSCIGGVFALLAATTMLASTVQKFKLSKASHSKGAVGEELNIMYDTTICFPEGVWINLEPRERPLGA

SEQ ID NO: 26142 - protein, 351 aa, Rhodococcus sp. RHA1
MKAIRVHEYDRTPSLDDVPEPVVKGPFDVIVKVRGAGVCRTDLHIIEGQWQTKSGVALPYTIGHENAGTVTEIGSAVTNVAVGDSVILHPLATCGLCLACRRGDDVHCTDSEFPGIDVEGGMAEYLRTSARSVVKLAPSLEPADVAALADAGLTAYHAARKAAEHLRPGHNVVVIGAGGLGHIGIQVLEALTSARIIVVDQSAPALELAKEVGADATVVADGTEAEQVLALTDGDGAEAVLDFVGEGSALASGVGMLRRAGNYYVIGYGGTLEIPTIDIISTEINFIGNLVGTYNDLVELMALAAQGRVHLHTVKYRFSDFQQALDDLHHGAVRGRAVLVPDDEFTATTRG

SEQ ID NO: 26143 - protein, 401 aa, Physcomitrella patens subsp. patens
LSFQIEDLPGGPEAFELVARFCHRRTCINVTSANVAMLRCAAEFLGMTETMTSENLIRITEEYLRAVVLGSWEESLAVIRTCDEFNQSAEKTQLIQRCASALADKTSPTATFAVDLASSPLHPTTDAYLASYFVSTPSGNSSHRSSKAVSETWWFDDLSTLSVHLVEPIVRYMIIHKPADSRVIAKFLLHYLRSALPVHGYSATIQREVVEVVVNLLANLERKSVSCRSLLGLRRIAVAVRAGKHCRRDLERMIGRQLEKATLDNILIPALPPRSSSLYDVDLVLRLVEFFLKEKADALTPLQTSLLKVGQLMDKYLAEIAADAYLKPSKFLALAESLPDYARQSDDGLYRAVDIFLEAHPFVSETDATRLFKVLNYHKLGPETCKAAAQNPRFPPSFAIQ

SEQ ID NO: 26144 - protein, 412 aa, Oryza sativa Japonica Group
MEAKLSAASRRVAPSPIQQLSHLAQRAGAVNLAEGFPDFPAPAHVKAAAAAAIAADLNQYRHVQGICDALAETMKRDHGLRVDPLTDFAVCCGQSEAFAAAIFAIIDQGDEVLLFDPAFETYQTCIELARGVPVYVPLDPPSWTLNEDKFLKSFTNRTKAVVLNSPHNPTGKVFSREELLIIAQACQKMDCFAITDEVYEYITYDENKHISLASLPGMQERTIITSSLSKTYSVTGWRIGWACAPANIASAIRNIHVKLTDSAPAPFQEAALVALTSPPDFYSSLKQDYTARRDFILQVLTDFGFRISFKPQGSIFVFVELPRSWQLSDMDFVTNLIKNAGVAAVPGRGFFHSSTDDPSYHHRYVRFAFCKSNDTLNAAAEKMRKLAVSHDARLLRPTDDGEAGQTASATSP

SEQ ID NO: 26145 - protein, 592 aa, Ostreococcus tauri
  misc_feature (1)..(1): Xaa can be any naturally occurring amino acid
XPPRWAGAPLCAPRATYRARAVASDAGRRGVTTGALFIAHRPDVDVVPPRASMATRARAGGGESARARVEGSSARARLGRSGGGGGGVRGRRTLVSASISLGRARGGTRARSAAEKESEGRVTDGASDRTSSSIVEAEIVDGEVLDVMGRREAESSGVTSGTTLFGVPMSPEVYAIALVYLISTSRCADLGPSETAMILSIAQTPWLVKPLWGFLSDSVPIFGYRRKSYLLLCGAIGCLGWSSMATWVDSPETALVAFTLGSLSIAFSDVLIDSIVVAKARGEEQGVSGSLQSLCWGFVALGSIVSSYFSGSLIETYGTRFVFGATAMFPLLIAGASTLVQEKSVPATTRSRDGVIGDFKEMTGKIFKVAKRREIWAPALFVFLYQATPSAGTAMFYFNTNELGFTPEFLGRVSLLRAIAALGGVALYNGYLKRVPLKKMFFWGTVAGTVLGSTQLLLISRMNLELGISDKVFALTDTAVLTVLGEVSFLPVLVLAAKLCPEGVEATFFAALMSLFNAGGVTSEFLGAGLTKQLGVTADNFDNLFLLASICIVCNLLPLAAINLPRTIGKVWSNRGLEPRDGVPARPVEPFF

SEQ ID NO: 26146 - protein, 184 aa, Physcomitrella patens subsp. patens
MASVVASAVAAPVSLGAAASSVAASNESATVKAFSGLKPATLFSSKTQKLGAVQNGSRVQCMQVWNPIGQPKFETFSYLPPLTDDQIAKQVDYMIQQNLIPCIEFDTVGSVSRTNFSGAGSSGYYDGRYWTMWKLPMFGCTDSSQVLREIQECKSQFPSCWVRVLGFDSKKQVQICGFLVSRPN

SEQ ID NO: 26147 - protein, 339 aa, Oryza sativa Japonica Group
MLVQPPNAVAVRATAAGKEPLFSFGVIADVQYADIPDGRSFLGVPRYYRHSLTILQRAVRSWNAHNHKHPVAGGGVRFCVNFGDIVDGFCPKDRSLAAVQAVVAEFDRFHGPAYHMLGNHCLYNLPRSKLVSLLRMPSGRAYYDFSPFPGYRFVVLDAYDFSAVGWPRGHPVAAAARRFLDERNPNADKNSPSGLAGVDRRFVMFNGAVGEAQLRWLDGVLRGAARRREAAVVCSHLPLHPGAASPSGLMWNYEEVMRVVHRHGCVAACLAGHDHRGGYGVDARGVHHRTLEAALECPPGTDAFGRVDVYPDGLTLVGAGRMGSTDMRLQLHSPVTELS

SEQ ID NO: 26148 - protein, 525 aa, Campylobacter jejuni subsp. jejuni NCTC 11168
MVEVKNLTMRFANQLLFENVNLKLVRGQRYGLIGANGAGKSTFLKILSGEIESSSGEIVFDEGLKIAVLGQDQFAFENYTIKDAVMCANKRLYEALKEKEKLYMSEEFTDEINERLGELEIITAEEDPNYDCETRCEKILSSLKIKDFDALMSTLQSADKFKVLLAQVLFLGADALFLDEPTNNLDLEAISWLENELLRHEGTLVVISHDRHFLNKICTRILDVDFKQIRDFAGNYDDWYMASTLLAKQAELKRDKTLKEREELENFIRRFSANASKAKQATSRAKALEKLELEEIKISSRRDPSIVFRTNREIGNEVLEIKGIGKAYDKQLFSNLELKIEKNDKIALIGANGVGKSTLAKIIAHAISPDSGSIHLGATIELGYFPQDTSNLICENLKLYEWLMSEKFKDLDEIRKCLGRMLFSGSDQEKMAASLSGGEKHRLMLSRLMLERPNFLLLDEPDNHLDLESIIALGEALYNFKGVVLCISHDRELVSAFANRIWHLENGKLTDFRGTYQEFLGENDG

SEQ ID NO: 26149 - protein, 411 aa, Synechococcus elongatus PCC 7942
MSESLESLARLAHWRHELRTPINAILGYSQLLLEDWAGTAIATDLERIESAGQELLRLVNEILDPHSSDRGLSLDTYQARLRYALRTPVNTVCGYVELLLEEDSPELAESRVDLERISAAGERLLEQLEAMAAWDQPASQASAVALSEMEVEVAESVLRYRQAAVSASAVTGGRLLVAEDNEINRDVLERRLRRLGHDVVCVASGQEALNQLAQQPFDLLFLDVMMPGLTGFEVLQQLKADPTLAELPVLMISALDDLESVIRCLRLGATDYLTKPFEPTLLQTRLETCLQHKRLRDRELDYLRNVAIVTDRRWPVEAGDYDRDRLQTVAERSDALGQLARMFRQMTRSVEQRETQLKQTIRRLELQIDTATVKSQVKEITESDYFRDLESRARQIRRDRSYRSSPPDRHA

SEQ ID NO: 26150 - protein, 388 aa, Physcomitrella patens subsp. patens
LFEQACNNILKVQFPLKCANGTVELIEAYRAQHSHHRLPVKGGIRMAPNVDADETMALAALMTFKCAVVDVPFGGAKGGIKIDPTKYSANEKEAIIRRYTSELVRKNFIGPSIDVPAPDYGTGPQEMAWIKDTFEHLQPNDINGSACVTGKPLEEGGIDGRQEATGLGVYFCLREFLNDEALVAKLGLTTGIKGKTFIVQGFGNVGRHTIDSIYGAGGKIIAIAEVDGGLVAECEDGIDIPGLKAYYKKKGTITGYPGAKTVKFAQGILELPCDVLIPAALETQIHSGNAGNIKAKIVAEAANGPVTPLAETMLEDNDVVILPDLLLNAGGVTVSYFEWLKNLNHIHFGRMSRRMEERGKTALIDALENQFGNGHRFSDEVRSQVVKG

SEQ ID NO: 26151 - protein, 323 aa, Synechococcus sp. WH 5701
MGPHFTQSYPGLAGLRGRDLLSSADLDAEQTLALLKLAADFKSGSLRLDLSGKSLGLIFTKASTRTRVSFSVAMGRLGGQVLDLNPSVTQVGRGEPVADTARVLSRYVNALAIRTFEQQELAEYAHWASIPVINALTDLEHPCQALADVLTIRESFGSLKGLTMAYVGDGNNMAHSLMLCGALLGINVRVACPEGFAPDPAVLAQAQALAGRAATVSVLHEPVPAVRGAEVLYTDVWASMGQEQEQQQRLQAFAGFCVDEALLAEADPRAIVLHCLPAHRGEEISAGVIEGSASRVFDQAENRLHVQQALLAALLADPETPCL

SEQ ID NO: 26152 - protein, 271 aa, Erythrobacter sp. SD-21
MSFEGKTAWITGASSGIGAALAQEWASRGANIILSGRDEGRLSAVADRLDTETLTLPFDVRDEEAMRQATDTATGWKDGVDIFVANAGISQRSPAVDTDMQVYRDIIDIDLTSQIAASQALLPHMTGRGSGKLLFISSIAGKVGVPMRTAYCAAKHGLIGYADALRGELSQSGVDVHVICPGSVATDVSRNALNGDGTKRGRSDKVIDNGIAPDDAARRIVDAVELNQREIIVAEGMEEAMGEMRRTPDQLFDQVSGMVAAGYMEKMQAEE

SEQ ID NO: 26153 - protein, 456 aa, Mannheimia succiniciproducens MBEL55E
MTKHYDYISIGGGSGGIASINRAAGYGKKCAIIEAKHLGGTCVNVGCVPKKVMFYGAHIADAINHYAEDYGFDVSVNKFDFAKLVESRQAYIGRIHTSYGNGLSKNKVDVFNGFARFVDAKTVEVSYEDGSSEQITADHILIATGGRPSIPNVKGAEFGISSDGVFALNELPKRVAVVGAGYIAVELAGVFNSFGVETHLFVRQHAPLRNQDPLIVDTLVEVLVQDGIQLHQKAIPQEVVKNADGSLTLKLEDGRETVVDSLVWAIGREPATDVINLQAAGVETNDRGFIKVDKYQNTNIPGIYAVGDIIEGGIELTPVAVAAGRRLSERLFNNKPDEHLDYNLVPTVVFSHPPIGTVGLTEPKAIEKYGAENVKVYTSSFTAMYTAVTQHRQPCRMKLVCAGADEKIVGLHGIGFGVDEMIQGFAVAIKMGATKADFDNTVAIHPTGSEEFVTMR

SEQ ID NO: 26154 - protein, 137 aa, Thermus thermophilus HB27
MERTFVMIKPDGVRRGLVGEILARFERKGFRIAALKLMRISQELAERHYAEHREKPFFPGLVRFITSGPVVAMVLEGPGVVAEVRKMMGATHPKDALPGTIRGDFATTIDENVIHGSATLEDAQREIALFFRPEELL

SEQ ID NO: 26155 - protein, 420 aa, Thermus thermophilus HB27
MEVKLPELGDNVTQATVVGVLVKEGDRVEPGQPLLELETDKAVVEVPAEAGGVVKRVLVKVGDEVRPGQPFLELAEAEGGAEAPPLKAEERPEAPAPKAEEAPRPAPKEAPPAPQEAPSERRLIPAAPSIRRLARELGVDLTRLRGTGLAGRITEEDVRRAAGLGEAAPAALPAAPAPRLPDFTKWGPVRREPMSGVRKATVRSMSQAWAQVPMVTHFDEADVTELEALRKQYAKKAEEKGFRLTLTAFLLKALALTLKAFPKFNASLDVEAQEIVYKDYIHIGVAVDTPHGLLVPVIRDVDRKGVLRLAEELQEISQRARERKLSPEEMQGATFSLSNLGGIGGTGFTPIVNWPEVAILGVSRSQMKPLWDPGKEAFVPRLVMPFSLTYDHRLIDGADAARFCRHLAGILEDPLGLALA

SEQ ID NO: 26156 - protein, 340 aa, Sinorhizobium meliloti 1021
MTMTAAVVREFGKPLVIEEVPVPQPGPGQVLIKYEATGVCHTDLHAAKGDWPVRPNPPFIPGHEGVGYVAKLGAEVTRLKEGDRVGVPWLHTACGCCTPCRTGWETLCGSQQNTGYSVDGTFAQYGLADPDFVGRLPARLEFGPAAPVLCAGVTVYKGLKETEVRPGEWVLVSGIGGLGHMAVQYAKAMGMHVAAADIFPDKLALAEKLGADLVVDARAPDAVEEVQRRTGGLHGALVTAVSPKAMEQAYSMLRSKGTMALVGLPPGQICLPVFDTVLKRITVRGSIVGTRQDLEEALEFAGEGKVAAHFSWDKIENINAIFERMEEGKIDGRIVLDLNG

SEQ ID NO: 26157 - protein, 293 aa, Francisella tularensis subsp. holarctica
MSSENIIKDFEIFAEKVFDQLNCVSKTLLSAMHYSFFSGGKRIRAQFVYAIGEALAIDKSNCDKIAFAVESIHTYSLIHDDLPAMDNDTLRRGKPTCHIKFNEATAILAGDALQALAFEILQDINYSDIDKLKKINKLFAQYCGASGMVGGQQLDIEGENKKLKIEELQILHINKTAKMFRACIVLPYILSQNQNSQIEDLLVRLSDLIGLCFQIKDDILDVTKTTNELGKTSAKDIDANKSTYVSLMGLKDANKYLLDKKNEITQIITKLKNNNFSSTSLENLIDLVINRNC

SEQ ID NO: 26158 - protein, 392 aa, Clostridium perfringens SM101
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNKEELQKIVDVLKDKDVIIISDEIYAELSYDEDHVSIASFPEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 26159 - protein, 251 aa, Magnaporthe grisea 70-15
MAPQAIIAPSILSADFGNLGEECSKTIGQGADWLHVDIMDGHFVPNITFGPPVVAKIRGHVDRPEAAHGKGTFDCHMMIAEPKKWVKEFKAAGCDLYCFHYEAAFSSAAEEPSATSDAKTSPRELIRYIHDQGLLAGIAIKPATPADVLYELLDSSDAAERPDMVLVMTVEPGFGGQKFMASELPKVQALRQRYPELNIEVDGGLGPGTIDQAADAGANVIVAGSAVFGAKDPAEVIKVLRESVQKRAGKI

SEQ ID NO: 26160 - protein, 274 aa, Francisella tularensis subsp. holarctica
MKICFIGGGNMAAAMIAGMTSHGYKSQDIIVFDRNEHKCLNLIKKYNINTSTSLLNTIKLADILILAIKPQNMFELIKNIRDTVTSTQVIVTVAAGIQTSAYEELFNKEISFARTIPNTPSSLGYGATGIFFNKVIAADKKDLVIDIMQTIGVVTVVEDEKEIDIIAAIASSGPAYYFQFMEHMVEAAIKQGLDKKQAEKLVVQTCLGAAQMALNTNENMSELRKNVTSKKGITYEALNIFEQFNLGGIVDKAIQANIARAQQLAIEFTKLIDN

SEQ ID NO: 26161 - protein, 112 aa, Arabidopsis thaliana
  misc_feature (2)..(2): Xaa can be any naturally occurring amino acid
  misc_feature (27)..(28): Xaa can be any naturally occurring amino acid
  misc_feature (31)..(31): Xaa can be any naturally occurring amino acid
  misc_feature (39)..(39): Xaa can be any naturally occurring amino acid
  misc_feature (43)..(44): Xaa can be any naturally occurring amino acid
  misc_feature (47)..(49): Xaa can be any naturally occurring amino acid
  misc_feature (55)..(55): Xaa can be any naturally occurring amino acid
  misc_feature (57)..(58): Xaa can be any naturally occurring amino acid
  misc_feature (63)..(63): Xaa can be any naturally occurring amino acid
  misc_feature (66)..(66): Xaa can be any naturally occurring amino acid
  misc_feature (69)..(69): Xaa can be any naturally occurring amino acid
  misc_feature (76)..(77): Xaa can be any naturally occurring amino acid
  misc_feature (81)..(81): Xaa can be any naturally occurring amino acid
  misc_feature (84)..(84): Xaa can be any naturally occurring amino acid
  misc_feature (86)..(87): Xaa can be any naturally occurring amino acid
  misc_feature (92)..(94): Xaa can be any naturally occurring amino acid
  misc_feature (96)..(99): Xaa can be any naturally occurring amino acid
MXSSMLSSATMVASPAQAIMVAPFNGXXSSXAFPATRKXNNDXXSFXXXGGRVNXLXXWPPIXKEXFLXFFFYFFXXTDSXWGXGXXYFIRXXXFXXXXFSCCFFGGFLLFG

SEQ ID NO: 26162 - protein, 207 aa, Chlamydomonas reinhardtii
YRAMLVDAAGTFLIPTEQVADVYLRYARPHGCMLEEGEVLSRFRRAYNMPWKASSLRYVGDARDFWHCIVANSTGCDRPEVSEAIYEYYSRPEAWRVAPGAVAALQRLRDAGVLTAVVSNFDTRLRPLLRDLAVQGLFDEVVVSAEVHAEKPNPVIFDAAIRALSAAAVVHVGDDRRNDCWGARDAGITAWLWGYDVRSWEQVAQRV

SEQ ID NO: 26163 - protein, 287 aa, Silicibacter pomeroyi DSS-3
MKTRDMNRDWIATAATLNAALPYLQRYDDAIVVIKLGGHAMGSDEAMESFARDVVLLRQVGVNPVVVHGGGPMINAMLKKLDIQSEFVNGKRVTDVATVEVVEMVLSGVVNKRIVQEINRQGGKAVGLSGKDANLMICDQTNPDLGFVGTPTEMNPDLLRNLFAHDIIPVIAPLGAGREGETFNVNGDTAAGAIAAALKADRLLLLTDVSGVKNGEGEVLTELKAGQIREMIADGTIAGGMIPKTETALDALDNGVRAVVILDGRVDNAVLLELYTEHGAGSLIRRD

SEQ ID NO: 26164 - protein, 639 aa, Ostreococcus tauri
  misc_feature (364)..(370): Xaa can be any naturally occurring amino acid
METLPTRRAVARVGQHASGEERTEQGWESGAEGFVQDVLDDGERDAKRERKGERESDRARGGGDATPFLIAVDEKLVPDYYSVIERPMAVVTMREKLMRGEYLSKDMFLEDLRLIESNAVVYNGSDSVFAKMARAVVGRGEELLSHMPRVDFVTCVRAAEYAEKLVNEPMLDTSNDMDMDDDDEDDDAETKAWRERTLAKRVRRVFRAEALAGLPIGQRRALPRRSALGMDAFMRSSDDHSKCWPEADDANRARRPEDDDFVADAVPTVPRYAACASVARIEDIRADLSVVALKIALDDRRPIPGVGTRSITNVAARALEELAHECVSRVARAVADRPHKRPRDDHDDRNLFLRCWSRSRPMSXXXXXXXHWVPSEKPSRPLDTVVLPTGARDMIERDVREFLDSERWYVDRGLPYRRGYLLHGLPGTGKTSLVFALAGHFGLPLYVVRLSDERLCDEGLHRLFRTTEKRSIILLDDVDAPGANAVFRELQPGESTGNLSVQSTLSLLDGVTSVDGRLIFLSCRDKSALNQTLIRPGRFDVILRFDAPGKEQIESYFNHFFADFGGDVPSMGAEFAELAGHVDTQPKSMGALQVLFLSHKSNPRDALESMRARISGQKRSITFGARSRNSRRDHSAAAA

SEQ ID NO: 26165 - protein, 507 aa, Mycobacterium avium subsp. paratuberculosis K-10
MTVFARPGSAGALMSYESRYDNFIGGQWVAPARGRYFENPTPVTGQTFCEVARSDEADVDKALDAAHAAAPAWGKTAPAERAAILNKIADRIEENLESLAVAEVWDNGKPIREALAADIPLAADHFRYFAGALRAQEGSLSQIDDDTVAYHFHEPLGVVGQIIPWNFPILMGAWKLAPALAAGNAVVLKPAEQTPVSVLYLMSLIGDLLPPGVVNVVNGFGAEAGKPLASSNRIAKIAFTGETTTGRLIMQYASQNLIPVTLELGGKSPNIFFSDVMAKADDYQDKALEGFTMFALNQGEVCTCPSRSLIQADIYDEFLELAAIRTKAVRQGDPLDSETMLGSQASNDQLEKVLSYIAIGKDEGATIITGGERAELGGDLSGGFYMQPTIFAGNNKMRIFQEEIFGPVVAVTSFTDYDDAISIANDTLYGLGAGVWSRDGNTAYRAGRDIQAGRVWVNCYHAYPAHAAFGGYKQSGIGRENHKMMLDHYQQTKNMLVSYSNKAQSFF

SEQ ID NO: 26166 - protein, 317 aa, Streptococcus pyogenes M1 GAS
  misc_feature (4)..(4): Xaa can be any naturally occurring amino acid
  misc_feature (31)..(31): Xaa can be any naturally occurring amino acid
  misc_feature (45)..(45): Xaa can be any naturally occurring amino acid
  misc_feature (95)..(95): Xaa can be any naturally occurring amino acid
  misc_feature (101)..(101): Xaa can be any naturally occurring amino acid
  misc_feature (172)..(172): Xaa can be any naturally occurring amino acid
  misc_feature (174)..(174): Xaa can be any naturally occurring amino acid
  misc_feature (176)..(176): Xaa can be any naturally occurring amino acid
  misc_feature (192)..(192): Xaa can be any naturally occurring amino acid
  misc_feature (216)..(216): Xaa can be any naturally occurring amino acid
  misc_feature (239)..(239): Xaa can be any naturally occurring amino acid
  misc_feature (261)..(261): Xaa can be any naturally occurring amino acid
  misc_feature (278)..(278): Xaa can be any naturally occurring amino acid
SNAXDPNVITVTSYANIAIIKYWGKENQAKXIPSTSSISLTLENXFTTTSVSFLPDTATSDQFYINGILQNDEEHTKISAIIDQFRQPGQAFVKXETQNNXPTAAGLSSSSSGLSALVKACDQLFDTQLDQKALAQKAKFASGSSSRSFFGPVAAWDKDSGAIYKVETDLKXAXIXLVLNAAKKPISSREGXKLCRDTSTTFDQWVEQSAIDYQHXLTYLKTNNFEKVGQLTEANALAXHATTKTANPPFSYLTKESYQAXEAVKELRQEGFACYFTXDAGPNVKVLCLEKDLAQLAERLGKNYRIIVSKTKDLPDV

SEQ ID NO: 26167 - protein, 547 aa, Streptomyces avermitilis MA-4680
MRKTRKAHGDKVILDDVTLNFLPGAKIGVVGPNGAGKSTVLKIMAGLEQPSNGDAFLSPGYTVGMLLQEPPLDESKTVLENVQDGAAEIMGKLKRFNEVAELMATDYSDALLEEMGKLQEDLDHANAWDLDAQLEQAMDALGCPPGDWPVTNLSGGERRRVALCKLLIEAPDLLLLDEPTNHLDAESVQWLEQHLAKYDGTVVAVTHDRYFLDNVAGWILELDRGRAIGYEGNYSVYLEKKQSRLKVEGQKDAKRAKRLKEELEWVRSNAKGRQAKSKARLTRYEEMAAEADKMRKLDFEEIQIPPGPRLGSIVVEVNNLSKAFGEKVLIDDLSFTLPRNGIVGVIGPNGAGKTTLFKMIQGLETPDTGTIKVGETVKISYVDQSRENIDPKKSLWAVVSDELDYINVGQVEMPSRAYVSAFGFKGPDQQKPAGVLSGGERNRLNLALTLKQGGNLLLLDEPTNDLDVETLSSLENALLEFPGAAVVVSHDRWFLDRVATHILAYEGDSKWFWFEGNFESYEKNKVERLGPDAARPHRATYKKLTRG

SEQ ID NO: 26168 - protein, 300 aa, Persea americana
MVPSSPILFSSKPPCPFLPIPSKPIKLIHLSTSSSSWVSFKKSPSPSSRSLTTLVAQTSDWAQQEEDSNVAEATLSDWEGEGEGEGEEQTESGAEDGEESGGDGFVEGGEEDSYPLPPEEAKLFVGNLPYDVDHQALAELFDQAGTVEVAEVIYNRETDQSRGFGFVTMSTVEEAEKAVEMFNRYDINGRLLTVNKAAPRGARVDRPPRAFEPAFRMYVGNLPWQVDDARLEQVFSEHGKVVEARVVYDRETGRSRGFGFVTMSTQTELDDAIAALDGQSLDGRAIRVNVAEDRPRRASF

SEQ ID NO: 26169 - protein, 431 aa, Mycobacterium avium subsp. paratuberculosis K-10
MTSHYDVVVLGAGPGGYVAAIRAAQLGLSTAIVEPKYWGGVCLNVGCIPSKALLRNAELAHIFTKEAKTFGINGEATFDYGAAFDRSRKVAEGRVAGVHFLMKKNKITEIHGYGRFTDPHTLAVELNDGGTETVTFDNAIIATGSSTRLVPGTSLSANVVTYEEQILSRELPESIIIAGAGAIGMEFGYVLHNYGVEVTIVEFLPRALPNEDADVSKEIEKQFKKLGVKILTGTKVESISDDGSQVTVVVSKDGNSQELKAAKVLQAIGFAPNVEGYGLEAAGVALTDRKAIGITDYMRTNIEHIYAIGDVTGKLQLAHVAEAQGVVAAETIAGAETLALGDYRMMPRATFCQPNVASFGLTEQQARDEGHDVVVAKFPFTANGKAHGVGDPSGFVKLIADANTVSCWAGTWSATTSPSCCRSSPWRRSGT

SEQ ID NO: 26170 - protein, 409 aa, Haemophilus influenzae R2846
MTIEILVPDLPESVADATVATWHKKLGDTVKRDEVIVEIETDKVVLEVPALSDGVLAEVVQAEGETVVSKQLLGKISTAQEGDVSSATLKATNEPTPSDRQNAAIENSHNHNADQSPAIRRLLAEHDLQADQIQGSGVGGRLTREDIEREIAKRQAQQVKQEAATEQNTISTVAYSARSEKRVPMTRLRKRIAERLLEAKNSTAMLTTFNEVDMQPIMTLRKTYGEKFEKQYGVRLGFMSFYIKAVVEALKRYPEVNASIDGDDVVYHNYFDISIAVSTPRGLVTPVLRDCDKLSMAEIEKQIKALAEKGRDGKLTVEDLTGGNFTITNGGVFGSLMSTPIINPPQSAILGMHAIKERPIALNGQVVIHPMMYLALSYDHRLIDGRESVGFLVTIKELLEDPTRLLLEI

SEQ ID NO: 26171 - protein, 315 aa, Persea americana
MANTSISPLSTLFCPKTLIPFLSIPSKAKLLHLSHSTSSVPSWVSLKSKLSSSGGSFIALVARTSDWARQDGDNEIGEAGFDWEGEGTEAQVSDWEGEVEEDGEVLGESGAEDEEESGEVGFADEEDSYSAPPEEVKIFVGNLPFDLESADLADLFNKAGVVESAEVIYNRETDQSRGFGFVSMSTVEEVVKAIEMFDRYDINGRTLTVNKAAPRGSRAERPPRDFEPAFRVYVGNIPWQVDNLRLEQLFSEYGKVEEARIVFDRETGRSRGFGFVTMSSQIEMEDAIAALDGSDLDGRAIKVSMAQERPRRGHF

SEQ ID NO: 26172 - protein, 172 aa, Brassica napus
MVVEEQNLESGGSVRVVIKGESHLRNVLWGPVRWIKMLAKELHWSFVFGVVSLYGINQGLGGSLGRVATEYYMKDVQKVQPSESQALTAITKIPWIIKPLWGILTDVLPIYGFHRRPYFVLAGVLGVVSMLFISVLGNLHLYLALLWMTIASAAMAIADVTIDACTAYNSIK

SEQ ID NO: 26173 - protein, 253 aa, Borrelia burgdorferi B31
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYSKSASDNIIIQYGGSVNSNNVKELMNEPNIDGALIGGASLKAESFLSIINNVL

SEQ ID NO: 26174 - protein, 484 aa, Alcanivorax borkumensis
MKIANLAEVGATNAPTADTIDSVFSALQRAQLARRASFTLDVRIAQLNKLRDSLKRHESNIIAACAADFKKPAPEVKLTELLPVLQEIRHAKKHLRKWMRPKWAPASIGVLGTKSHVRPEPKGVCLIIAPWNYPLNLALGPLVSALAAGNSVIIKPSEMTPHTSKVIANIVAETFPPDLVSVIEGDAAVSQKLLALPFDHIFFTGSPAVGKVVMEAAAKNLCSVTLELGGKSPTVVGPNANIKKAARNIVWGKFANNGQTCIAPDHVFVHSNIAAQFNQALQKEIGRVYGKTLEAQKSTADYCRIVNRRHFQRISNLIDDAKSKGAKIFEGGAIDTDQNFIAPTLISNVSNDMDITREELFGPILPIIEYDDIDSVIEQINDNPKPLALYIFDEDKSFAKHIVEQTSSGAVGINLTVVHFLHPNLPFGGVNHSGIGAAHGEYGFRSFSHDKVLMEDRHSLIHLLFPPYTGWVRQLINAAVRILG

SEQ ID NO: 26175 - protein, 393 aa, Borrelia burgdorferi B31
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYLPSVGGFLMEKEDKFLGGILKNPERPFVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 26176 - protein, 183 aa, Zea mays
  misc_feature (52)..(52): Xaa can be any naturally occurring amino acid
  misc_feature (82)..(83): Xaa can be any naturally occurring amino acid
MKVAFAAVLLICLVLSSSLFEVSMAGSAFCSSKCSKRCSRAGMKDRCMKFCXICCSKCNCVPSGTYGKQHECPCYRDMKNSXXQAKCPLIFFFFTITHQLQPFDQSLPCMYISTLEISHMDPASWICLLLYWGLGITKEEKLAKKKKKKLSIRPPQGGPGPNPPKGEPFTPPLGRLFKTRGWK

SEQ ID NO: 26177 - protein, 335 aa, Borrelia burgdorferi B31
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRVVDLAQKLVK

SEQ ID NO: 26178 - protein, 507 aa, Aspergillus nidulans FGSC A4
MDFAKLLVASPEVNPNNRKALTIPVLNPFNTYGRVFFFSWFGFMLAFLSWYAFPPLLTVTIRDDLDMSQTQIANSNIIALLATLLVRLICGPLCDRFGPRLVFIGLLLVGSIPTAMAGLVTSPQGLIALRFFIGILGGTFVPCQVWCTGFFDKSIVGTANSLAAGLGNAGGGITYFVMPAIFDSLIRDQGLPAHKAWRVAYIVPFILIVAAALGMLFTCDDTPTGKWSERHIWMKEDTQTASKGNIVDLSSGAQSSRPSGPPSIIAYAIPDVEKKGTETPLEPQSQAIGQFDAFRANAVASPSRKEAFNVIFSLATMAVAVPYACSFGSELAINSILGDYYDKNFPYMGQTQTGKWAAMFGFLNIVCRPAGGFLADFLYRKTNTPWAKKLLLSFLGVVMGAFMIAMGFSDPKSEATMFGLTAGLAFFLESCNGAIFSLVPHVHPYANGIVSGMVGGFGNLGGIIFAIIFRYSHHDYARGIWILGVISMAVFISVSWVRPVPKSQMRE

SEQ ID NO: 26179 - protein, 395 aa, Bacillus halodurans C-125
MKTFEQAKMMKRLPEQFFAKLVEQVQEVKKDHDDIINLGQGSPDLPTPEHIVEKLQEAAENPLYHRYAPFSGYPFLKEAVSKYYEREYGVSVDPKTEVAVLGGAKTGLVEVSQCFLNPGDMALVPDPGYPDYWSGIAIAGGSMYGMPLKKELGFHPDLRGIPAPVLYEAKLMFLNYPNNPTGAVATEELFAEAIELAEEYDICVVHDFAYSAIGFDGQKPLSFLQVEGAKNVGIEMITLSKNYNMAGWRIGFAVGNPSVIKAIETLQDHYFCSLFGGIQAAAAHALLSDQSNVTTLVQTYEERRNALVKAARAIGWDVEAPKGSFFAWFPVPSGFTSEEFATYLLKKARVVVAPGKGFGEHGEGYVRVALLADIAKLEEAMGRVGKLDVFSNKRG

SEQ ID NO: 26180 - protein, 205 aa, Mannheimia succiniciproducens MBEL55E
MTEFKLNYHKTHFMTSAANIHQLPKDEGMEIAFAGRSNAGKSTALNALTNQKNLARTSKTPGRTQLINLFEVEPQYKLVDLPGYGYAAVPEQMKLQWQKSLGEYLQHRECLKGVVILMDIRHPLKDLDQQMIEWAVSSDLPVLLLLTKADKLSQSARSKQVKTVREAILPFQGDVQVEAFSAQNKIGIDKLAAKLDSWFSSLLTE

SEQ ID NO: 26181 - protein, 297 aa, Oenococcus oeni PSU-1
MEIKANKLTDTYTLNNNVQIPVIGFGTWQSADGEEAYNAVKWALEAGYRHIDTAAAYGNEESVGQAIKDSGVKREDLFVTTKLWNYQRDNYENSLRGFHDSITRLGLDYVDLYLIHWPEPIEYRDHWQSLNADSWRAMEKIYKDGKTRAIGVSNFREKHIDELMKTAEIAPMVNQIFLNPGDQEKDLVTYNKNHNILTEAYSPLGTGNLLDNPELKKLADKHGVDVAQILIRWNLEKGYLPLPKSTHQKYIESNKKVFSFQLDYDDHKTLDALDGQGKQHTDPHEHNFQKVVPFLNN

SEQ ID NO: 26182 - protein, 350 aa, Thermus thermophilus HB27
MKDYYAILGVSREASQEEIKKAYRRLALKYHPDRNPGDKEAEERFKEINEAYAVLSDPKKRAAYDRGHLEAPEYRPEDLFDLFFQEVFGVRGHRRPPRGEDLEAEVEVELQDLLHGAEKEVRYTRLVPCEACGGEGGRRTPCPTCRGQGVVESYRQSFFGTVVTRTACPHCKGRGYLLAETCPACRGRGRVPREERVRVQVPPGMDEGHLLRVPGYGNLGPGGPGDLYLRIRVRPHPHLERQGPDLVYRLRLGLAQAALGARVVVPGLEGPIPLDIPPGTGHGEVFALEGGGLPLPGGRGRGTLRVVVELAVPKKLSPKAQKLLRAYAEEVGEEVAPEGFWERLKGFFRK

SEQ ID NO: 26183 - protein, 353 aa, Thermus thermophilus HB27
MLLLTPGPTPIPERVQKALLRPMRGHLDPEVLRVNRAIQERLAALFDPEEGALVAALAGSGSLGMEAGLANLDRGPVLVLVNGAFSQRVAEMAALHGLDPEVLDFPPGEPVDPEAVARALKRRRYRMVALVHGETSTGVLNPAEAIGALAKEAGALFFLDAVTTLGMLPFSMRGMGVDYAFTGSQKCLSAPPGLAPIAASLEARKAFTGKRGWYLDLARVAEHWERGGYHHTTPVLLHYALLEALDLVLEEGVAARERRAREVYAWVLEELKARGFRPYPKASPLPTVLVVRPPEGVDADRLVRALYAEGVAVAGGIGPTRGQVLRLGLMGEGARREAYQAFLKALDRALALA

SEQ ID NO: 26184 - protein, 361 aa, Crocosphaera watsonii WH 8501
MTRQYRITLLPGDGIGPEILAVTVDILKVVGKQLEIDFQFQEALIGGVAIDETGKPLPEATLKMCRSSDAVLLAAIGGYKWDNLPREKRPETGLLAIRAGLNLFANLRPATILPQLINASSLKPEIVQGVDIMVVRELTGGIYFGKPKGIFETETKEKRGVNTMAYTESEVDRIAKVAFETAQKRGGKLCSVDKANVLDVSQLWRDRVTLMAEKYPDVELSHLYVDNAAMQLVREPKQFDTIITGNLFGDILSDAAAMLTGSIGMLPSASLGLEKPGLFEPVHGSAPDIAGEDKANPLAQVLSAAMMLRYGLNEPKAATKLEKAVLEALAQGYRTGDIMSDGMKAVGCKGMGEVLLRILES

SEQ ID NO: 26185 - protein, 600 aa, Zea mays
SGRARSFLRWLRHRSRRVSSSSSCSFHLTSTTANNNDSTDTSEDLRARSLPHQHRAGEEREVEAEEEREVGEEIAAEGPEPASEVCIVLGDPEPGAGPRAPLRTEPPRMDPSKKESEFFTEYGEASRYQVSEVIGKGSYGVVAAAVDTQTGERVAIKKIVDVFDHVSDATRILREIKLLRLLRHPDLVEIKHIMLPPSRREFRDIYVIFELMESDLHQVIKANDDLTAEHHQFFLYQLLRGMKYIHAASVFHRDLKPKNILANADCKLKICDFGLARVSFNDTPSAIFWTDYVATRWYRAPELCGSFFSKYTPAIDIWSVGCIFAELLTGKPLFPGKNVVHQLDLMTDLLGTPSAESISKIRNEKARRYMNNMRKKPRVPFTKKFPGIDPMALHLLERLLAFDPKERPSAAEALADPYFNGLANNEREPIAQPISKLEFEFEKRKLAKDDVRELIYREILEYHPQMLQEYLQGADHNQMTFMYPSGVDRFRRQFAHLEEGTAKGEKHSPQLRQNVSLPRERVIGNKHGDGNTGDKLAHASVTDGISQPSLSERSFLKSESISASKCIGEKPKHVKDGESVLESVDETVDDLSKKIPQLKT

SEQ ID NO: 26186 - protein, 130 aa, Oryza sativa Indica Group
MEEFQEADVLWPDHHHHLLRDDDALRRRHQEQQHGGVDDADDSRGGTGTPSAPVGIPVTRAPTTRRISHGSTAPAAAFVPPHELVAARARRCSEERAAFSVCVGNGRTLKGRDLRDVRTAVLRMTGFLET

SEQ ID NO: 26187 - protein, 390 aa, Clostridium perfringens SM101
MNYYEESLKLHENNKGKLDVISKVKVETRDDLSVAYSPGVAEPCKKIKENKADVYKYTCKGNMVAVVTDGSAVLGLGNIGPEASLPVMEGKAILFKEFGGVSAFPICINSNDVDTIVNTVKLISPGFGGINLEDISAPRCFEIEERLKKELDIPVFHDDQHGTAIVVLAGVLNALKLVNKNIEDVKVVVNGIGAAGTAICKLLLIAGVKNIIPCDKVGIITEAMENIDYAKRDLAKIINSKKITGTLKDALKGADIFIGVSAPNILTKEMVKEMNKDAIIFAMANPTPEIMPEEAKLGGARIIGTGRSDLPNQINNVSVFPGLFKGTLSVRASEINEEMKIAAAMAIANSIDEKDLADDNIIPSSLDKNLVDSVAKAVANAAKETGVCRI

SEQ ID NO: 26188 - protein, 433 aa, Treponema denticola ATCC 35405
MSDIIYIEGREILDSRGNPTVEVEVQLSDFSYGRACVPSGASTGEYEALEMRDGDKSRYMGKGVLKAVDQVNTVIAEELDGADALDQAEIDNMLINLDGTENKSKLGANAMLGVSMAVARAAADSLGLPLYRYLGGVHAMQMPVPMANIINGGRHSDNKIDFQEYMIMPVGAPSIREGIRMTAEVFHALKDILKKEGHVTAVGDEGGFAPNIENVQALDYIMKAIEKAGYKPGKDVVIALDCASSELFDAGDRKGYKFWKSEPSKILNADEMVDLFKDWISKYPIVSIEDPLDQNDWEGYAKMTKELGNQIQIVGDDFFVTNTKRLARGIEEGACNSILIKLNQIGTVTETIDAVRMAQKAGYTAVISHRSGETEDAFIADLAVALETGQIKTGSMSRSDRIAKYNQLMRIEDELGYNARYAGMATFANLIKK

SEQ ID NO: 26189 - protein, 275 aa, Bacillus anthracis str. Ames
MHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 26190 - protein, 468 aa, Thermotoga sp. RQ2
MKNRKTPMKEQSPESRRRNFEEVALGYTLEEAVAEAQRCLQCPTHPCVSGCPVGIDIPGFIRKLREGKLEESYSILKSYNNLPAVCGRVCPQEVQCESRCVVGKMKDSESVAIGRLERFVADWAAENLEEDVKPLAGLKKEKVAVVGSGPAGLTAAADLAKMGYHVDVFEAFHKPGGVLVYGIPEFRLPKRIVEREVNYIKKLGVNFYLNTVVGKTVKVKELLSEYDAVFIGTGAGTPKFMGIPGTNLNGVYSANEFLTRVNLMKAYLFPEYDTPIRVGKRVAVIGAGNTAMDAARSALRLGAEKVYIVYRRTEREMPARREEYHHALEEGIEFLWLTLPIRYVGDANGNVEAVECVRMELKEADGSGRPRPVPIEGSNFVLKVDMVIEAIGQGPNRVLLSEFPGLELNERGYIKADEDTGATSVKGVFAGGDIVTGAATVIKAMGAGKKAAQFIHSYLTGEWNPWQK

SEQ ID NO: 26191 - protein, 715 aa, Salmonella enterica subsp. enterica serovar Typhi str. CT18
MTTTSAFMLSVRLDNVAVVAIDVPGEKVNTLKAEFAAQVRAILKQIRENKALQGVVFISAKADNFIAGADINMIGHCQNAQEAETLARQGQQLMAEIQALPVPVIAAIHGACLGGGLEMALACHRRICTDDVKTVLGLPEVQLGLLPGSGGTQRLPRLVGVSTALDMILTGKQLRARQALKAGLVDDVVPQTILLEAAVELAKKERLAQRTLPVRERILAGPLGRALLFRLVRKKTAQKTQGNYPATERIIDVIETGLAQGSSSGYDAEARAFGELAMTPQSQALRAVFFASTEVKKDPGSDAPPGPLNSVGILGGGLMGGGIAWVTACKGGLPVRIKDINTQGINHALKYSWDLLETKVRRRHIKASERDKQLALISGSTDYRGFSHRDLVIEAVFEDLPLKQQMVAEVEQNCATHTIFASNTSSLPIGDIAANAARPEQVIGLHFFSPVEKMPLVEVIPHASTSAQTIATTVKLAKKQGKTPIVVSDKAGFYVNRILAPYINEAIRMLTEGERVEHIDAALVKFGFPVGPIQLLDEVGIDTGTKIIPVLEAAYGERFSAPANVVASILNDDRKGRKNGRGFYLYGEKGRKSKKQVDPAIYKLIGVQGQSRLSAQQVAERCVMLMLNEAARCFDEKVIRSARDGDIGAVFGIGFPPFLGGPFRYMDALGPGEMVATLQRLAALYGPRYAPCEQLVRMAERREHFWTNGETDQGN

SEQ ID NO: 26192 - protein, 472 aa, Silicibacter pomeroyi DSS-3
MERIETDLLVIGAGSGGLSVAAGASQMGARVVLLEGHEMGGDCLNYGCVPSKALIASAKAAHARMTDAGLGVAGQEPQVDFAAVKDHVAAVIAQIAPVDSQDRFEGLGVRVIREYGQFVSRTEVQAGAHLIAARRIVIATGSTPLIPPIPGLDSVPYLTNEILFDLRQRPDHLLIIGGGPIGLEMAQAHVRLGCKVTVIEAARALNREDPEAAALVLTRLRAEGVEIAEDTAAAQIRGRAGAIEVVSAEGRIFAGSHLLVAVGRKASTDRLNLDAAGVETTRTGIRVDASLRTSNRRVYAIGDVAGGLQFTHVAGYQAGVILRSALFGLPSKARTDHIPRATYTDPELAQIGLTEAEARDRHGDRVEVARFDYLHNDRAIAEGRTEGFIKVMVVRGRPVGVTIVGHQAGEHANLWSLALANNLKMSQVAAMVSPYPTIGEISKRAAGAYFSPRLFENQSVKRVVGLVQRWLP

SEQ ID NO: 26193 - protein, 307 aa, Thermus thermophilus HB8
MVEKPAIALVGESLVDLVLEGESPLTFTGSLGGSVLNTATVLARLGYPVRFFSEVGEDWLSAWSEAEMARRGLNPKLRRHPGPMPLALVRLDPEGNARYSFHRPFQAPFLPEAGALRGVGAFHFGSLFALEARTAKGVAALLEEAARAGALLSYDPNLRGLPSPEERARVEAYLGRVDLLKLSLEDARLLFPEAPLEAVRRLPPRLKVLTLGPEGALAFLGEGEVRVPGVRVRVVDTVGAGDTFTAGLLALLLRRGGGRGVLEGLDLEGLREALEAAVALSALACTVRGAGLPEEGLAAWRARWLAG

SEQ ID NO: 26194 - protein, 442 aa, Xanthomonas oryzae pv. oryzae
MLAETPLLETTLERELATLAFGRRYGKVVEVVGTMLKVAGVQVSLGEVCELRQRDGTLLQRAEVVGFSRDLALLAPFGELIGLSRETRVIGLGRPLAVPVGAALLGRVLDGLGEPSDGQGAIACDTWVPIQAQAPDPMRRRLIEHPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPSDHSQAAGRLRRLLAKYNEVETLVQVGEYRQGSDAVADEAINRIDAIRDFLSQPTDQLSDYESTLEQLANVNDDA

SEQ ID NO: 26195 - protein, 475 aa, Thermus thermophilus HB8
MEVKEAPTEALIGGAWRRLARRFPVVSPATGERVAEVADCGEEEAREALEEAVLAFPAWSRATAYERAQVLRRWYERILEHKEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYEEAAKTLKRVSLELGGGAPVLVFADADLDRAVEETLRAKFRNAGESCVAANRIFVQAEVAEAFAEAYARRVQALKVGDPLSEETDIGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSFGL

SEQ ID NO: 26196 - protein, 444 aa, Synechococcus sp. CC9311
MLEAILRPIAYYRRCFFRNSGVVRVRMSPTLPPQQVLISDPSVIKELINEDGGRHITAPGQLNGLLSQVLGKHSIILLAPATHRQRRKLLTPPFHGERLKAYGQLISSLADQSLIDLNVGDVFDAREQMQGITMRVILTAVFGLHEGDAFRQLERSLASSISIRSGPLGSLLLFFPFLRRDLGRWSPGGRIKAADAAIRRLLLEQIASRRRAVERCGEENMSADILSLLLSCKDDEGQGLSDDELHDELLTLLFAGHETTATALTWAFYWIHRNPLVLERLMNELNGLLDHSDPEAIARLPYLSAVVNEVLRIHPVAMLTFPRRIESAITLGGYAFRSGDVVMACIQAVHERPDLYPKPLQFNPERFMNQTYGLHEFLAFGGGSRRCIGAALALYEMKLILAKILLNNQFELTPKSNRWNKPRRRGFTLGPSIPVKLKMVSLRP

SEQ ID NO: 26197 - protein, 543 aa, Synechococcus sp. CC9311
MNVPNDLEGNLLRNAPVAPVVLAILDGWGICDSAEHNAIRSASTPVIDALWHAYPHALIEASGSHVGLPDGQMGNSEVGHLTIGAGRIIRQELVRISETVRERRLGSISALQSVAERLRRTGGTLHLLGLCSDGGVHSHVDHVCGLLEWAAEEGLKNVAIHAITDGRDTPTQSAPTHLSKIQAAISTYGIGRIASLCGRYWAMDRDHRWERTERAYALLTDPDLDRQEDDPASVLVSSYAKGITDEFLEPVRFSDDPLRDGDALLMFNFRPDRARQIIQALSLQEFEGFRRVHQPTLDVVTFTQYETDLPVSVVFPPESLDQLLGQVVADAGLKQYRTAETEKYPHVTYFMNGGIEQPLPGEKRHLVPSPRVATYDQAPEMSADTLTESCVAAIQQGEHSLVVINYANPDMVGHTGMMEAATQAIETVDRCIGKLLDAVGRMGGTLLITADHGNAERMQGPDGQAWTAHTTNPVPVILIEGEKRKVPGFGNSIRLRENGGLADIAPTLLQLLNLDKPEAMTGTSLIEPIEASAPATTKLPQPV

SEQ ID NO: 26198 - protein, 449 aa, Lactococcus lactis subsp. lactis Il1403
MENSTGLKSSLKTRHIVMLSLGGAIGSGLFLGSGKVIAQAGPSVLLSYILAGLTLYVVMYGVGKMVIHQDEHKAGMAGVVAPFIGDHWAHFADWVYWATWMAVLIAEEAGVSTFLAMLIPGVPLWVFALIVAVLGTAINLWSVRAFAETEYWLAFIKVAVILILIALGIYLLVINDAHLGFVADTAQKVSTKSTAPSFAPNGFSGFLTSLLVVIFSFGGSELAAITVAETENPKVAIPRAIRGVLIRIISFYVIPIFLFLHLLPWSEVLNPDAASPFATIFARVGIPHADKIVLVIIVIAIFSAVNSAIYATSRSLYSRIQGSNSYVGQRLGKLSKNQVPTNAILVSSFVLFIGVLLSAILGDGFWQFVAGSISFTISIVWILLLVAALVLYFKHKEVTNWFVKLATLVVLIALTIIFIMQIVTNPWTLSVFALVICLLSYFTYRKKKA

SEQ ID NO: 26199 - protein, 449 aa, Synechococcus sp. WH 5701
MATHEIFMPALSSTMTEGKIVEWLKKPGDRVERGESVLVVESDKADMDVEAFQEGFLASVLLPSGGTAPVGETIGLIVETEAEIAAVQASAPAAPAAAPVAPAPAEAPASVAAAVPPPAAPAAPVPAPVAVPSSAPVAMATGGRLVATPRARKLAGQLGVALESLRGSGPHGRIQAEDVERAAGQAASLPRVAEGTAPAVTSAPAAAASANGSAAPAPVGQAFGNPGDTVAFNTLQAAVNRNMVASLAVPCFHVGYTITTDRLDAFAKSVKSKGVTMTALIAKAVGVVLARHPQVNASFSEGGMVYPPAINVAVAVAMDDGGLITPVLAAADRTDLYSLSRSWADLVARSRSKQLKPEEYSTGTFTLSNLGMFGVDRFDAILPPGTGAILAVAASRPAVVAGKDGSIAVKRQMQVNLTADHRVIYGTHAAAFLKDLAQLIETAPESLAL

SEQ ID NO: 26200 - protein, 353 aa, Bacillus halodurans C-125
MKKITLSVIPGDGVGKEIMPHALRVLDAVAEVHGGLTFEKVEYPWSCEYYLEHGEMMPEDGLVQLTESDAVFLGAVGNPQLVPDHVSLWGLLIAIRRGFQQSLNIRHAKQIRGIDPPIKHANQFDLLVVRENSEGEYSEVGGRIHQGDDEVVVQNAIFTKKATKRAIDYAFQLAATRGKRVTSATKSNGIVFSMPFWDNVFQEVGKQYPDIEQQSVHIDALTAFLVTKPAEFDVIVASNLFGDILTDVSAAIMGSIGIGPAANLNVEGTYPSMFEPVHGSAPDIVGKGMANPIGQIWTGKMMLDHFGEEELGKTLLDIVEDVTEAGIKTPDIGGRATTGEVADAIIERVKSLT

SEQ ID NO: 26201 - protein, 381 aa, Arabidopsis thaliana
MASNGASPRIVDATENSLDKIKRQLASGSGRNLLQGPLFKRSETLRKWNERWVILDPTTGKMEYKTRRNEPTIKGTILFDENSTISISPVNFQGLPKYNGCCIYIGTPQKKDYFLCAETPGAAKAWVTTLHATQLVLKAHKEAVESLSGSGSATLGTVATVVAAANSTALECSREIQAAMQISLRNALKITPNKPIDGPLDDLTIMKETLRVKDEELHNLARELRSRDSMIKEIADKLSETAEAAVAAASAAHTMDEQRKIVCVEFERLTTDSQRQQEATKLKLKELEEKTFTLSKEKDQLVKERDAALQEAHMWRSELGKARERVVILEGAVVRAEEKVRVAEASGEAKSKEASQREATAWTEKQELLAYVNMLQTQLQR

SEQ ID NO: 26202 - protein, 153 aa, Zea mays
QERYSWKSDREHKFGKDVYPSNFQNGALKGGATLDPKIPLSEQEDLIVWMRTAALPTFRKLYGRIYIDLKENDTITVTLNNNYNTYSFGGKKKLVLSTATWLGGKNDFLGFAYLIVGGLCIFLAFAFTLLYFVKPRKLGDHNYLSWNRRHAGR

SEQ ID NO: 26203 - protein, 196 aa, Streptococcus salivarius
MIPVVIEQTSRGEASYDIYSRLLKDRIIMLTGPVEDNMANSIIAQLLFLDAQDNTKDIYLYVNTPGGSVSAGLAIVDTMNFIKSDVQTIVMGMAASMGTVIASSGTKGKRFMLPNAEYMIHQPMGGTGGGTQQTDMAIAAEHLLKTRNNLEQILADNSGQPIEKVHVDAERDNWMSAQETLEYGFIDEIMANNQLK

SEQ ID NO: 26204 - protein, 441 aa, Cryptococcus neoformans var. neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFGTLYPNASPLALDLLSKLLTFDPAKRYGCEEALEHPYLAVWHDPADEPLCEVPFDFSFEEEDSVSGMRDLILEEVRSFRYLVRQQTMPPVRKDSHELPPAPPAPQHPGAGVGPAFHEKRTAKAIWRNILGLHWRNSWRGRNYHRIIFVESVTVIGKHR

SEQ ID NO: 26205 - protein, 772 aa, Oryza sativa Indica Group
MAEPESSTAAAGGSLPPQLPAGACCAPSPSSSSASSRSRSASSPVLVSVGFGFCKVILEYIFVYYWMISGSMEQQMFLSKNGIYEFWNWFDDRTWYPLGRVIGGTVYPGLTLTAGTIWWLLNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPIHVLLCIVTGRYSSRLYIAYAPLVILGTLLAALVPVVGFNAVMTSEHFASFLVFIILHVVALVYYIKGLLTPRLFKVAMTLVITVGLAVCFAVIAILIALVASSPTKGWSGRSLSLLDPTYASKYIPIIASVSEHQPPTWPSYFMDINVLAFLIPAGIIVRLMLVLAPAACILSGIALSEAFDVLTRSVKYQLSKLFDDSPAASGDSSAESSSASTVSTNSAKNETRPEKTETAPKEKPSKKNRKKEKEVAESVPVKPKKEKKLLVLPMEASVLGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGNYRVDAQGTPTMLNCLMYKLCYYRFVETDGKGFDRVRGYEIGKKHFKLTHFEEVFTTHHWMVRIYKLKPQKNRVRGKLKKLKSGSKASSTNAAGRKKNPWQ

SEQ ID NO: 26206 - protein, 296 aa, Zea mays
  misc_feature (176)..(176): Xaa can be any naturally occurring amino acid
MEHRAFDCSGSDDDLPPTYQIRVPRMHFSGNRRPLAGAFSQPRPHNKLDSDIHQIEQQAYTGVLRAFKMQSDALTWEKESLITELRRELKVSDVEHRMLLNMVNEEEAIHTIRQSRQGCGMQSSLPYNSVVDHNLGPIKRQKKSHPIYSLPVDPHSPSMPLKALVGNKTYTLAPEXIRRGSAYQTLPHQVGWLASDGATKGMDGRSGRYHTNEYYASHNDMGLLNFNRTDIPDTETLVKKVERVLSRPDVYAIERAKELLIGQEQSLLDAIAKLDEASDHESDDMLVGSRIHATIG

SEQ ID NO: 26207 - protein, 299 aa, Thermotoga maritima MSB8
MFLVISVVGSSNIDIVLKVDHFTKPGETQKAIEMNVFPGGKGANQAVTVAKIGEKGCRFVTCIGNDDYSDLLIENYEKLGITGYIRVSLPTGRAFIEVDKTGQNRIIIFPGANAELKKELIDWNTLSESDILLLQNEIPFETTLECAKRFNGIVIFDPAPAQGINEEIFQYLDYLTPNEKEIEALSKDFFGEFLTVEKAAEKFLELGVKNVIVKLGDKGVLLVNKNEKKHFPTFKVKAVDTTAAGDVFNGAFAVALSEGKNPEEAVIFGTAAAAISVTRLGAQSSIPAREEVEAFLKNL

SEQ ID NO: 26208 - protein, 388 aa, Zea mays
MALHAAAPACAVFCRLPSPSPSHVGGRRSLPAVASPRGVVSAAPLRTRAVPTKAIVNSDGIPETSDSPHVVCFGELLIDFVPTVNGVSLAEAPAFKKAPGGAPANVAVGIARLGGSSAFIGKVGDDEFGYMLADILKQNNVNNQGLLFDPHARTALAFVSLRSDGEREFMFYRNPSADMLLEEKELDLDLIRKAKIFHHGSISLITEPCKTAHIAAARAAKDAGVLVSYDPNLRLSLWSSPEDARDGILSVWRTADIFKVSEEEVSFLTNGEDPYDDAVVKKLIHSNLKLLLVTEGPDGCRYYSKDFSGRVGGLKVSAVDTTGAGDAFVAGVLSQLATDFSLLQDEGRLREALKFANVCGALTVTQRGAIPALPTRQQVLDALTNFVA

SEQ ID NO: 26209 - protein, 315 aa, Thermotoga sp. RQ2
MSFSNEMKVFSGNANRPLAEKIANYLNLQLGDCEVGRFADGEINVRINETVRGHDIFLIQPTSPPVNENLMELLIMIDAFKRASANTIAVVIPYYGYARQDRKAKGRDPISAKLVANLITVAGATRVLTVDLHAEQIQGFFDIPVDNLWSYPVFAEELLKRENIVPEETVVVSPDVGGVRRARRMAERLKTSLAILDKRRPSDNVAEVVNIIGEVKDKVVIMFDDIIDTAHSIVKGAEALKKAGAKKIIACATHGVFSDRALERIENSPIDTVYITDTIYHENLPEKVKVISVANLIGEAIMRIRKHLSVSTLFR

SEQ ID NO: 26210 - protein, 397 aa, Bacillus anthracis str. Ames
MFHRIEEALEDLKQGKVVIVCDDENRENEGDFIALAEYITPETINFMITHGRGLVCVPITEGYAERLQLEPMVSHNTDSHHTAFTVSIDHVSTTTGISAHERATTIQQLLNPASKGADFNRPGHIFPLIAKEGGVLRRAGHTEAAVDLAQLCGAEPAGVICEIINEDGTMARVPDLLQCAKQFDIKMITIEDLIAYRRHHETLVTREVEITLPTDFGTFQAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLTVTERVPLQMPAKEENKTYLQTKVNKLGHLLNL

SEQ ID NO: 26211 - protein, 541 aa, Bacillus cereus ATCC 14579
MITVSNVSLRFADRKLFEDVNIKFTPGNCYGLIGANGAGKSTFLKILSGEIEPSTGDIHITPGERLAVLKQNHFEYEEFPVLETVIMGHTQLYKVMQEKNAIYMKEDFSDEDGMRAAELEGEFAELNGWEAESEAAILLKGLGIGEDLHDKKLSELTGAEKVKVLLAQALFGQPDILLLDEPTNHLDLKAIQWLENFLMNFENTVIVVSHDRHFLNKVCTHMADLDFGKIQLYVGNYDFWYESSQLALKLTQDANKKKEEKVKELQNFIARFSSNASKAKQATSRKKLLDKITLDDIRPSSRRYPFVGFTPEREVGNDLLTVEGLSKTIDGEKVLDNVYFTLNKGDKVAFIGRNDIAMTTLFKILMGEMEPDSGSFKWGVTTSQSYFPRDNSKYFENSDYNLVEWLRQFSPQDESESFLRGFLGRMLFSGEEVKKNVSVLSGGEKVRCMLSKMMLSGANVITLDDPTNHLDLESITALNNGLIAFKGTILFTSHDHQFVQTIANRIIEVTPNGVIDKEATYDEFLENEELQKQVDAMYKGQ

SEQ ID NO: 26212 - protein, 288 aa, Zea mays
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGLQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 26213 - protein, 412 aa, Salmonella enterica subsp. enterica serovar Typhi str. CT18
MADSRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGAFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKTMFRADGVLPSHPKPVEASTE

SEQ ID NO: 26214 - protein, 284 aa, Candida albicans SC5314
MEKLLHWTIAQQSGDKAALEKIGEPDQKALNQLFGGPDEATLMKESIKVVESTDVSLEDKEIALENFEMLIENLDNANNIGNLKLWNPLIDILAKEDTPVELKVLICGIIGTAVQNNPKSQEDFNETEGLSELIELAQDDKKFELQSKALCAISSFIRYFQPGYAKFEKLQGLKLINFDNKNNKYQLRILSLISSILSNGLDDSLKAQFKEAKLPHYLASVLNEDSNTSLVDKSLNIVSQLNQLNYEFSLEEKYEINRGIQVVEGLSEKLNIDDLNNAKQATSS

SEQ ID NO: 26215 - protein, 756 aa, Zea mays
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKNGLQSLSKGGAPPRFLIIDDGWQQIASENKPDPNVAVQEGAQFASRLTGIKENTKFQTKPDGDGDGEQAAGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVAHSFPDNGCISCMCHNSDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPARDCLFSDPARDGASLLKIWNLNKCGGVVGVFNCQGAGWCRVTKRTRVHDASPGTLTGTVRADDVDAIARVASDGGGWDGETVVYAHRTRELVRLPRGVALPVTLGPLQYEVFHVCPLRAVVPGVSFAPVGLLDMFNAGGAVEECDVISDAGGKAMALRVRGCGRFGAYCSREPARCLLDSAEVEFSYDIDTGLVSVDLPVPEQELYLWTLEIMI

SEQ ID NO: 26216 - protein, 497 aa, Bordetella pertussis Tohama I
MTAPAAVPAPQSPPKVKIPIGLIAGIIAMVVVLLLPLPAELPPAGHRMLAILAFAVVVWITEAVSYEASAIMITTLMAFLLGTAPNVKNPDVLYGTSAAISMALTGFSNSALALVTGALFIAAAMTFTGLDKRIALVTLARVGTSTRRILLGAIAVTIVLSLVVPSATARSAAVVPIMLGVIAAFGVDKRSNIAAGIMIIVAQATSIWNVGIQTAAAQNLLTVGFMDKMLGERVAWSDWLIAGVPWSLLMSAVLVFVVLRLLPPESDAIAGGKEAVEASLRELGPMTSAQKRLILVSIMLLLFWSTEGKLHKFDTTSTTYFGLVLLMLPRFGVMTWKDVQTRIPWGAVIVFGVGISLGTALLTTQAGQWLGAQVVAHTGLDHLGPLGIFAILSAFLILIHLGFASATALTSAMLPILIAVLQTLPGDFNRLGMTMLLGFVVSYGFILPINAPQNMVALGTETFTAKQFAKVGIVLTIVGYLLMLLMSVTYWRWLGWM

SEQ ID NO: 26217 - protein, 356 aa, Aspergillus nidulans FGSC A4
MGSCFSSESAGDVEQKKRSQAIDRKLEEDSRRLRRECKILLLGSGESGKSTIVKQMKIIHQNGYTVEELALYRLTVYKNLLECAKALIGAYHQFNLEPTSQKVRDNIEFLANYNIDPDPNIPLDPAVGDAITYIWNDPCTSTALERQNEFYLMDSAPYFFEEAKRITSPDYIPNVNDVLRARTKTTGIYETRFTMGQLSIHMFDVGGQRSERKKWIHCFENVTSIIFCVALSEYDQVLLEEGNQNRMMESLVLFDSVVNSRWFMRTSIILFLNKVDLFRQKLPRSPLSNYFPDYSGGNDVNRAAKYLLWRFNQVNRAHLNLYPHLTQATDTTNIRLVFAAVKETILQNALKDSGIL

SEQ ID NO: 26218 - protein, 436 aa, Silicibacter pomeroyi DSS-3
MKHARSGTQAMSRQTDQDRIAVLGLGYVGLPLALGLARAGFQTLGFDTDAAHITALGRGHDRNGEVSERSLAETRARFSCDPADLAGCTVYIIGVPTPITDAKTPDLEPLKGACRMIAPHLVPGDMVIVESTVYPGVTEEICGPVLAEGSGLELYSQIKLAYSPERVNPGDAEHSMENVVKIVSAQDAETLDRVAAIYAPVVKAGVHRASSIRTAEAAKVIENTQRDLNIALVNEFSLIFSRLGLDTLEVLEAAGTKWNFLPFKPGLVGGHCIGVDPYYLTYRAEQSGYHPEVILAGRRINDNMGRHVARQLIKALIARRIDPGRARVLVMGFTFKENCADIRNTRVADILSELAEYSVATEVCDPWVDPEAMEQEYGVTPVSEPTTGAYDAIVVAVAHRQFVELGAAAIRAFGLPGAVLYDIKGIFSKSDTDLRL

SEQ ID NO: 26219 - protein, 393 aa, Lactococcus lactis subsp. lactis Il1403
MKKNSDFVLKMDESVTLAAANRAKALKAQGRDIIDLTLGQPDFPTPKIIGQAAIEAIDNGKASFYTQAGGLPELKNAVQHYWTRFYNYEIQPNEILITAGAKFALYAYFMATVDPDDEVIIPAPYWVSYVDQVKMAGGNPVIVEAKQENNFKVTVEQLEEARTSKSKILLLNSPSNPTGMIYSKEELTAIGEWALAHDLLILADDIYHRLVYNGAEFTAISSLSDEIRKRTTVINGVSKTFAMTGWRIGLAVGDPEIISAMTKIASQTTSNPTAVAQYAAIEAFEERDNSFEIMHAAFEERLNIIYGQLSEVPGFELVKPNGAFYLFPKVTKAMAMKGYSDVTDFTTAILEEAGVALVTGAGFGSPENVRLSYATSLKNLEVAVARLKDWMNE

SEQ ID NO: 26220 - protein, 379 aa, Aspergillus nidulans FGSC A4
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYVHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 26221 - protein, 249 aa, Mycobacterium avium subsp. paratuberculosis K-10
MGETATLVLLRHGESEWNSLNLFTGWVDVGLTDKGRAEAVRSGELLAEQGLLPDALYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGRG

SEQ ID NO: 26222 - protein, 484 aa, Grewia occidentalis
DSTLEKENLGRISQIIGPVLDVAFPPGKMPNIYNALVVKGRDTAGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESK

SEQ ID NO: 26223 - protein, 751 aa, Aspergillus nidulans FGSC A4
MAPLMPQAPHKDDLEETWVFLENGINNVMVKLEDGVDMKNYMALYTAVHNFCTSHKAVSGQAIQAQRGAHLLGEELYRKLGEYLSRHLEWVHGESMGHTDEALLSFYIREWQRYLNRHWVKREIDEGKKNVYDVYTQHLVKWKEDFFLKVHEKVMGAVLKLVEKQRNGETIEQSRIKSIVDSFVSLGLDETDPTKSTLEIYRYYFQRPFLEATRIYYEDESRQFVADNSVVEYMKKAEIRLEEEKARVGLYLNNDISKDLTSTCLDVLVTAHSELLRDEFQPLLDNERQDDLARMYRLLSRIKDGLDPLRTKFEAHVRRAGLSAVEKVAAEGDSFEPKMYVDALLSVHTRYHSLVKEAFNGESEFVRSLDNACREFVNRNKICKSGSTKTPELLAKYTDSLLKRGSKAAEESELEEMLVQIMTVFKYIEDKDVFQKFYSKMLAKRLVHVSSVSDDAETSMISKLKEACGFEYTNKLQRMFQDIQISKDLNSSYKDWLEKSFLDDDDRKKLVDSHFQILGTGFWPLTAPSTSFLAPPEIVKTSERFQKFYCDKHNGRKLTWLWQLCKGELKANYIKNTKVPYTFLVSTYQMGILLLFNESDTLTYSDIQKATTLTPEILDPNLSIFLKAKVLNISPEGSKPGPDSTFSLNYNFKNKKIKVNLNIQIRSEQKVETDDTHKTIEEDRKLLLQSAIVRIMKSRKKMKHVQLVQEVIHQVKSRFPPQVPDIKKNIEALMEKDYIERLDGDEIAYIA

SEQ ID NO: 26224 - protein, 261 aa, Vitis vinifera
MAMIFAKPSMRTRVSFETGFFLLGGHALYLGPDDIQMGKREETRDVARVLSCYNDIIMARVFAHQDILDLAKYATVPVINGLTDYNHPCQIMADALTIIEHIGQLEGTKVVYVGDGNNIVHSWLLLAAVVPFHFVCACPKGFEPDEKTVQKAQQAGISKIEITNDPKEAVRGADVVYSDVWASMGQKEEASYRRQVFQGFQVDEPLMKLAGPKAYFMHCLPAERGVEVTDGVLEAPNSIVFPQAENRMHAQNAIMLHVLGL

SEQ ID NO: 26225 - protein, 485 aa, Coccidioides immitis RS
MAPKVAIIGAGLSGLASLKQCLEEGFDATIFEARPVIGGQWCYEEPDPVTGETSSSMYEGVLLNSCRDTSTFSDFPMDPSRYPDYFGHKRFLRYIEEYAEYFGLREHICLNTEVVSCSQDKEGKWSVETIQKGRSPVKDTYDAIFACSGALADPVIPMFEGLEKFKGDVFHSHIYRRPGALEGKRIAIIGFGNSAADLSSELSWQAKELHLITRRGGWIVPRFVLGKPAEAYDNRVAETILPSKFSQWIQTQLCNHVLGKLPDVLQPEHGLMEANVTMRSDLLENIKTGRIIPHRAGVKRVSETSLILTDGTFIDVDVIICCTGYHMSIPYVPEESYRNNHNPILNTNNSMELYKLVASPTFPNVFFIGFVELAGPLVPVSETQARWATSVLAGRIKLPSVKKMYGSIAAYQARLAAVVFTSNPVTAVKLLKAVYVGINSPAQYRLFGHGSKPMLASATLLRLADEAPGLSEKERHILCMSQPEG

SEQ ID NO: 26226 - protein, 480 aa, Glycine max
MVKICCIGAGYVGGPTMAVIALKCPEIEVVVVDIAAPRINAWNSDHLPIYEPGLDDVVKQCRGKNLFFSTDVEKHVAEADIVFVSVNTPTKTQGLGAGKAADLTYWESAARMIADVSKSDKIVVEKSTVPVKTAEAIERILTHNRKGINFTILSNPEFLAEGTAIADLFKPDRVLIGGRETPEGQKAIHSLKSVYAHWVPEDRILCTNLWSAELSKLAANAFLAQRISSVNAMSALCEATGADVSQVSHSIGTDSRIGPKFLNASVGFGGSCFQKDILNLVYICECNGLPEVANYWKQVIKVNDYQKMRFVNRVVSSMFNTVSGKKIAILGFAFKKDTGDTRETPAIDVCKGLLGDKAKLSIYDPQVTEDQIMRDLAMKKFDWDHPAHLQPLSPTSNKQVSVVWDAYEAIKDAHGICIMTEWDEFKNLDYQKVYDSMQKPAFIFDGRNVVNVNKLREIGFIVYSIGKPLDSWLKDMPAVA

SEQ ID NO: 26227 - protein, 583 aa, Arabidopsis thaliana
MGNTCVGPNLNPNGFLQSVSAAVWRNQKPDDSIKSSKDESSRKKNDKSVNGDDSNGHVSSTVDPAPSTLPTPSTPPPPVKMANEEPPPKPITENKEDPNSKPQKKEAHMKRMASAGLQIDSVLGRKTENLKDIYSVGRKLGQGQFGTTFLCVDKKTGKEFACKTIAKRKLTTPEDVEDVRREIQIMHHLSGHPNVIQIVGAYEDAVAVHVVMEICAGGELFDRIIQRGHYTEKKAAELARIIVGVIEACHSLGVMHRDLKPENFLFVSGDEEAALKTIDFGLSVFFKPGETFTDVVGSPYYVAPEVLRKHYSHECDVWSAGVIIYILLSGVPPFWDETEQGIFEQVLKGDLDFISEPWPSVSESAKDLVRRMLIRDPKKRMTTHEVLCHPWARVDGVALDKPLDSAVLSRLQQFSAMNKLKKIAIKVIAESLSEEEIAGLKEMFKMIDTDNSGHITLEELKKGLDRVGADLKDSEILGLMQAADIDNSGTIDYGEFIAAMVHLNKIEKEDHLFTAFSYFDQDGSGYITRDELQQACKQFGLADVHLDDILREVDKDNDGRIDYSEFVDMMQDTGFGKMGLKVS

SEQ ID NO: 26228 - protein, 368 aa, Bacillus halodurans C-125
MKSLMGVVNLDHDQDLLHELTYFRSVAGVPFGGRYRMIDFVLSNMVNSGIQDIAVFARNKYRSLMDHLGTGAPWDLNRKRGGLFILPPDWNDPTDISKGDLRHFHNHRDFFHRGNADHVLVSGSQFISKVDYEDAFKRHQETKADVTVLYKKVDQLEPEDRYRMKLEFDSFGNVKSITNDEMNSNLYMQMYIIRKELLLELLNHCIGYHKQDLFVDGIMSNLNELAIRAYEYKGYLSIISSVASYYKHSMDLLKPEIYQSLFLAGSPIYTKIKDEPPAKYVNGSEVSNSLVANGCVIEGHVENSILFRGVYVAKGVSIKNSIIMQRCYIHEDTHLDHVILDKDILISPNRQFAGAPEQPFVIAKRKAM

SEQ ID NO: 26229 - protein, 319 aa, Thermus thermophilus HB27
MRAIRVHEVGGPEVLRLEELPVPEPGPGEVLVRLLAIGVNFIDTYKRKGLYPVPTPFTLGEEGAGVVEKVGEGVVGVRPGDRVAFANVQGAYAEYLVVPAERLVPVPEGLDPKLAAAALLQGMTVHYLLKSTYPVAPGDQVLVHAGAGGVGQLLIQWAKRLGATVYATASTEEKRGLCLQAGADYALPYEGFAEAVKALSGGGVDVVYDGVGKDTFLGSLAALRPRGMLVLFGQSSGPVPPQDPQILNRMGSLFLTRPTLHHYTASRKELLFRAGEVFRGVLEGWLKVRIGAEFPLEKAREAHEALEGRRTTGKVLLLP

SEQ ID NO: 26230 - protein, 278 aa, Mycobacterium sp. MCS
MAGRTIVITGASDGVGAAAAKRLSRSGENVVVVGRSPQKTAAVADALEADSFVADFSDLAQVRDLAQRLLDAYPRIDVLANNAGGMMNTRETTVDGFEKTFQVNHLAPVLLTTLLLDRLVQCRASVLNTSSMANKFVRTGFDDLDAVQKQSGSVAYSSSKLANILFTKELHRRYHGAGISTAAFHPGPVASNFSAEVDNPMFGVIYRSPLRHLALIGTEQGSDELVWLASATPGVDWRSGEYYHKHKVAKANKLADDAGMAERLWENSLELLGERAVS

SEQ ID NO: 26231 - protein, 216 aa, Vitis vinifera
MGTLGKAIYTVGFWIRETGQAIDRLGCRLQGNYYFLEQISRHRTLMNLFDKAPIVDKDAFVAPSASIIGDVQVGRGSSIWYGCVLRGDVNSISVGSGTNIQDNSLVHVAKSNLSGKVLPTIIGDNVTVGHSAVLHGCTVEDEAFVGMGATLLDGSIVEKHAMVAAGALVRQNTRIPCGEVCLGVGLCVCVRVHVHVHMCVCMCPFNCACMHLCLSV

SEQ ID NO: 26232 - protein, 538 aa, Cryptococcus neoformans var. neoformans JEC21
MHGPVFISSLLHPSPAILSSNMSAEQAVASIPEESKEVELGPLPTVEGKSEDEVKELLTKAAKQVRFYFSDSNLPVDKYFFSLTCCNAEGWVPIKTISTFKRMKDFQSLGVPFVAYALRLSIKEDGNDPLVAVSEDGENVRRKRPLEKNTTAWDRSVYIKGFGEEETEANTQEKIEAYCDQFGKINAVRMRRGDIEGKGAAGKGKGQFKGSVFVEFAYEADAKKFAEQESIPKFTPDGPEMTFMSKDAYVKMKAKEKGIPEGDINRGGQSKSKPEGKFNAFREMERAKHGQLPSLAKIPDGVAIVGSRPEMKNLKAGENKKKRSREDDDEEREGKEARTDEPEPLVIEYNGASLECDRHTGKVLDRSKVAFEINSAVKFINHGENPDWKDLKAQVSNVIASPFLAFPPGSSSGTIAKSDNSVINDEEFEKLKEAKMTFGGAEVEWARMAEEEHRDFWYTRACFKGKQAAQALNEKEEKEKRGRGGRGGRGGGRGGRGRGGRGGRGGRGGKGGRGGRDGRDGKEDNSAGFPPKLATGEQ

SEQ ID NO: 26233 - protein, 153 aa, Bacillus anthracis str. Ames
MVFEGHLVGTGLKVGVVVGRFNEFITSKLLGGALDGLKRHGVEENDIDVAWVPGAFEIPLIAKKMANSGKYDAVITLGTVIRGATTHYDYVCNEVAKGVASLSLQTDIPVIFGVLTTETIEQAIERAGTKAGNKGYESAVAAIEMAHLSKHWA

SEQ ID NO: 26234 - protein, 497 aa, Pseudomonas fluorescens PfO-1
MTTLTRADWEQRARDLKIEGRAYLNGEYTDAVSGETFECISPVDGRLLGKIASCDADDAQRAVENARATFNSGVWSRLAPTKRKATMIRFAGLLKQHAEELALLETLDMGKPISDSLYIDVPGAAQALSWSGEAIDKIYDEVAATPHDQLGLVTREPVGVVGAIVPWNFPLMMACWKLGPALSTGNSVILKPSEKSPLTAIRIAELAVEAGIPKGVLNVLPGYGHTVGKALALHNDVDTLVFTGSTKIAKQLMIYSGESNMKRVWLEAGGKSPNIVFADAPDLQAAAESAASAIAFNQGEVCTAGSRLLVERSIKDKFLPMVIEALKAWKPGNPLDPATNVGALVDTQQMNTVLSYIESGHSDGAKLVAGGKRILQETGGTYVEPTIFDGVSNAMKIAQEEIFGPVLSVIAFDTAEEAINIANDTPYGLAAAVWTQDISKAHLTAKALRAGSVWVNQYDGGDMTAPFGGFKQSGNGRDKSLHAFDKYTELKATWIKL

SEQ ID NO: 26235 - protein, 462 aa, Bacillus anthracis str. Ames
MTFSKSTTDKPSYTYEELSVKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFYQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 26236 - protein, 550 aa, Salmonella enterica subsp. enterica serovar Typhi str. CT18
MQNPYTVADYLLDRLAGCGIGHLFGVPGDYNLQFLDHVIDHPTLRWVGCANELNAAYTADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTEALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQCLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 26237 - protein, 413 aa, Salmonella enterica subsp. enterica serovar Typhi str. CT18
MTDNRVENSSGRAARKLRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELFFSQPDMAQLGKGMVIPALPNPEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVILMGLDPTRILVMSQVLLSFGIALALVPLLIFTSNATLMGELVNTRRVKQIGWIIVVLVVALNIWLLVGTVMGLS

SEQ ID NO: 26238 - protein, 300 aa, Bordetella pertussis Tohama I
MTDTPDPAAVLSPAVKAAVLSEALPYIRRFHGKTIVVKYGGNAMTEERLQRSFAHDVVLLKLVGLNPVVVHGGGPQIDDALRRIGKQGTFVQGMRVTDAETMEVVEWVLGGQVQQDIVMMINEVGGKAVGLTGKDGMLIQATKKLMVNKDDPSQPLDIGLVGDITRVEPAVVKALQDDQFIPVISPIGYGEDGTAYNINADVVAGKMAEVLGAEKLLMMTNTPGVLDKGGKLLRSLSAQTIDELFADGTISGGMLPKISSSLDAAKNGVNSVHIVDGRVPHCLLLEILTDQGVGTMISSH

SEQ ID NO: 26239 - protein, 486 aa, Pseudomonas putida KT2440
MKALDQLTFDNRFARLGDAFSTQVLPEPIADPRLVVASESAMALLDLDPAQAELPVFAELFSGHKLWEEADPRAMVYSGHQFGSYNPRLGDGRGLLLAEVLNDAGEHWDLHLKGAGQTPYSRMGDGRAVLRSSIREFLASEALHALGIATSRALCVIGSSTPVWRETRESAAMLTRLAQSHVRFGHFEYFYYTKQPEQQRVLIDHVLEQHYPECREAEQPYLAMFRTIVERNAELIARWQAYGFCHGVMNTDNMSILGITFDFGPYAFLDDFDANFICNHSDDRGRYSYANQVPIAHWNLSALAQALTTVIEVEPLKEALGLFLPLYQAHYLDLMRRRLGLTTAEDDDMVLVERLLQCMQRGGVDYSLFFRKLGEQPVAEALKVARDDFIDLAGFDAWGADYLARCGREPGNAEGRRERMHAVNPLYVLRNYLAQKAIEAAEAGDYSEVRRLHQVLARPFEEQPGMQAYAERPPEWGKHLEISCSS

SEQ ID NO: 26240 - protein, 439 aa, Ostreococcus tauri
  misc_feature (1)..(2): Xaa can be any naturally occurring amino acid
XXNARRAIERGKERWRSMRLRTQSTVVMIIGAAGPTVAGHAYAIALCFACQYAMTKELFVFVSSAYAEENASGEDAAKLRRTTNALRWYWFWTFAFYVYGRFAKYLFLGFMSAKDWRDLLSEGPEVSPWAWAAMHHTFLSFMAYLGGLVYFVLTLRKGIYEYQFAQFAWTHMILAATTMTGYFNVSNVLEGMIWFVFPLFLVTTNDIMAYICGKLFGRTPLIKISPKKTWEGFIGAFICTIFAAPFMAAYLQRSVYFTCPPSGDMYFRGIFSRRSWCVPGEPFIVSDKPITMFLGTIAGPFITRLTGLSHVRCSMFMVHSFALAMFASTVAPFGGFFASGFKRAFKIKDFAETIPGHGGVTDRLDCQVINSCFSSLYLSNFVKHVGGSLTLGMLLTKIELVCDEHIVQLYEALGQMVNARGLTVAASSASAAAETAASL

SEQ ID NO: 26241 - protein, 300 aa, Zea mays
  misc_feature (72)..(72): Xaa can be any naturally occurring amino acid
MASFFADDGADDLPRATSHPFDSDDFGAAAADDASAGGYASFADGGVEEVDEEITVESYGVPIRHVSGGYSXPFSPDLEPNGSDGPTLPPPTEMGREEGILLREWRRKNAMELEKKEQKEKELRAQIIAEAEEFKKAFFEKRIQNCASNMVNNREREKIFVASQEKFHANADKQYWKSISDLIPHEIATIEKRGKKDKDKKPSVTVIQGPKPGKPTDLSRMRHILVKLKHAPPPHMLQPPPAPAAKEGAKDGSKEGGKDGGAKDGAAAPANDAKQPAESQETSTANGPSEAEKEQPAASE

SEQ ID NO: 26242 - protein, 423 aa, Mesorhizobium sp. HN8A1
VMFDGSSIAGWKAINESDMVLMPDPDTVHMDPFFAHSTMVILCDILDPVSGESYNRDPRGTAKKAEAYMKSEGIGDQIFVGPEAEFFVFDDVKYKADPYNTGFKLDSTELPSNDDTDYDTGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSG

SEQ ID NO: 26243 - protein, 272 aa, Arabidopsis thaliana
MRARLVVFPIKGKKWCFSRSVDPFAAQSPSGVTPTTVRGLWKKISSESKPINANAELLVDFISDKMNKAWVGLEKAPDGSIKNKIHGFGLKLLARVKPSEIFLKSISKEVTSVQVTYPPSLDPRLVRRRLRHIAMSGTILHKKYLVGSVTLLPLTSAFMVLPLPNIPFFWVLFRTYSHWRALQGSEKLLKLISNEANPDKPDSTDDADESKNSNTKPEQKSQSPTCILLPSEELYQLIREASEEGLDEATIIEICKSFDLNKNDVLKYRNLV

SEQ ID NO: 26244 - protein, 422 aa, Borrelia burgdorferi B31
MDFKQIKSNVEKVKFLRKDFPILNKKFDNKYIIYFDNAATSQKPKNVIYSNVEYYENYNANVHRSGHKFAIQSSIKIEKTRELVKNFINAESAKNIIFTSGTTDGINTIASSFFYSKYFKKKDEIILTTLEHNSNLLPWVNLANLANLKIKLAKFNEMGIITPEEIEKLITEKTKLISISGINNTLGTINDLESIGKIAKKYNICLFVDAAQMAPHIKIDVKKIGCDFLVFSGHKMLAPTGIGILYISNNMAEKLHSSKLGGNTVEEIFIENEKIKFKASDSPNKFESGTPNIAGIIGLEEAIKYIDNISMDFILEHDKQLIEYGVKKLQELDEVEFILNTNLKRNSIISFTVKNIHSHDIETYLDTMGIATRAGRTCSYVAFFPENLNKDHLLRISFYFYNTQEEIDNFILGLKKVIKELS

SEQ ID NO: 26245 - protein, 180 aa, Triticum aestivum
  misc_feature (142)..(142): Xaa can be any naturally occurring amino acid
MAGDDARTGAVAPAEEEPHVERLPADILAHVLSLLPSFHDLSMAGAVSRRWRRAVGRSLATRRRLSLAGQRTGDESTARLVRAAVNLRDLDISRSCWGCHITDQGLLNFSSGGGVGNLTSVSLGGLPGITDKGAAHLVSKGXTAPLEIGGKSIPEQPLYAVADNLSNLEEVSTWGNWPPP

SEQ ID NO: 26246 - protein, 172 aa, Oryza sativa Japonica Group
MPMMEASPVYSAARNASGDAWKALFDLAGGLIQVYDQEAMLSLSKFVDQLPSVMNQVTEGVSEFKPTPPENREFCKNSYNVPNTLLVKFSIDAIDDTEIVEDVLKPRVESIGGQIKKVILSGTHLTPCIQDVKWQVGSEYTPADALAQGLKSLALNETRVLSRTIADWFRSL

SEQ ID NO: 26247 - protein, 575 aa, Haemophilus influenzae R2846
MISGILASPGIAFGKALVLKEEKIVLDTQKITDDQIDAEVARFYEGRAAAVEQLNSIRERALISLGEEKAAIFEGHLMILEDEELEEEILDYLRSNKVNAGVAASKILDQQVTMLSEIDDEYLKERAGDIRDIANRLVKNILGMYIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDVVANIGTIRDCDGAERNGAEGIGLYRTEFLFMDREQLPTEEEQFIAYKQVVEAMNGRLTVLRTMDIGGDKELPYLDLPKEMNPFLGWRAIRIALDRREILNAQLRAVLRASAFGKLAVMFPMIISVEEIRELKAVIETLKAELREEGRLFDNNIQVGVMVETPSAAVNAKFLAKEVDFFSIGTNDLTQYTLAVDRGNEFISHLYNPMHPSVLGLIKQVIDASHAEGKWTGMCGELAGDERATLLLLGMGLDEFSMSAISVPRIKKLIRNVNFQDAKVLADAALQKPTAAEIDQLIEEFLLENSLN

SEQ ID NO: 26248 - protein, 484 aa, Hermannia erodioides
  misc_feature (5)..(5): Xaa can be any naturally occurring amino acid
VSMLXKRNLGRISQIIGPVLDVAFPPGKMPNIYNALVVKGRDTLGQQINVTCEVQQLLGNNRVRAVAMSATEGLTRGMEVIDTGAPLSVPVGGATLGRIFNVLGEPVDNLGPVDTRTTSPIHKRAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESK

SEQ ID NO: 26249 - protein, 383 aa, Bacillus halodurans C-125
MKKEIVGMLLAGGEGKRLGQLTRKLAKPAVYFGGKYRIIDFPLSNCTNSGIDTVGVLTQYEPLALNGHIGIGSPWDLDRRHGGVTVLPPYIEKQGGSWYKGTADAIYQNRYYIEQYDPEYVLILSGDHIYKMDYDRMISHHKKLGADATISVIEVPWEEASRFGIMNTNEEMTITQFEEKPTTPISNLASMGIYIFNWSVLKSYLIQDAKQANSSHDFGKDIIPKMLAKDLKLVAYPFEGYWKDVGTIKSYWEANMDLLDEHSSLMLNDPSWRIYSVNRNQPPQYISTRAYVRCSLVNEGCVVHGNVEQSILFPGVHIGANSSVFESVLMPNVKVGENVVLRRTIIMEGACIPSGTHLAPSDPDDILVIDKDTEFSPSIAANQ

SEQ ID NO: 26250 - protein, 298 aa, Mycobacterium avium subsp. paratuberculosis K-10
MSAMLSGMARIAIIGGGSIGEALLSGLLRAGRQVKDLVVVERVPERAKYLADTYSVLITSVADAVENASFVVVAVKPADVESVMSEIARAAGQAESDTAEQVFVTVAAGVTIGYFESRLPAGTPVVRAMPNAAVLVGAGVTALAKGRFVTAPQLEGVSALFDSVGGVLSVPESQMDAVTALSGSGPAYFFLLVEALVDAGVAAGLSREVAADLTAQTMAGSAAMLLERMDADRRLGEAETPGLRVDATATQLRATVTSPGGTTAAGLRELERGGLRAAVDAAVQAAKMRSEQLRITSE

SEQ ID NO: 26251 - protein, 245 aa, Zea mays
  misc_feature (130)..(130): Xaa can be any naturally occurring amino acid
HLNKRHCQDLQHQQRYERETILSQIDRSRRSLLAKLREYKGQDCEVIHEAAAFAGERIERDDGLVLPPYSDHVTNSFALDDLYPLSYMSKPKRLHTQPDSDGDDDGTAQDGARRNGRESRDTGASKRGSXAERGGGGGIGAFMGWVAKTAVMVVGAVCVMKAAGYESVTWRNGGARLDIAGLFGGGGGKQAVAAGGGDERRAPLRCPPGKALVVENGRARCVVKERVEVPFDAVLAPPSSRYGLG

SEQ ID NO: 26252 - protein, 756 aa, Saccharomyces cerevisiae
MYNSSTNHHEGAPTSGHGYYMSQQQDQQHQQQQQYANEMNPYQQIPRPPAAGFSSNYMKEQGSHQSLQEHLQRETGNLGSGFTDVPALNYPATPPPHNNYAASNQMINTPPPSMGGLYRHNNNSQSMVQNGNGSGNAQLPQLSPGQYSIESEYNQNLNGSSSSSPFHQPQTLRSNGSYSSGLRSVKSFQRLQQEQENVQVQQQLSQAQQQNSRQQQQQLQYQQQQQQQQQQQHMQIQQQQQQQQQQQQSQSPVQSGFNNGTISNYMYFERRPDLLTKGTQDKAAAVKLKIENFYQSSVKYAIERNERRVELETELTSHNWSEERKSRQLSSLGKKESQFLRLRRTRLSLEDFHTVKVIGKGAFGEVRLVQKKDTGKIYAMKTLLKSEMYKKDQLAHVKAERDVLAGSDSPWVVSLYYSFQDAQYLYLIMEFLPGGDLMTMLIRWQLFTEDVTRFYMAECILAIETIHKLGFIHRDIKPDNILIDIRGHIKLSDFGLSTGFHKTHDSNYYKKLLQQDEATNGISKPGTYNANTTDTANKRQTMVVDSISLTMSNRQQIQTWRKSRRLMAYSTVGTPDYIAPEIFLYQGYGQECDWWSLGAIMYECLIGWPPFCSETPQETYRKIMNFEQTLQFPDDIHISYEAEDLIRRLLTHADQRLGRHGGADEIKSHPFFRGVDWNTIRQVEAPYIPKLSSITDTRFFPTDELENVPDSPAMAQAAKQREQMTKQGGSAPVKEDLPFIGYTYSRFDYLTRKNAL

SEQ ID NO: 26253 - protein, 240 aa, Thermoplasma acidophilum
MKGGKRIDGRLPDEFRELTIIENYIPRANGSAYVALGNTRVVAGVKIEAGEPFPDTPDQGVLTTNVELLPIAFPSFEAGPPNDLAIEVSRVVDRGIRESKMISPEKLVIEQGKKVWIVFLDINVLDYDGNLIDASTIAAVAALRNAVVPASKEGGEDFKLPVSSTPISVTMVKIGDTLVCDPSLEEDQICGGRITVTTTEDGHIRAMQKGEIGAFTVEDVKKAVKMSLEVGKKLREKYFR

SEQ ID NO: 26254 - protein, 553 aa, Bacillus halodurans C-125
MFSAKKRDKCIGEMSEKQLDLLVIGGGITGAGIALDAQVRGIQTGLVEMNDFASGTSSRSTKLVHGGLRYLKQFEIKLVAEVGKERAIVYENAPHVTTPEWMLLPIFKDGTFGKFSTSLGLKVYDYLADVRKDERRYMLNEKQTLEKEPLLRKENLKGGGIYVEYRTDDARLTLEIMKEAVARGAVALNYMKVESFIYDQGKVVGVVAKDRLTDTTHTIYAKKVVNAAGPWVDTLREKDRSKHGKYLKLSKGVHLVVDQSRFPLRQAVYFDTESDGRMIFAIPREGKTYIGTTDTFYDKDIASPRMTVEDRDYILAAANYMFPSLNLTADDVESSWAGLRPLIHEEGKKASEISRKDEIFFSDSGLISIAGGKLTGYRKMAERTVDAVAQGLNVNEPCTTAAIRLSGGLAEGAQGFPRFLDEASRKGAKLGFDADEVRRLAKLYGSNVDHVLNYAYEGKEEAEHYGLPALLLGQLQYGVEQEMVATPLDFFVRRTGALFFNISLVHQWKEAVLRWMAEEFSWTEEEKTRFQNELETELKMAVDPLFQVEPTTV

SEQ ID NO: 26255 - protein, 193 aa, Zea mays
MGRKLALLVGINYPGTKAELKGCHNDVDRMHKCLVDRFGFDEENITVLLDRGSSGPQPTGANIRHALAKLVGDARRGDFLFFHYSGHGTRLPAETGQDDDTGYDECIVPSDMNLITDQDFRDLVQRVPDGCIFTIVSDSCHSGGLLDKAKEQIGNSTRQNQTQSREPEEERSHSGSGFRSFLKETVRDAFESH

SEQ ID NO: 26256 - protein, 451 aa, Mycobacterium sp. MCS
MSPETSSEATEQVQDEPATGGKLKRKITGPLLFLFILGDVLGAGIYALMGVLAQDVGGVLWAPLLVALLLALLTAGSYAELVTKYPRAGGAAVFAERAFKRPVVSFLVGFSMLAAGVTSAAGLALAFAGDYLSTFIDVPAIPAAMVFLGLVAALNARGINESVKSNVVMTVIELSGLLIVIVAVAMMVGGGRGEVGRVVEFPDGATPALAILAGAIVAYYSFVGFETSANVAEEIRNPSKVYPTALFGALITAGVVYALVGVASAVALPADQLSESSGPLLDVVSAAGVGVPDWLFSAIALVAVANGALLTMIMSSRLTYGMAEHGLLPSVLSRVLPQRRTPWVAIVATTVVAMCLTLVGELSTLAETVVLLLLFVFISTNVAVLVLRRDHVGHDHFRVWTAVPVLGVASCVLLMTQQTAKVWAFAAIMLAVGAVLYGLARIATKRQRTAV

SEQ ID NO: 26257 - protein, 279 aa, Pediococcus pentosaceus ATCC 25745
MINSLNDRIMLNNGTAIPGLGLGVFQIPDADTAQVVANGIKNGYRLIDTAQIYGNEAGTGAGIKAGLTATGLKRADLFVTSKVWNDHLSYDETIAAFESSLKKLGLDYLDLYLIHWPGDNAFQDAWRALETLYKQGKIKAIGVSNFQIHHLQALAEFAEITPVINQIETHPQLSQLEMREYAAKHDIKVQAWSPLMQGKILDNAVLAKIAQKYNKSVAQIVLRWDVQQNILLVVKSVRAERMLSNAQIFDFELAPEDMDQINALNENLRVGPNPDEFDF

SEQ ID NO: 26258 - protein, 166 aa, Mannheimia succiniciproducens MBEL55E
MANIEKQAGELQEKLIAVNRVSKTVKGGRIMSFTALTVVGDGNGRVGFGYGKAREVPAAIQKAMEKARRNMINVALHEGTLQHPVKGIHTGSRVFMQPASEGTGIIAGGAMRAVLEVAGVRNVLSKAYGSTNPINVVRATIDALANMKSPEMVAAKRGKTVDEILG

SEQ ID NO: 26259 - protein, 315 aa, Cryptococcus neoformans var. neoformans JEC21
MSTSSRCLVRGSVNIDEFFHLPHIVRPGETISSTGLTKRAGGKGANQAFAVARAGGQVELDGAIGDDGIWVKEMLESAGVGIGKLKVVKDEVTGRAVIQILHAGANYYLPSPTPATSLSTYTHLLVQNEVPLSSTLAYLTAAGQSSPPLTSVFNPSPMLTPAQLREFPWKHLSWLIVNEGELGDLLLAFGSSANPGEAKEDELQAKASAGILELHENEYFSKNVGIICTLGAKGILYYEPGKEVGYLPAAKLQNPVKDTTGAGDCFAGYFVAGLMGGKSLQDALKTCLVACGICVENEGAMESVPTLEAVNERLA

SEQ ID NO: 26260 - protein, 301 aa, Pseudomonas fluorescens PfO-1
MTLERDAAANTAKVLSEALPYIRRYVGKTLVIKYGGNAMESEELKTGFARDIVLMKAVGINPVVVHGGGPQIGDLLKRLSIESHFVDGMRVTDAATMDVVEMVLGGQVNKSIVNLINRHGGSAIGLTGKDAGLIRAKKLTVTRQTPEMTQPEIIDIGHVGEVVGINTELLNLLVKGNFIPVIAPIGVGENGESYNINADLVAGKVAEALKAEKLMLLTNIAGLMDKSGTVLTGLSTQQVDDLIADGTIYGGMLPKIRCALEAVQGGVGSSLIIDGRVPNAILLEIFTDTGVGTLISNRKRP

SEQ ID NO: 26261 - protein, 436 aa, Francisella tularensis subsp. holarctica
MSLYEDIVAKREKVSLVGLGYVGLPIAIAFAKKIDVLGFDICETKVQHYKDGFDPTKEVGDEAVRNTTMKFSCDETSLKECKFHIVAVPTPVKADKTPDLTPIIKASETVGRNLVKGAYVVFESTVYPGVTEDVCVPILEKESGLRSGEDFKVGYSPERINPGDKVHRLETIIKVVSGMDEESLDTIAKVYELVVDAGVYRASSIKVAEAAKVIENSQRDVNIAFVNELSIIFNQMGIDTLEVLAAAATKWNFLNFKPGLVGGHCIGVDPYYLTYKAAELGYYSQVILSGRRINDGMGKFVVENLVKKLISADIPVKRARVAIFGFTFKEDCPDTRNTRVIDMVKELNEYGIEPYIIDPVADKEEAKHEYGLEFDDLSKMVNLDAIIIAVSHEQFKDITKQQFDRLYAHNSRKIIFDIKGSLDKSEFEKDYIYWRL

SEQ ID NO: 26262 - protein, 1250 aa, Oryza sativa Indica Group
MPKPTQHIPIVQRLCAHSRQIKIGRDGALRADSETASRSGLGPAPAFGTWAERNIILAHLIPTARTMWAEPEIAVNYGPRRGGCESSSSRPTLQPAPILRHPFAGGFSPPLPPPLHRRPRNLDTSPLAGDHHHGASRFASTSVVKQSSGGLLGWFLGGNSSQLPPLDVPLPGVIISPPLPDFVEPSKTKITTLPKGIKIASETSPIPAVSVRLYIDCGSVYETSSSSGTSHLLERMAFKSTTNRSHLRLVRECYAPEMVEVLIDSGRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYRCQADSTSTHIALAFEVPGGWRQEKTAMIVTVLQVLMGGGGSFSTGGPGKGMRSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAVKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPHQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKIEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 26263 - protein, 940 aa, Oryza sativa Indica Group
MAARSWLLLLCFVAVATAGVLQARAQPDSNGFISVDCGLPGKTGFVDDKTMISYAADDGFTDGGACHNISAEYITPGLAKRYHTLRSFPDGKRNCYTLRSLVAGLKYLFRATFFYGNYDGLNKLPVFDLYVGVNYWTMVNITGPGDAVIVEAIVVVPDDFVQVCLVNTGAGTPFISGLDLRPLKNTLYPQSNATQGLVLLGRLNFGPTDYTDVIRYPDDPHDRIWFPWVDSTKWSQISSTKKVQDLDNDMYETPTAVMQTAITPRNASRNIEFSWDPVPLPNDPTPGYIAIFHFSELQLLPGNAVREFYINLNGKPWSLTAFKPEYLYNDATFNRNPFLRYPQYNISINATANSTLPPLINAVEVFSVIPTATIGTDPEDVAAITAIKEKYQVVKNWMGDPCVPKMLAWDKLTCSYAISNPARIIGLNLSSSGLSGEVSSYFGNLKAIQNLDLSNNKLTGPIPDALSQLPSLTFLDLTGNQLSGSIPSGLLKRIQDGSLNLRYGNNPNLCTNGDSCQPAKKKSKLAIYIVIPIVIVLVVVIISVAVLLCCLLRRKKQAAMSNSVKPQNETVSNVSSNGGYGHSSSLRLENRRFTYNELEKITNNFQRVLGRGGFGYVYDGFLEDGTQVAVKLRSESSNQGAKEFLAEAQILTRIHHKNLVSMIGYCKDGEYMALVYEYMSEGTLQEHIAGKNNNRIYLTWRERLRIALESAQGLEYLHKACNPPLIHRDVKATNILLNTRLEAKIADFGLSKTFNHVNDTHVSTNTLVGTPGYVDPEYQATMQPTTKSDVYSFGVVLLELITGKPSILREPGPFSIIQWARQRLARGNIEGVVDAHMHGDHDVNGVWKAADIALKCTAQTSTQRPTMTEVVAQLQECLELEDRRCGMEDTYNNFYAGNNNDPNSSYNMYNTDQSTEVSQNNTMEHNFERVPTMATGPVAR

SEQ ID NO: 26264 - protein, 323 aa, Francisella tularensis subsp. holarctica
MAYDNVKFPHVSFFLVTGGAGFIGSNLCEVLLSKGYRVRCLDDLSNGHYHNVEPFLTNSNYEFIKGDIRDLDTCMKACEGIDYVLHQAAWGSVPRSIEMPLVYEDINVKGTLNMLEAARQNNVKKFVYASSSSVYGDEPNLPKKEGREGNVLSPYAFTKKANEEWARLYTKLYGLDTYGLRYFNVFGRRQDPNGAYAAVIPKFIKQLLNDEAPTINGDGKQSRDFTYIENVIEANLKACLADSKYAGESFNIAYGGREYLIDLYYNLCDALGKKIEPNFGPDRAGDIKHSNADISKARNMLGYNPEYDFELGIKHAVEWYLIN

SEQ ID NO: 26265 - protein, 134 aa, Mycobacterium avium subsp. paratuberculosis K-10
MTSPKVQLTDDEWRQRLTPEEFHVLRQAGTERPFTGEYTDTKTEGVYQCRACGAELFRSTEKFESHCGWPSFYDPANSDAVILRPDHSLGTTRTEVLCANCHSHLGHVFTGEGYPTPTDQRYCINSICLRLAPS

SEQ ID NO: 26266 - protein, 299 aa, Triticum aestivum
LLVRPRVRPSIWFGFAFLLHGSLQKRELGTLTQRWNLRTIGYMPDAWVPVFFVQALLVFVGPTFVKDENSAHGRRVFAKYFIQTSMPVGDTNVCTYPLFGTIFLGLIDAVLMSYVSYVGSRVLSLVINKALRKRVSWLIMSVLFFLPIRVLLLGFSVMPNPGDKAFEVIVFLSFVMMLSGTTVGILLLVYWPVRDSLALKDAGNREIAEMVPYDDYYYEGSSLVANQSFREIERNSDTSTKRGSISFRTMIREDQLPPDGTDEIGFSSRSGVHIGSSSPAGSSPSAAMPMLPLKEVPRY

SEQ ID NO: 26267 - protein, 970 aa, Oryza sativa Japonica Group
MEEAAAAVHRRWRRRLLPKLMLLLCAVVHGQQPDSLGFISIDCGIPDGGGYSDESTRGLRYVPDAGFLDAGAGLSAGINPPYTDRDLAARYLTVRYFPGAASAAGERGGCYTLRQLSPGGRYLVRATFYYGNYDGAIAMLPVVFDLHLGANRWTAVNVTAADAIYIFEAVVSPPADFLQVCLVNIGKGTPFISGLDLRPLKPELYPEATANQSLLLLNHDRPPARFAFNRYQFWRPASYYKLFRYPFDPYDRLWQPYGDDPSWTNITVAAAVDVTNISRSDDPSPILRSAATPANATVRRLDFPWSSDDAATTTYLLLLYFAELQRLPAGAARRFDVLVDGDASAGGGRRGYTPRYLAAEVVRSTVRAARPGQRHVVSLVAAPDSALPPIVNGLEIYSVQPMPELATNDRDAKAMMEIRDNYELKKNWMGDPCAPKAFAWVGLNCGYSSSDPALVTALNLSSSVLIGPVNLSFGDLKSLQYLDLSNNSLSGPIPDFLVQMPALKFLDLSSNKLSGSIPSDLLQKRENGSLVLRIGNNANLCYNGANNTCAPESKQSKRILVIAIAVPIVAATLLFVAAKFILHRRRNKQDTWITNNARLISPHERSNVFENRQFTYRELKLMTSNFKEEIGKGGFGTVFLGYLEDGTPVAVKMCSKTSSEGDKKFLAEAQHLTRVHHRNLVSLIGYCKDKKHLALVYEYMQGGNLEDRLRGEASIAAPLTWHQRLKIALDSAQGLEYLHKSCQPPLIHRDVKTRNILLSGDLDAKIADFGLTKVFAGDVVTHVTTQPAGTLGYLDPEYYHTSRLSEKSDVYSFGVVLLELVTGRPPAVPLGDGDGGGGESVHLAVWARQRLAEGDIESVADAAMGGCFEVNSAWKVAELALRCKERPSRERPAMADVVAELKECLELEASRALGRGYSCYSSGSGGGSSVATTTTTSGAANISAAASAASVSDAQIGELRQESVLELGPR

SEQ ID NO: 26268 - protein, 496 aa, Physcomitrella patens subsp. patens
MLTGLLVQGLVCRESQSSVVPHLLDYVNNSCTPFHATAETRNHLLSSGFQEISECEEWAVQPGGRYFFTRNMCSIYAFAVGHKYKPGNGFHVVAAHTDSPCPKLKPVSYSAKGGFLHVRVQPYGAGVWQTWFDRDLSIAGRVLIRRKDGELVNELVRVRRPILRIPTVAKILDRGLAADASKADAEVNLAPILAMQIESELAMSCDSESSMAMEHNDHGSHVYPQPTTAHHPLLIQVLADELKCDVSEVADFDLSVYDTQPGCVGGARDDFVFAGRLDNLTSTFCALWALLDTCADSSSLVDESCVRMIALFDSGELGGTDSVQAAGPSTLLQAMTRITRWLARGSDSEGVVERAMRRSLIVTADMVDGMHPSQVCPPGQEESFHQPKLRDGLVLKQDAGNSNDIMTLFLFREVAKRSSIPIQNFPVSREIGCCSTVSSILAAGYGLRLIDCGVPLLSMHSVREMCSTEDIDTTFRHFRAFFQHFTSMDEQPRVDV

SEQ ID NO: 26269 - protein, 185 aa, Oryza sativa Japonica Group
MDTGNKGTATPVLLNVYDLTPANDYLYWLGFGVFHSGIEVHGMEYGFGAHDFPSSGVFEVESKSCPGFIYRKTVWLGTTDMSHGEYRSFIEKLAGKYHGNSYHLVSKNCNHFTDDVCSFFDCLLPESVQVSPVGRVPTLRPVADDDLDSISTVSDNNEEDKHLLPAPSNDLHSVDVPLKLAKDVL

SEQ ID NO: 26270 - protein, 450 aa, Burkholderia pseudomallei K96243
MQDVDPAYAFVRARESGARTYADTFDTVFAHGAGTVLTDTAGRRYLDFLSCAGTLATGHNHPAVVERVRAFVDSGQAMQMLDMTTPVKHRFVERLFGILPPALARHARVQFCGPSGADAIEAAIKLFKTATGRRSVIAFHGGYHGMTAGALALTGNLRAKHAVASLMPDVHVMPYPYAYRCPFGLGAPHTAAASLHYIESMLSDPESGIAKPACVIVEAVQGEGGVIPAPPEWLAGLRALTARLDIALVIDEVQTGIGRTGAMFAFEHSGIRPDAVVLSKAIGGGFPLALVAYDERYDVWEAGAHAGTFRGNQIAMAAGVACLDVIESEGLIAGAAAKEAHVRARLERLAARHPEIGDVRGRGLMWGIELVDPDAAPDAAGARPAAPALARALKRYCFAHGLIVETGGRHGAVVRLLPPLTVSAAELDLAFDTLDAGLAALGEHARAEFA

SEQ ID NO: 26271 - protein, 533 aa, Ostreococcus tauri
MSRARAALDALRARAVPIDRYLNLRSLQRADAETFYRVLVSAPKELMPFVYTPVVGEACERYHDLPVRAHGVYITADDAGKVGAKLRRHWREEMRWVRDACGGATRGVETGATDDPVSVAVVTDGERILGLGDLGAGGMGISEGKILLYTVCAGVHPSTCLPVCLDVGTNNERLLNDPNYKGLRRKRLKGEAYDALVDEFMREMRAWQPSCLVQFEDFGNANAFRILEKYRHSGPCFNDDIQGTAAITLAALLGALRVTKGKLEDQRVLFYGAGEAGVGIGELIAMAMEKTGMSHKEAMERCYFMDSKGLVCKSRLDGLQPHKVAFAHDVQFQPDLLSAIDAIKPTALIGVSTIGQAFTEDVVKRMCSINERPIIFPLSNPTSKSECTFEQAMAWSDGKVVFASGSPFDPVVRKRDGVTVFPAQANNAYVFPALGYAAALTHATQVTDDLFLAAAESLAGITSDAEIDAGHLFPDMNSIRDVSVTLTAEICEMIVAKSLGRAPSGVSTHEDWLKYIASHQYDPGEEQPIASKL

SEQ ID NO: 26272 - protein, 172 aa, Lupinus luteus
MSNPKVFFDMAIAGNPAGRIVMELYADTTPRTAENFRALCTGEKGVGRSGKPLHYKGSTFHRVIPNFMCQGGDFTAGNGTGAESIYGAKFADENFIKRHTGPGILSMANAGAGTNGSQFFICTEKTEWLDGKHVVFGKVIEGMNVVRDIEKVGSGSGKTSRPVTIADCGQLS

SEQ ID NO: 26273 - protein, 105 aa, Citrus sinensis
GEGTATQDSNNSGANSNGTATNGGEEDLKSWDTDFVKVDQATLFDLILAANYLNIKGLLDLTCQTVADMIKGKTPEEIRKTFNIKKDFTPEEEEEVRRENQWAFE

SEQ ID NO: 26274 - protein, 163 aa, Uromyces viciae-fabae
MANCYFDVSSNGKPLGRIVFELYDDVVPRTTNNFRQLCLNPPGKGFKHSIFHRVIPDFMIQGGDFTNGNGTGGESIYGKKFEDENFQKKHVERGMLSMANAGPNTNGSQFFITVTKTPWLDGKHVVFGKVIEGYDQVVKAMEKTGSQSGKTSSVLKIEDCGTL

SEQ ID NO: 26275 - protein, 462 aa, Streptomyces avermitilis MA-4680
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 26276 - protein, 341 aa, Hordeum vulgare
MASRAAAAIAVLALVCAAVHSSEGQLSPNFHAATCPDLERIVEFHVAETFRRDVGVVPALIRILFHDCFPQGCDASVLLKGAGSELNEIPNQTLRPVALDLIERIRVAVHRACGPTVSCADITVLATRDSLVKAGGPSFDVALGRRDGLAPASSALVGLLPVPFFDVPTLISSFANRSLDVADLVSLSGAHTFGVAHCPAFEDRFKPVFDTNPAIDGKFATALRNKCAGDNPAGTLTQNLDVRTPDVFDNKYYFDLIARQGLFKSDQGLIDHPTTKRMATRFSLNQGAFFEQFARSMTKMSNMDILTGTKGEIRNNCAVPNRRVQDIETAVAGDEGIAADM

SEQ ID NO: 26277 - protein, 546 aa, Saccharomyces cerevisiae
MSQVQSPLTATNSGLAVNNNTMNSQMPNRSNVRLVNGTLPPSLHVSSNLNHNTGNSSASYSGSQSRDDSTIVGLHYKIGKKIGEGSFGVLFEGTNMINGLPVAIKFEPRKTEAPQLKDEYRTYKILAGTPGIPQEYYFGQEGLHNILVIDLLGPSLEDLFDWCGRRFSVKTVVQVAVQMITLIEDLHAHDLIYRDIKPDNFLIGRPGQPDANKVHLIDFGMAKQYRDPKTKQHIPYREKKSLSGTARYMSINTHLGREQSRRDDMEAMGHVFFYFLRGQLPWQGLKAPNNKQKYEKIGEKKRLTNVYDLAQGLPIQFGRYLEIVRNLSFEETPDYEGYRMLLLSVLDDLGETADGQYDWMKLNGGRGWDLSINKKPNLHGYGHPNPPNEKSKRHRSKNHQYSSPDHHHHYNQQQQQQQAQAQAQAQAQAKVQQQQLQQAQAQQQANRYQLQPDDSHYDEEREASKLDPTSYEAYQQQTQQKYAQQQQKQMQQKSKQFANTGANGQTNKYPYNAQPTANDEQNAKNAAQDRNSNKSSKGFFSKLGCC

SEQ ID NO: 26278 - protein, 199 aa, Lactococcus lactis subsp. lactis Il1403
MNEKKKGFWSEAIRVTKENDPAARTALEVFLTYPGVKALAAHRISHFLWRHHLKLLARMHSQFWRFWTQIEIHPGAEIAHGVFIDHGSGLVIGETAIVEKDVKLYHGVTLGGTGKDKGKRHPTIRQGALISAHSQLLGPIEVGENAKVGASAVVVTDVPPEVTVVGIPAKVVRVKGKKDVERITSLEEKREASYHSSHL

SEQ ID NO: 26279 - protein, 502 aa, Vitis vinifera
MDTEIPGGGAAVGVQIHCSRRLPDFLQSVNLKYVKLGYHYLVSNLLTLCLVPLMIGILIQASQTNPDDLRHLWLHLQYNLVSVIICSAILVSATTVYITRRPRPVFLVDYACYRPPDHLQVRFHQFMDHSKLTGDFTESTLEFQRKILERSGLGEETYVPQAMHYLPPRPSMSAAREEAEQVMFGALDALFSDTCIKPKDIGILVVNCSLFNPTPSLSAMIVNKYKLRGNIRSFNLGVIAIDLASDLLQVHRNTYAVVVSTENITQNWYFGNDRSMLIPNCLFRVGGAAILLSNRSRDRRRAKYRLVHVVRTHRGADDKAFSCVYQKQDDVGKTGVSLSKDLMAIAGGALKTNITTLGPLVLPISEQLLFFATLLVKKLLKSNAKPYIPDFKLAFNHFCIHAGGRAVIDELEKNLQLLPEHVEASRMTLHRFGNTSSSSIWYELAYTEAKGRMRKGNRVWQIAFGSGFKCNSAVWEALRHVQPSRNGPWEDCIDKYPVKVVT

SEQ ID NO: 26280 - protein, 754 aa, Oryza sativa Indica Group
MARYPDDPHDRVWFPWFDAAKWNEISTTNRVQNIDNDLFEAPTAVMQTAVTPINASNNIDFFWNSQPQPNDPAPGYIAIFHFSELENLPNNASRQFYININGILFDDGFTPSFLYAEASYSSKPFVRHPQYNITINATANSTMPPLINAVEVYSVISTANIGTDSQDVSAIMTIKAKYQVKKNWMGDPCLPRNLAWDNLTCSYAISNPARITSLNLSKIGLSGEISSSFGNLKAIQYLDLSNNNLTGSIPNALSQLSSLTIFTGGEDDDGWLMVDNNDGAAGGRQRQRWRTVEGAARAVEGRRRGEQRDLTGNQLNGTIPPGLLKRIQDGFLNLRYGNNPNICTNGNSCQPPKNKSKLAIYIVVPIVLVLAIVSVMTLLYCLLRRKKQGSMNNSVKPQNETMRYGPTNNGSRHNSSLRLENRRFTYNELEKITNKFQRVLGQGGFGKVYDGFLEDGTEVAVKVRTESSNQGDKEFLVEAQILTRIHHKNLVSMIGYCKDEKYMALVYEYMSEGTLQEHIAGKGNDGRYLTWKERLRIALESAQGLEYLHKGCNPPLIHRDVKGTNILLNTRLEAKIADFGLSKVFNPENGTHVSTNKLVGTPGYVDPEEILIVRLIGTDQMRRYQSTMQPTTKSDVYSFGVVLLELVTGKPAILRDPEPISIIHWAQQRLARGNIEGVVDASMHGDYDVNGLWKVADIARKCTALSSAHRPTMTDVVAQLQECLELEDKHQVSDINNGFYNGNSGDLNSNFYTT

SEQ ID NO: 26281 - protein, 321 aa, Lactococcus lactis subsp. lactis Il1403
MVYSDSHLKLFALNSNPGLAEKISQFTGVPLGKLSSKQFSDGEIMINMEESVRSQDIFIVQSTSCPVNDHLWELLIMIDACKRASARTINVVIPYFGYARQDRTATSREPITAKLVADMIVKAGADRLLTLDIHAVQVQGFFDIPVDNLFTVPLFADYYRKSGLFGDDVIVVAPKNSGIKRARSLAEYLESAIAIVDYEDDDKNRENGYVIGNVSGKKVILIDDILNTGVTFANAANVVREAGASEIYAVASHGLFTSGAADVLEKVDIKEILVTDSVVTNHRKPLNVKYLSAAEYLASAILRIHEGRPVSPLFEHEKPQD

SEQ ID NO: 26282 - protein, 426 aa, Mycobacterium sp. MCS
MLAPFPLRTGGAMSTGSGHIRLTSHSGAVGTPTIHWGAPTAAERGPVIGTTANRSHRNVIGTHSGSYSVYRALAVAAGALKREHRADLTDTSPTDTIGPYPQWGEPATIVSMDPWGASVADVFTAELAAGLDIRPTIAITKAHVILPEITDAIAKGRLVPDGRVLLASGAALVTKAAVEPVWWLPGVAQRFGCSETDLRRVLFEETGGMYPELVTRSDLEVFLPPIGGQTVYIFGSATDLADPSVELTARVHDECNGSDVFGSDICTCRPYLTHAIEECIRGAQNGGVGLVAYSRKEGRALGEVTKFLVYNARKRQVGGDTADQYFARTECVAGVQDMRFQELMPDVLHWFGIRKIHRLVSMSNMKYDAITGSGIEVGERVNIPEELIPPDARVEIDAKMAAGYFTPGPVPDAEKLKQVKGRGLSQ

SEQ ID NO: 26283 - protein, 701 aa, Oryza sativa Indica Group
MSRYPDDPRDRVWTPWDSPSNWTEISTTRPVQQTYDDLFEVPTAVMQTAIVPMFATDNIELAWVAYTQPKDPSPGYIAIMHFSELELSPPSRDVREFYINLNGNMMYSKGYKPVYLYAHAIYNTNPFLRYPQYNISINATYNSTMRPFINAMEVYSVFSTTTIGTYGQDASAMMVIKEKYQVKKNWMGDPCIPTEFTWESLTCSYENSKHVIKINLSSSGLSGEISSSFGDLKALQYLDLSNNNLTGSIPDALSQLPSLTVLYGNNPNLCTNDNSCQAAKHKSKLAIYIVAPVVLVLVIVSVTILLFCLLGQKKKQGSMNTSIKPQNEANYVPTNDSDGHGSSMQLENRRFTYKDLEKITNNFQRVLGRGGFGKVYDGFLEEGTQVAVKLRSESSNQGDKEFLVEAQILTRIHHKNLVSMIGYCKDGKYMALVYEYMSEGTLQEHIAGKRNNGRHLTWRERLRIALESAQGLEYLHKWCNPPLIHRDVKATNILLNARLEAKIADFGLSKSFNLENGTHVSTNTLVGTPGYVDPEYQATMQPSTKSDVYSFGVVLLELVTGKSAVLRDPEPISIIHWAQQRLAQGNIEEVVDACMCGDHDVNGVWKVADIAFKCTAQVSARRPTMTDVVAQLQECLELEEEHCAVNDANNNFYTSNNSNPNSSYDTYAADHSIDVSQNSVAFEMEKNFGRMPSTAPGPATR

SEQ ID NO: 26284 - protein, 203 aa, Lactobacillus sakei subsp. sakei 23K
ITMAEHLPAGKKLSDCKVVFVGDATQVCVSLMFVATKMGMQFVQYGPKGYQIKPETLAIGQKNAEVSGGSVLITEDTDQAMRDADFVYTDVWYGLYESPLSYDERMAIFYPKYQVNDELMAKAAKHAKFMHCLPANRGEEVTDSVLDSDASVAWDEAENRLTAMRALLVYLMAPIIDYSDDTLNNLKDPALKDLLNNRIDSTK

SEQ ID NO: 26285 - protein, 942 aa, Oryza sativa Indica Group
MAAWSWLILLCLVAAATAGVLQARAQPDSKGFISVDCGLPGKTSYVDDKTKISYAADDGFTDGGSFHNISAEYITPALSARYHNVRSFPDGARNCYTLRSLVAGLKYLIRATFMYGNYDGLSKLPIFDVYIGVNFWMMVNISDPSGATLLEAIVVVPDDFVQVCLVNTGTGTPFISGLDLRPLEKKLYPQANDKRGLSLFGRWNFGPISTTEFIRYPDDPHDRIWMPWVSPSYWVEVSTTRPVQHTDEDVFDAPTKVMQTAIAPLNASSNIEFAWVPYTQPKDPAPGYITVMHFSELQLRSSNATRQFYINLNGNMVFSQGYTPAYLYADAIFNSNPFLRYPQYNISINATANSTLPPIINAIEVFSVFSTATVGTDGQDASAMMVIKEKYQVKKNWMGDPCVPKTLAWDKLTCSYDSSKPARITDINLSSGGLSGEISSAFANLKALQNLDLSNNNLTGSIPDALSQLPSLAVLDLTGNQLNGSIPSGLLKRIQDGTLNIKYGNNPNLCTNDNSCQPEKHKSKLAIYVAVPVVLVLVIVSVTILLFCLLGRKKKQGSMNTSVKPQNETTSYVPTNGSHGHGSSMQLENRRFTYNDLEKITNNFQRVLGEGGFGKVYDGFLEDGTQVAVKLRSESSNQGDKEFLAEAQILTRIHHKSLVSMIGYCKDGKYMALVYEYMSEGTLREHISGKRNNGRYLTWRERLRIALESAQGLEYLHKWCNPPLIHRDVKATNILLNARLEAKIADFGLSKTFNLENGTHVSTNTLVGTPGYVDPEYQATMQPTTKSDVYSFGVVLLELVTGKPAVLRDPEPISIIHWAQQRLAQGNIEGVVDARMHGDHDVNGVWKATDIALKCTTQVSAQRPTMTDVVAQLQECLELEEGRCAISNANNNFYTDNNSNSNSSYDMYATDHSIDVSQNSAAFETERNFGRMPSTATGPAAR

SEQ ID NO: 26286 - protein, 912 aa, Oryza sativa Indica Group
MAARWWLLLLLGLAVAGVVRGQGGAPDTSGFISIDCGLPEKTSYVDDATKLKFTSDDAFTDAGTIHNVSSEFATPKTTTDRSLYNVRSFPAGARNCYTVPSVVPGSKYLVRAKFLYGNYDGLNKPPVFDLHLGVNFWQTVTVPSADWLGNAEVIAVVPDDFLQVCLVNTGAGTPFISGLDLRPLPSSLYAPANATQGLVLLDRRNFGASGSTVIRYPDDTYDRVWWPWSNPPAEWSDISTADKVQNTIAPVFDVPSVVMQTAITTRNSSIPIQFSWDTKPNHVYPDPGSIFTLYVTELELLAGNAVRQFNVTINGVIWTKAPYKPVYLSTDAMYNGDRPYRGITRYNFSLNAAGSSTLPPILNAAEAFSVISTADLATDAQDVSAITAIKAKYQVNKNWTGDPCAPKTLAWDGLTCSYAISTPPRITGVNMSYAGLSGDISSYFANLKEIKKLDLSHNNLTGSIPNVISQLQFLAVLDLTGNQLNGSIPSSLLKRSQDGSLTLRYGNNPNLCSNSSSCQLPQKKSNSMLAVYVAVPVVVIGAVAVFLILFIRKKKNKSKGAVKPQILGNGVQSHSQNGSGGSLLELHNRQFTYKDLAVITNNFQRVLGKGGFGPVYDGFLKDGTHVAVKLRDESSSQGYSEFLTEAQTLTKIHHKNLVALIGYCKDEIHLALVYEHMSEGTLEDKLRGKDHKGRSLTWRERLRIVLESAQGLEYLHKACSPRFVHRDVKSSNILLNANLEAKVADFGLTTAFKCDGDTHVSTVRVVGTYGYLAPEYATALQVSEKIDVYSFGVVLLEVITGQPPIIKLPEPTTIIQWTRQRLARGNIEGVVDVNMPDDRYDINCIWKVADVALKCTAHAPGQRPTMTDVVTQLKECLELEETSFKGDTSSSYMSGSSIDPNSSYNTYTTEMS

SEQ ID NO: 26287 - protein, 287 aa, Tamarix sp. ZDY-001908
MEGKEEDVRLGANKFPERQPIGTAAQTHEEKDYREPPPAPLFEPSELTSWSFYRAGIAEFIATFLFLYITILTVMGVKRSDSMCKSVGIQGIAWAFGGMIFALVYCTAGISGGHINPAVTFGLFLARKLSLTRALFYMIMQCLGAICGAGVVKGFMPTIYQVQGGGANEVAHGYTKGDGLGAEIVGTFVLVYTVFSATDAKRSARDSHVPILAPLPIGFAVFLVHLATIPITGTGINPARSLGAAIIYNRSAAWNDHWIFWVGPFIGAGLAAIYHQVVIRAIPFKSK

SEQ ID NO: 26288 - protein, 285 aa, Pseudomonas fluorescens PfO-1
MSAPSVLIAGCGDVGSRLATQLLAAGFQVYGLRRDISRLPDGVIGVAGDLFNEDCPATWPVGAIDYLVYSAAATDHDEAGYRAAYVQGLQHVLGWLNDYGQEPERLLFVSSSSVYGQQSGEWVDEKSETVAAGYSGRLMLEAEQVALNSGIPASIVRLTGIYGPGREWLLTQVRRGYRVAVDPPLYGNRIHADDAAGLMAFLLDADRKGVTLDDIYIGVDDAPAPLAEVVAWLREYLGVTEWSEDESVRRTGSKRCSNARAKTLGWVPKYPSYREGYAAILEGRC

SEQ ID NO: 26289 - protein, 320 aa, Kineococcus radiotolerans SRS30216
MPDPSPLAPLVVVVTTGGTIASTVDEDGVSRPTLGGDALLGTAGDEAGVRVRVVEALRVDSSTLTLAQADLVRARVAEALADPGVAGVVVLHGTDSLEETAYLLDLHHDDPRPVVLTGSQRTADHPAPDAPANVREALRVAADGLARGQGVLVAFGGRVHAAAGTTKRHTTDLDAFAAPDRALPRAGALTAVGSPDAPWPRVDVVAAHPGTDGALLDAARELGARGVVLQGLGSGNATAEVVAAVARAVAAGVVVVLTTRVPAGPVATSYGSGGGGAELAAAGAIPAGRLRAGQARVLLAVLLRAGADRGEVAREFARRG

SEQ ID NO: 26290 - protein, 568 aa, Bacillus cereus ATCC 14579
MSKFTVASNGALETTLRGAEVLSTPLLNKGVAFTQNEREELGLKGLLPPAVLTLEEQARRAYEQFSSQPDDLLKNVYLTALHDRNEVLFYRILTDHLREMLPIVYTPTVGVAIQRYSHEYRKPRGVYLSINDSSGIEEAFTNIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDVCTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENDVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAESVARVNLSDNDIKMAVQEAMWKPRVSPNKSGRKG

SEQ ID NO: 26291 - protein, 537 aa, Physcomitrella patens subsp. patens
WVDPNILKLSHRIGRGPFGDVWLATIHSSTKDFDEFHEVAVKMLPDSREHMHSLLQRFQSTYQQVETVRGQVCIIMKFLEGSIGDKIAHLPSSKLPLEDVLRYGQHLLRGILELHSHGVLALNLKPCNFLLDDQDVAVVGEFGIPMLYAGMVAPSERTVWLGSPNYMAPEQWGANVRGPVSFETDCWGFACSVIELLTGERPWKNLTPEKIFKAVVDRHEKPNVPTGLPPSLERVLKRCFEYDYRRRPSKGQGVGVVKTVLGPDSVKVQFCDKPRELTQFSGVNQLSNLSLWKYSFQVGDSVRLKASVNSPRFGWPGENATEGTVSEIGIDDAVFIVVFTGSQQTWRADPLELERVAGGIVANDWVRSRNLVESNGQNPSRIGIVHHVGPSGSLKVSFFGLETLWTGEAADFENVSPLTVGQYVRLKQAVLAPRFKWPLTECGEWDTGRIAHVLPNGGLIVDFPGRLFHGKGWWADSEEIEVIRISEIEGLLKKYQHIEKMHWVVRPAVSLIGLLVAVRTGVVVVNLVTRPFRGKKQ

SEQ ID NO: 26292 - protein, 323 aa, Salmonella enterica subsp. enterica serovar Typhi str. CT18
MSKIYEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 26293 - protein, 539 aa, Silicibacter pomeroyi DSS-3
MRFISQLDKDSDCYRRNRADMLALVDQLRALEARPMALSEERRARMEARGQITPRDRLARLLDPGLPFVQLHSLAGYMVDSADPETSVPGASVIIGIGFVSGVRTVVVVDDSGIKAGAMTEMTAAAFLSAQEVALKQRLPFLHLVESAGANLMEYRVELWAHGGKLFRNLARLSAAGIPNIAVLHGPSTAGGAYMPGLADYVVGVRKNGMAALAGAALVHAATGERANDRDLGGSEMHAQTSGLVEYLAEDDAHGIEIARQVVAALDWNKSLPERPAPADIAPPLDPEDLAGLVPVDYRVPYDMRELAARVVDGGVFQDFKPRYGVSTVCLQAAIQGIAVGIIGNNGPIDPDGATKAAQFIQLCGQSDTPLIFLNNTTGYMVGTAYEQAGMIKHGAKMIQAVTSVDVPRITLYVGASFGAGNYGMSGYAYEPDFLFAWPNATTGVMGGEQAAGTMAMVARAGAARKGQDLDEARLAKQSAMIAAHFDQQSDAFYTSGRCLDHGVIDPRDTRRVLAFCLHTCREARARRVKPGSYGVARF

SEQ ID NO: 26294 - protein, 473 aa, Xanthomonas citri
MQHPRAFACLGDRVTDLLVRTSVEEGDAHVCFLRAHKRCRAVRAGQSIECGGVEQEHEIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 26295 - protein, 581 aa, Zea mays
MEAAPSARAFSPSSSPSAGARPSLPLAGLASRRARVLAAPPPPRAVASSRAPLVVSSPPPPEDSGTHNPAHAKVDRSGRFCSPRAARELALMISYAACLEGTDVVRLFDRRISARREPGFVFNKACLLNYNHMSFGGGPLEVGTEQEAEKLASQNDKDSANEADVLSAPPKLVYNNYVLRELLVAVASGWDKHVVIIDKIIPQAWKDEPVARILELCILHIAMAEMASKGTPHKVVINEAVDLAKRFCDGGAPRANTFCLQGLAFNLRESKSSVPLNRGMKPFLAAISVSPGASAFKRRGTWGSFELKESGGNEMDGEYARHWMSADVKSRVSSSVGRSGSDDLFRPYEISGWAGYASLVAAILKLHETVRMDWPNSWAAVVPSSSVMLRDCGTMLKIRLCSHEEGNKDRNIVSTVNLDCKLDLKAIALQARNAEYNPKRFAAVIMRIREPKTTALIFASGKMYARIIQKLGFPAKFKNIVGSCDVKFPIRLEGLAYSHGAFSSKIVLTGAKVREETYTAFENIYPVLSEFRKIQQWVDGYSVQLTYVMYSFMEHVWDWAPMTCDVKVTFFKLQASSRILV

SEQ ID NO: 26296 - protein, 251 aa, Oryza sativa Japonica Group
MKSPELQSSVIRDLVLLSCVGLRPVLVHGGGPEINSWLGRVGVEPQFRNGLRVTDALTMEVVEMVLVGKVNKQLVSLISVAGATAVGLCGKDARLLTARPSPDAAALGFVGEVTRVNPSVLHPIIESGHIPVIATVAADETGQAYNINADTAAGEIAAALGAEKLLLLTDVSGILADRNDPGSLVKEIDIAGVRQMVADGKVGGGMIPKVECCVRALAQGVHTASIIDGRVPHSLLLEILTDEGTGTMITG

SEQ ID NO: 26297 - protein, 303 aa, Salmonella enterica subsp. enterica serovar Typhi str. CT18
MNTLEQTIGNTPLVKLQRLGPDNGSEIWVKLEGNNPAGSVKDRAALSMIVEAEKRGEIKPGDALIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKTVTIVGLQPEEGSSIPGIRRWPTEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 26298 - protein, 387 aa, Silicibacter pomeroyi DSS-3
MNISSDTGFRRAGRLDGIELSEIVQISERVAQLRADGADIVALSTGEPDFPTPTHVIEAAHRAALAGQTRYPATAGTPALRAAIAAEAGVEPANVIVSTGAKQVLAGAFLATLDPGDEVITTAPFWTSYADMVRLAGGVPVVLDCPGAQGFKLTPAQLEAAITSRTRWLLLNTPSNPTGAIYSEAELQALGAVLDRHPHVWVISDEIYQHLAYVPFTPFVQAVPTLADRTLIVNGVSKAYSMTGWRIGWGIGPAPLIKAMVAVQGQITSGACSIAQAAALAALSGPQDLLVERRAEMLARRDLVVAGLNAAGLECASPDGAFYVFPKTPARMPVDHDFCHHLLDTAGVALVPGRAFGMSGHLRLSFAYARQSLEEGLARIARAVAAL

SEQ ID NO: 26299 - protein, 251 aa, Borrelia burgdorferi B31
MTKLRLKSKDEIKKIKASASLLALTLLEVERNIVPGISTKELDLIAYDFIIKNRAKPAFKGYRGFKGTICASVNEEVIHGIPGKRKLADGDIVSIDCGVILDGFYSDMAKTFKVGNVDSSIDKLLEVTNASLYKGIAEMKVGNRILNISKAIEDYIKPFGFGIVREYTGHGVGFELHEEPSVPNYYAPFFKNIRIQEGMVLAIEPMVNLRGHKVSIKSDGWTVFASDLSYSAHFEHTVAVVDGLPLILSEV

SEQ ID NO: 26300 - protein, 334 aa, Bacillus halodurans C-125
MAILVTGGAGYIGSHTVLFLLEQGEQVIVLDNLQKGHAGALSDVTFYHGDIRDDQLLDTIFTTHSIDTVIHFAANSLVGESVKQPIEYYENNVIGTHTLLKKMLEHDVKKIVFSSTAATYGEPVQIPIQESDPTIPTNPYGETKLAIEKMFHWCQEAYGLQYVCLRYFNAAGADPNGRIGEDHSPESHLIPIVLQVALGQRERVAIFGDDYQTEDGSCIRDYIHVMDLANAHYLACEHLRKDGQSGSFNLGNGKGFSVKEVIEVCRQVTGHPIPAEIAPRRSGDPASLIASSEKAQTILGWEPKYPSLETMVEHAWNWHKEHPHGYSTENKDKQ

SEQ ID NO: 26301 - protein, 494 aa, Streptomyces avermitilis MA-4680
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 26302 - protein, 323 aa, Physcomitrella patens subsp. patens
MSWCTIESDPGVFTELIQQMQVKGVQVEELYSLELESLSQLRPVYGLVFLFKWRAGEKDGRPVLKDYNPNLFFASQVINNACATQAILSILMNRPEIEVGPELSTLKEFTRGFPPELKGLAINNSEAIRTAHNSFARPEPFVAEEQKVADKDDDVYHFISYLPVDGVLYELDGLKEGPISLGECGGEGPDSMDWLQMVQPVIQERIEKYSKSEIRFNLMAVIKNRKDIYNEEMTQLEMRRARLWDRIEKLEGKRDDTMDFADVESELAKVQDKIAMEDEKFRKWKTENIRRKHNYIPFLFNFLKILAEKKQLRPLIEKARQKT

SEQ ID NO: 26303 - protein, 253 aa, Vitis vinifera
MESSYEAVRNDEPANPGLQIIRYTPYQSWSSPWFDLRVFYVRISNFEVDDSTPEYLTLNHIPLSPDTLLEVNGTRSSIFSDGVSSLLRRDRVDKKSEEATFVSTDSIRLTGSVKFEVFDKEDLILSGALEMSNIEDQCQAMEHEFFRKKHNRKGALDSIPEYETTECQKNVPSSLDLQMSEYTNYKPESEEDYMYWRRTEFMEGEDGELSWFNAGVRVGVGIGLGICLGIGIGVGLLVRTYQATTRNFKRGLM

SEQ ID NO: 26304 - protein, 64 aa, Brassica napus
AQLPVRPSPYHNDHSSTPPVHARVYTTTAQDHNNYRGGSGLHSTGFGNTTHSLYGNNKVMHDES

SEQ ID NO: 26305 - protein, 481 aa, Mycobacterium sp. MCS
MTNLSLDGRFARELPEMAVRWKAEEAPDPRLLVLNDELASGLGLDADWLRSPDGVRLLVGNSVPDGATPVAQAYAGHQFGGFAPRLGDGRALLLGELVDGDGRMRDVHLKGSGHTPFARAGDGLAAVGPMLREYLVSEAMHALGIPTTRSLAVVATGRPVRRESVLDGAVLTRVASSHLRVGSFQYAAVTGDTDLVRRLAGHAIARHHPEVAGAADPYLGLFEAVCSAQAQLIARWMLVGFVHGVMNTDNMTISGETIDYGPCAFMDVYDPETVFSSIDSWGRYAYGNQPSIAAWNLARFAETLLPLFDDDIDRAITLAQNALGAFGRHYEGALTAGMQAKLGLTGVDGPAVAPLLDELLKLLQDNHIDFTSFFRALGLAARGDNEPVRGLFVDLAGFDAWLDSWRALGPDGAAMDRVNPVYIPRNHLVEEALTAAAAGDMEPFETLLDAVTGPFDERPGLQRYAEPAPEAFGRYRTFCGT

SEQ ID NO: 26306 - protein, 533 aa, Pediococcus pentosaceus ATCC 25745
MILMSNEIKNPKKRRKLVEYANGRSLEEINGTVKVPKNIGFWKALFMYSGPGALVAVGYMDPGNWSTSITGGQNFQYMLMSIILISSLIAMLLQYMAAKLGIVSQMDLAQAIRARTSKSLGIVLWILTELAIMATDIAEVIGAAIALYLLFHIPLAIAVFITVLDVLLLLLLTKIGFRKIEAIVVCLIMVILVVFVYQVALSNPNWGAVFSGLVPTTKAFETSPTIGGMTPLSGSLGIIGATVMPHNLYLHSAVSQTREIDHNDEEDVARTLRFSTWDSNIQLSFAFIVNSLLLVMGVAVFKSGAVQDPSFFGLFHALNDTSTLSNGILIGVAKTGVLSTLFAVALLASGQNSTITGTLTGQVIMEGFIHMRMPLWARRLITRLISVVPVLICVMITSGKGDLQEHEALNQLMNNSQVFLAFALPFSMIPLLMMTDSRVEMGDRFKNSWAVKILGWISVIFLTYLNMTGLPNSITAFFGANPSAGEVELAHIIAYMLVAVVLALLAWTVFELHKGNQRYELEMRSKAEAKEEA

SEQ ID NO: 26307 - protein, 346 aa, Spiroplasma citri
MFKGGLMEEKSFSIYGLSAGIKLADEICKILGVTRQGMETVRFADGEILVRAMNSVRGKDVYIIQSTSWPVNENLMELLIAIDALKRGSAQSINVIIPYFGYARQDRKARGRQPITCKLVANMLTTAGTTRVMTVDLHSPQSMGFFDVPVDDLRSTQELVRTIVRKIEEDHLKEEVTIVSPDHGGLVRARDVANRLGNLAGNIAVIDKRRPKPNVSEVQFILGDVKDRICFIVDDMIDTAGTICNAAKALKQHGAKAVYLLACHGVFSPPAKERLTELINDGTVKKVIVTNTIDINQDRLFVGLEIISIADLISQMIKAMIEKRSLSDVYSKCNEQIKKIIEKIKK

SEQ ID NO: 26308 - protein, 288 aa, Oryza sativa Japonica Group
MACSHLAAAAAAASPAAARSPAASSAATASAFARLSATPRVASGGLAVRGQRGVAAVVAAAAGAAAATPVADIEERRATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVRYDEELGKALFNGLPNPFTAARYHSLVIEQETFPHDALEATAWTEDGLIMAARHKKYRHIQGVQFHPESIITPEGKRIILNFVRFIEELEKQRAGEKN

SEQ ID NO: 26309 - protein, 243 aa, Oryza sativa Japonica Group
MAAGGGGGDELKLLGLWASPYVLRAKFALSFKGLSYENVEEDLHNKSELLLSSNPVHKKVPVLIHNGKPICESQIIVEYVDEAFPDAGESLLPSDPYDRAVARFWAAYINDKFMPAWQKASLGLTEKKKAKAVKQMLAAIENLETAFKELSKGKPFFGGDTAGYLDVTLGAVVGWARAGEVLFGRKLFDATRSPLLAAWMERFVALDAVKAVLPDNAELIEYGKMRMAHYAKLAAALAAANKK

SEQ ID NO: 26310 - protein, 340 aa, Vitis vinifera
MASSTLICDTEPWKNLRAHVEDIKKTHLRDLMSDTKRCQSMMVEFDGLLLDYSRQCATLETMDKLFKLAEAENLKQKIGRMYNGERINSTENRPVLHVALRAPRDSVIQSDGKNVVPDVWKVLDKIQVFSETVRSGSWVGATGKALTDVISVGIGGSFLGPLFVHTALQTDPEASKFAKGRQLRFLANVDPVDVARNITGLNPETTLVVVVSKTFTTAETMLNARTLREWISAALGPSAVAKHMVAVSTNLTLVEQFGIDPNNAFAFWDWVGGRYSVCSAVGVLPLSLQYGFSVVEGWGRLAARGAAAEGGWDAESDSWGLCRVGLLRWALWWSLVGLRV

SEQ ID NO: 26311 - protein, 348 aa, Triticum aestivum
MESLPVPSVQAMVAATGGADVPPRYLRPAEAVTGIVDGEGEAQIPIIDYRRLLLELDRRGEESARLHSACQEWGFFQLVNHSVPADVVEGMKANIQQFFQLPAETKKRFAQERGQLEGYGQLFVVSEDQKLDWADMLYLYTQPPESRNTKFWPDQPVNFRSTLDRYSGAVKEIADSLLATMAENLGLKQEVIADRCVGGVQSVRMNYYPPCAQAEKVVGFSPHSDADLLTLVLQVNHVQGLQIKRNGSWFPVRPVEGALIVNIGDIFEIFTNGRYRSIEHRAVVDPKEERLSAAAFHSPNIHATIGPLKELTADEDEAYKTVDHENFMRLFFATKLEGKSFLDRMKLK

SEQ ID NO: 26312 - protein, 409 aa, Bacillus cereus ATCC 14579
METIVQKFGGTSVGSVERIQHVANLIIEEYERGHSIVSVVSAMGKSTDELVALANAITENPSKREMDMLLSTGEQVTISLLTMALQAKGYHAISLTGWQAGITTESVHSSARITDIHTDRIQSYLAEGTIVIVAGFQGVSEDFEITTLGRGGSDTTAVALAAALKAKKCDIYTDVTGVYTTDPRVVKDAYKLDEISYDEMLELANLGAGVLHPRAVEFAKNHNVVLEVRSSMEQENGTIVKGECNMEQQSIVKGIAFEDNITRVTIKGLEQGSLSTVFSTLAAAHINVDIIIQSITNEGTVHLSFSIHSNDLRETLEVLEQNQEALHYEAVEYENHLAKVSIVGSGMVSNPGVAANMFTTLKEEDIHIKMVSTSEIKVSVVIDRLHLVTGVEALHQSFMAKIEPFVQMS

SEQ ID NO: 26313 - protein, 330 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAMRSGSSMSADGPMNLYNAVNVAINKASTNKGVVIVMNDEIHAAREATKLNTTAVNAFASPNTGKIGTVYYGKVEYFTQSVRPHTLASEFDISKIEELPRVDILYAHPDDTDVLVNAALQAGAKGIIHAGMGNGNPFPLTQNALEKAAKSGVVVARSSRVGSGSTTQEAEVDDKKLGFVATESLNPQKARVLLMLALTKTSDREAIQKIFSTY

SEQ ID NO: 26314 - protein, 288 aa, Pediococcus pentosaceus ATCC 25745
MNVFEESYKLSNGVKIPKLALGTWEIDDDQVADAVRSAIEMGYRHIDTAQAYANERGVGEGVRTASVPREEIFVNSKIAAEIKNYDDAKKSIDETLNKMGLDYLDMMIIHNPQPWAEVNQSDDRHFEGNLEVWRALEDAMHEGKLRAIGVSSFQKEDLDNLIKNSDTKPMVNQILSHIAATPMDLINYSHENGIVVEAFSPIAHGQALRSEAIQKMAAKYNVSAPQLSIRYDWQLDTVVLPKTSNPEHMKSNAELDFVISDEDMEILKQVKPLDYGDASVFPVFGGKM

SEQ ID NO: 26315 - protein, 310 aa, Zea mays
HMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 26316 - protein, 287 aa, Zea mays
MAAPPVQPVPTAAAAAAAVNGDAFRLGFVGAGNLAESIARGVAASGVLPASAIRTAPHRRPERGEAFASFGACLLQTNAHVVDDSDVIVISVKPQIVKQVLLQLRPRLSEKKLLVSIAAGIKMQDLQDWSGQRRIIRVMPNTPSAVGQAASVMCLGEMATQDDENRVRKLFSAIGKVWTAEEKYFDAVTGLSGSGPAYIFLAIEAMADGGVAAGLPRDLALGLASQTVLGAATMVSQTGKHPGQLKDQVTSPAGTTIAGIQELEKGAFRGTLISAVVAAAKRCRELS

SEQ ID NO: 26317 - protein, 159 aa, Ostreococcus tauri
  misc_feature (159)..(159): Xaa can be any naturally occurring amino acid
MEVSVSFSPSARPARFATSFRIIQIPPPQLDTRDVPIAMVALDVEAVSRMSPGRFFRDHTSAVNALDFHHTEDQMVTTGDDDAIHVYNTNTGAKTKTLYSKKYGCANVTFTHSAAAVVYSSRAKGSGGAAIDDHAVRYHSLHDNTYVRYFKGHSDAVTX

SEQ ID NO: 26318 - protein, 263 aa, Salmonella enterica subsp. enterica serovar Typhi str. CT18
MGKLTGKTALITGASQGIGEGIARVFARHGANLILLDISDEIEKLADELGGRGHRCTAVKADVRDFASVQAAVARAKETEGRIDILVNNAGVCRLGNFLDMSEEDRDFHIDINIKGVWNVTKAVLPEMIKRKDGRIVMMSSVTGDMVADPGETAYALSKAAIVGLTKSLAVEYAQSGIRVNAICPGYVRTPMAESIARQSNPDDPESVLTEMAKAIPLRRLADPLEVGELAAFLASDESSYLTGTQNVIDGGSTLPESVSVGV

SEQ ID NO: 26319 - protein, 286 aa, Thermotoga maritima MSB8
MQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 26320 - protein, 1227 aa, Oryza sativa Japonica Group
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCSVRRYNACKLQCMDPSMFGVSMPLLLLWRVKFLSLEGCSQLTTRGLESVITSWSDLQSLKVVSCDKIKDEEISPALSELFSTFKELKWRPDNKSRLAASLAGTGMGKKGRVLCKRLREREMKGKGQRTDAGAQLSTNRARMSVKGRAPPPEEGKKNGEKMAAAAAIPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDVERTNPVPPRFIHKATPARLMRRARSSHNYRRRLGAMDAINEWRLPKVSEEEDEAVDQTDWQADTLSSRISSARDWNFEAGGAYEGSDHNGGAFNHSDGENSPVAVQRMGRWPQGSAVKHKENFVHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWFLEVFVCPSNCNQNNSSALSTIPMRSGEGRDCEVPGSTAVQGTNVPTISQEQDRSVYKELRSQNEEFFELFMLKVSLKRQIDRVNHHLALCRKLWRQANESAGGHRCGNSSCSGGHRHRAVAVPVPHAEATPRAMPSTPLAVPLPATAMAQRTQCNLARMPRPQQPNCGGRPGSSRGGAVGLSAAGRMLETPGQPHVAPNGWPAGHGHPASGTLAAAMACSSRPVARQQGNRREQGWDAHQAQVGAQHQNLPRFPPQQGGGNIGERQGQGQFRPGTPSYVQEQRPPPQSSSSHEALQAGERQQANNNSSGSSRQQRQTDTATVASRREPMSK

SEQ ID NO: 26321 - protein, 565 aa, Zea mays
MGSTAAVSVSASAIASRGCARSEAARRPGGIRVCGLRSEVLTCHSLRISQAPARLTVARPPPPAAATNGAAAGTCGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRINLTNSMKALGVDILTGVGTIVGKQKVRYGKAGFPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDADGNVVPNLYCIGDANGKLMLAHAASAQGISVVEQISGKDHILNHLSIPAACFTHPEISMVGLTEPQAREKADKEGFEINVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 26322 - protein, 272 aa, Bacillus cereus ATCC 14579
MDKQIGFIGCGNMGMAMIGGMINKNIVSSNQIICSDLNTANLKNASEKYGLTTTTDNNEVAKNADILILSIKPDLYASIINEIKEIIKNDAIIVTIAAGKSIESTENAFNKKVKVVRVMPNTPALVGEGMSALCPNEMVTEKDLEDVLNIFNSFGQTEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 26323 - protein, 515 aa, Citrus unshiu
MASIGSLKVPSSPSTAATSSNSNNHSRRSVVKRLAFSSSQLSGDKIFSKAVTGDRRRERRRSLCLLQAVSDSKNSPLDPEASRRVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKLATAFGLMKIDEEGRIIEFSEKPKGEQLKAMKVDTTILGLDDARGKEMPFIASMGIYVISKDVMLSLLRDKFPGANDFGSEVIPGATSIGMRVQAYLYDGYWEDIGTIEAFYNANLGITKKPIPDFSFYDRSDPIYTQPRYLPPSKMLDADVTDSVIGEFCVIKNCKIHHSVVGLRSCISEGAIIEDTLLMGADYYETDADRRFLAAKGSVPIGIGKNSHIKRAIIDKNARIGNNVKIVNRDSVQEAARETDGYFIKSGIDTIIKDALIPSGTII

SEQ ID NO: 26324 - protein, 289 aa, Magnetospirillum magnetotacticum MS-1
MTDQPTPDSSIAFQGEPGAYSHLACRNAYPGMQPLPCATFEDTFAAVREGRARYAMIPIDNSVAGRVADVHHLMPYAGLHIIAEHFERISHHLLAVPGATLATIKSVKSHVHALGQCRNLIRELGLKVIVGTDTAGAAAELAERQDPTMAAIASELAAEAYGLVSLKAGIEDAEHNTTRFVVLAREALEPNPNQPCVTTFVFRVRNVAAALYKALGGFATNGINMTRLESYMVGGEFAATQFYADVEGHPTQRNLRLALEELDFFSHEVRILGVYPRHPFRMKQQGGGQ

SEQ ID NO: 26325 - protein, 872 aa, Burkholderia pseudomallei K96243
MRRAEESQLKQQASHDQIVLVAPLTGPVVPLADVPDPVFSGGMFGDGIGIDPLEGRLLAPCAGVVSHVARTGHAVTIAADGGAEILLHIGIDTVELNGLGFTAKIAEGARVAAGDLLIEFDQDAIARAAHSLVSVIAIANSDAFEVVERAGAGVVKAGETPLLALRARGAGASAGTSASASAGAAADASCAQPAAEARKSITLTQPGGLHARPAARAREAARGLDAHVDVHFEGRKAALQSVVGLLGLGAGEHATIELVATGRDAAKALERVAHELLREAHGEAEEKPARIVSPAPAAAGIARAPLEPNTLAGVCAAPGIAVGTLVRWDDAQIVPPELASGTPAAESRLLDRALAEVDAQLETTVREASRRGAIGEAGIFAVHRVLLEDPALVDAARDLISLGKSAGYAWRETIRAQTAVLADVDDTLLAERAADLRDIDKRVLRALGYASASARELPAEAVLAAEEFTPSDLASLDRERVAALVMARGGATSHAAIIARQLGIPALVAVGDALYAIAQRTQVVVDASAGRLEYAPSALDVERARHERQRLAGVREANRRMSGEAALTRDGHRIEVAANIATLDDARVALDNGADAVGLLRTELMFIHRQAAPTASEHQQSYQSIVDALQGRTAIIRTLDVGADKEVDYLTLPPEPNPALGLRGIRLAQVRPDLLDDQLRGLLAVKPYGSVRILLPMVTDVGELVRIRKRIDDFARAMGRAQAVEVGVMIEVPSAALLADQLAQHADFLSIGTNDLTQYTLAMDRCQADLAAQADGLHPAVLRLVDATVRGAEKHGKWVGVCGALGGDPVAVPVLAGLGVTELSVDPVSVPGIKAQVRRLDYQLCRQRAQDLLALESAQAVRAASREIWPAE

SEQ ID NO: 26326 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 26327 - protein, 401 aa, Coccidioides immitis RS
MPDFPSHSSSYLAPQPIHPKRQFTEFALPTDSPASAPTSGPRDAPRSVKDDEISRSSSHNAADESDASTAPLPASIISPAQTPPLTPGSLLPSLLSPQPGTKDRPPFTKPPKLLPRLPNVECIVRARIPTTSGSEMFLHLYQNDVDNKEHLAIVFGNTIRSRSLDRVREGETEMDRMIRGAYVGRLRPGRISSRYDDDDSAEKPSSASPKIKDPGEENESLPEESASGEVKAPLVRIHSECYTGETAWSARCDCGEQLDEAARLMSADPTGGVIIYLRQEGRGIGLGEKLKAYNLQDLGSDTVEANLLLRHPADARSYGLATAMLVDLGLGIDSENVGIRLLTNNPDKIRAVEGPNREVIVKERVPMVPLAWSTNGEKGIRSTEVEGYLRTKIGKMGHLLS

SEQ ID NO: 26328 - protein, 288 aa, Robiginitalea biformata HTCC2501
MEDQGEVASYIPELAKVDPANFGVHISTIDHRHFGSGNCYDKFSIQSIAKVLALVMAYRIVGDEIWNRVGVEPSGTAFNSLVQLETDRGIPRNPFLNAGAIVVSDILLSKLKNPREDFIAFVRSITNNTSLDYSRRIAQSEKEVGYRNVALCNFIKSFGQINNEPVDVLDFYYDLCSLEMSCQELSGLFLFLANNGCDVKSKNPVLSESQSKRINALMQTCGFYDESGDFAFKVGLPGKSGVGGGIIAVHPDQYAIAVWSPRLNKKGNSYRGMKFLEEFTTRSELSIF

SEQ ID NO: 26329 - protein, 225 aa, Lactococcus lactis subsp. lactis Il1403
MTIKENVKRILSNVDAAKAASSYSNQSVSVVAVTKSVDANLAREVFENGVSHLAENRTELFLEKYEALKDLEITWHLIGNLQRRKVKQVINYVDYFHALDSLKLAQEINKRAEHTIKCFIELNISGEESKHGFSVNELMEILPEFSELENIEIVGLMTMAPFDATESECNDIFGRMKKLQVEISEMNLSRIPCTELSMGMSRDYEIAIKNGATFVRIGTEFFKNL

SEQ ID NO: 26330 - protein, 281 aa, Lactococcus lactis subsp. lactis Il1403
MQRKLTLNDGNVIPQFGLGLYQLPEGTETQNIVKTALELGYRHLDTSHAYQNETSVGQAIQDSEISNSEIWITSKLWPSDYEQAPEAIERMLKRLKVKQIDLLLLHQQVGNYRKAWIALENAVKEGKVKSIGISNFDGERLVDLFNFADIKPSVIQVETHPYHQQVELQEFLKPYGTKIESWYPLGHGDKNLLEEKIFKKMAKKYNKTVAQIILRWHIQEGIIVFPRSTQKEHLAENINIFDFELSCSEIKEIRKLNKKQPYFTMTYEEQEKNFLSWKLED

SEQ ID NO: 26331 - protein, 877 aa, Frankia sp. CcI3
MTASVSPPSPSRHSHSPPMSGSTAKNVRRTRGDHNPLRPDLQASLVVFVVALPLSLGIAVASGAPVAAGLLAAVIGGVVAGALGGAPLQVSGPAAGLTVIVADLVHTYGWRVTCLITAGAGILQILLGLCRVARASLAVSPAIVHGMLGGIGLTIVLGQFHVVLGGQAESHAWENVAAVPEAIIDPHGFATLVGFVTIATILLWPRLPKRLPNAVRAIPAYLAAVVTGTLLAAVAGFDLPRVDLPSSLFDAVALPGLPHGDWSGIALGVVTVAIVASVESLLSAVAVDQLATTRGWRGPRVDLDRELLGQGSANLVSGLAGGLPITGVIVRSSTNVASGGRTRKSAVLHGVWVLLFAVFLGRMVEWVPLSALAGLLVVVGARLVNVAHLRHVRRHGELPVYLVTIVGVVALDLLQGVALGLLTALALVLRRVLWSSVRLVRTGELWQVEVEGTLSFLSLPRLARILGRIPAGAPVSIELIVDYLDHAAYEHLRGWCANHEASGGTVSVDEIGQVWFRRPAEVAEQRRRTVVPHLPRWFAPWSQWQELELASSSSDSPSSDSPSSDSPSSGSRSSDSQPAGVTPPAIHPVQGPDPAASVPAQASPDRTFDHVSTMLFGVNEFHRRAAPLLRGTFDALAGGQQPGALFLTCADSRIVPNIITSSGPGDLFTIRNVGNIVPVDDPAGSDPDAPLRRSGDLSVTAALDYAVDVLRVPSLVVCGHSGCGAMQALLSGTLDGAPDSALAGWLSHAAASLERTPPAGTEDLPPVERLGRANVAQQLENLRAHPAVRRALARGTLELVGLYFDIADARIWVLEESTGRFVDPMDALPTAVIGTGSRRRWDAPVRVPAPMVAVGAGPADEQPPPAGRRARWLGLPR

SEQ ID NO: 26332 - protein, 2334 aa, Pediococcus pentosaceus ATCC 25745
MVFAGMGVVAGLFGAGSGMTVSADEKPGVSLDLSQSEDLLATQTSATIPGSTSTSSSSTGESTSNSTKAVDSKSTNATTDAKSETQSNSSAKSTSADKNSASQKTSESTSLSTSASTSQSKSLSSSLKEAQTKSTSKDATKVADNQQSKQKDGKEQKNAKSDAKQDVKQTAKDDNVKTSQSTASSSTASNQGSEHAQINDNISSLSNSTSGSITESASGSLSVSLSNSLFVSDSRKRDKDSASNSQSLAKSLSNAKAQAENASVQGVNDATQIVTYTDENGKELAPSETTLHNSGEKPDIPGPKKIKGYVVDTSKSEIISNGAAVPFSLYLQLGKFSSIEELLDLINSSDAYPVGTVEIKYVYKVYNSKISITGKNGATTTGNPLDIASLVNSITNADGSKGDINNVTSPDLDQVDWNKGGTYTVTLNYFDPSTLETATTTVTVTVEDNSASTSTSTSSSLSNSVSKSDSITSDSTSKSASTSGSTSTSVSGSKSVSQSISASKSTSTSGSTSVSVSNSKSTSDSASRSVSTSKSTSTSGSTSVSNSKSTSDSVSQSISTSKSNSASASGSVSDSVSKSKSDSITSDSISNSISTSVSGSKSTSDSASQSISTSKSTSTSGSTSVSNSKSMSDSVSQSISTSKSTSTSGSTSVSNSKSTSDSLSQSISASKSTSTSGSTSVSNSKSTSDSVSQSISTSKSDSTSASGSVSDSVSKSKSDSITSDSISNSISTSVSGSKSTSDSVSQSISTSKSTSTSGSTSVSNSKSTSDSVSQSISTSKSDSITSDSISDSISTSISDSTSTSHSTSDSVSTSNSNSDSKSKSESRSTSTSISDSISDSNSKSTSESRSTSTSSSDSKSDSASKSDSISKSDSITSNSISESISTSNSDSSSKSDSKSTSESRSTSTSVSDSISDSNSKSTSESRSTSTSVSDSTSDSTSTSHSTSDSVSTSNSDSNSKSTSESRSTSTSISDSKSDSASKSDSVSKSDSITSNSISESISTSKSDSSSKSMSDSRSASTSVSDSTSDSASTSHSKSDSVSTSNSDSSSKSDSVSTSDSRSTSTSVSDSISKSMSDSRSTSTSVSDSKSDSESKSDSISKSDSITSNSISESISTSNSDSISDSNSKSTSDSRSTSTSISDSKSDSASKSDSVSKSDSITSDSISESISTSNSDSISDSNSKSTSDSRSTSTSVSDSKSDSASTSHSTSDSVSTSNSDSSSKSDSVSTSDSRSTSTSISDSTSDSASTSHSTSDSVSTSNSDSDSKSTSDSRSASTSVSDSKSDSASKSDSTSKSDSITSNSISESISTSNSDSSSKSDSKSTSDSRSTSTSVSNSISDSNSKSTSDSRSTSTSVSDSTSDSVSTSHSTSDSVSTSNSDSDSKSASDSRSTSTSVSNSISDSNSKSTSDSRSTSTSVSDSTSDSVSTSHSTSDSVSTSNSDSDSKSASDSRSTSTSVSNSISDSNSKSTSDSRSTSTSVSDSTSDSASTSHSTSDSVSTSNSDSDSKSTSDSRSASTSVSDSKSDSESKSDSTSKSDSITSNSISESISTSNSDSSSKSDSKSISDSRSTSTSVSDSTSDSASTSHSTSDSVSTSNSDSDSKSMSESRSTSTSVSDSTSDSASTSHSTSDSVSTSKSDSSSKSTSDSRSTSTSISDSKSDSASKSDSISKSDSITSNSISESISTSKSDSSSKSDSKSTSESRSASTSVSDSTSDSISTSHSTSDSVSTSNSDSSSKSDSKSTSESRSASTSVSDSTSDSTSTSHSTSDSVSTSNSDSSSKSASDSRSTSTSVSDSISDSNSKSTSDSRSASTSVSDSTSDSTSTSHSTSDSVSTSNSDSDSKSMSDSRSTSTSISDSTSDSTSTSHSTSDSVSTSNSDSSSKSDSVSTSDSRSASTSVSDSTSDSTSTSHSTSDSVSTSNSDSSSKSDSKSASDSRSTSTSVSDSTSNSTSASHSTSDSVSTSNSDSDSKSMSDSRSTSTSISDSTSDSTSTSHSTSDSVSTSNSDSSSKSDSVSTSDSRSASTSVSDSTSDSASTSHSTSDSVSTSNSDSSSKSDSKSASDSRSTSTSVSDSTSNSTSASHSTSDSVSTSNSDSSSKSDSISTSESRSASTSVSDSTSVSTSDSRSTSTSISDSTSNSISDGNGSTSHDNHHGSGSESNSESGSQSTSDSQSISTSISDSTSDSKNSGSASQSISTSQSKSTSASISTSQSASTSVSSSHNGASSQNDDNGKGTTNGNSEVDQQGNGQGNGGTGSYNQEQNFEATDTEVVRTTAQVKHQSTVDLNDASQNSRQQSRLPQTGETDNSGWTWLGTTLLALVGLGKKRKKDNED

SEQ ID NO: 26333 - protein, 219 aa, Avena fatua
STILKQIKLIHEGGYSRDERVPFKEIIFSNTVQSMRVILEAMESLELPLDDQRAEYHVRPSSCSRHRLRATRAFGVGNAISVLWKDAGVQQCFQRSNQYQLNDSAKYYFDSIDRYLAPDYIPNDQDVLRSRVKTTGIVETTFIIGDLTYRMFDVGGQRSEHKKWIHCFENVTTILFLVAISEYDQLLFEDETVNRMQEALTLFDSICNSRWFVKTSIIL

SEQ ID NO: 26334 - protein, 416 aa, Thermotoga maritima MSB8
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVMAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 26335 - protein, 531 aa, Citrus unshiu
MDSCCVGLRANTHVVKASKYGSKIGDNALWGERIRGSVRNDGCTKQLKKSLKAEKRDEKVKPGVAYAIMTSKHPNEVMTLAPPRLERRRVDPKNVAAIILGGGAGTKLFPLTLRAATPAVPVSGCYRLIDIPINSGINKIFVLTQFNSASLNRHIARTYFGNGTNFGDGFVEVLAATQTPGESGKNWFQGTADAVTRFTWVFEDAKNRNIENVAILCGDHLSILCGDHLYRMDYMDFIQSHVDRDADITISCAAVGESRASDYGLVKIDNMGRIAQFAEKPSGANLKAMQVDTSLLGFSPQEARKSPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 26336 - protein, 449 aa, Oryza sativa
  misc_feature (252)..(252): Xaa can be any naturally occurring amino acid
MATRHQRAAAAPQPANRGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQLERRPTDYMSSQVEVNPKMRAILADWIIDVHYKFELMPEDLXLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 26337 - protein, 374 aa, Ustilago maydis 521
MDLRVGGKYRIGKKIGSGSFGDIYLGINIISGEEVAIKLESIKAKHPQLEYEAKVYKTLAGGVGVPFVRWYGQECDYNAMVIDLLGPSLEDLFNFCNRKFSLKTVLLLADQMISRIEYIHSRNFIHRDIKPDNFLMGIGKRGNQVNVIDFGLAKKYRDPKTHLHIPYRENKNLTGTARYTSINTHLGVEQSRRDDLESLGYVLMYFLRGSLPWQGLKAATKKQKYDRIMEKKMTTPTELLCRGFPSEMAIYLNCCRSLRFDDKPDYSYLRKLFRDLFVREGFQYDYVFDWSIQQRSEDAKADPVVKQQQAQQQAAQLPRRKVLPQEGDEAVANGMDTTRTAYGTARPADKAYLTSQNMPSSSRPPKREDQTGYY

SEQ ID NO: 26338 - protein, 147 aa, Triticum aestivum
HPYPRKGRAMASGAVRPKLAYIVCYVKDVPKSAAFYADAFGYSVRRVDDSHKWAELDTGSTTIAFTPLHQRETDALTGEVQLPKSPRERGPVEICFDYDDVDAAYRRAVENGAVPVSAPEQKNWGQKVGYVRDCDGITVRLGSHVRE

SEQ ID NO: 26339 - protein, 578 aa, Debaryomyces hansenii CBS767
MAPSSKERKGTGVNVESQQVNGKTKTSGNVKNKLEHEGPVATAAAKGSKGKVEDEGVLQYTPLDEIPVRVARLTESFHKTRKTHSIQYRLNQLRNLYFAVKDNVDPLCDALYKDFYRLASETKNLEITGGLSELLHVMSSLHKWIQPEKVTDLPVSMLATPVYIERVPLGTVLVISPFNYPFLLSLSSIVAALAGGNVVVFKPSELTPHFSKLFCEIVSNALDDDIFYAINGAIPETTKALEQKYDKIMYTGSTMVGTIIAKKAAETLTPVLLELGGKSPCFVLDDVKGKDLPTIARRIVWGRFTNCGQTCVAVDYVLAHASIKDKLVKAMVKVVEEEFYGSLNKDDRNYTHLIHDRAFANLSRVLDDTKGDVVVGGLRDESSRFFSPTIIDNCSWDDSTMKAELFGPLLPILTYTDLSVATAEVVQNHDFPLAQYIFTSGSTSRKNPQVDQILTSIRSGGAVVNDVLMHFSLTNAPIGGVGASGQGAYHGYYSFRAFTHERTTMEQPLFNDFALAARYPPFNDKKDKLIQSSMSRHNGNVWFSRTGDVSYNGPNPLWSFWTGFTGICTLGYNLVNSL

SEQ ID NO: 26340 - protein, 456 aa, Bacteroides thetaiotaomicron VPI-5482
MRNLLQKCFKWQWLVCLAVGCCFSSCKDDEESTSGYDPNKPIVLTDFYPPEGKLATQVILNGSNFGDSKENVKVFFNDKEASVISVKDDRMLVLAPKRASTIEDPECVVKVQVHEQIEEYKQTFDYYIQTTVTTLVGGSTSAQVNPTGTIPLSEAQFRANIDRCICVDQDKNVFFLVDNDGKFAAFMLNEEADKLISLKSDINALFNSPVLGYNSKDDIVYQFWANRDSHEVYYFDPKTDYAPTTAISSISWDDPNFPNIEGFGVWAAKCNFTMGPDGKMYSRMLGGNLVRIDVENARGENLTNGDLVGTKDGSAYGLVFDPQDENVFYFSNNDKHCIYKYDLRTKECACWAGQEGKSGYLDGPIGQAMFNKPGQMCVDSEGNIILTDTENHCIRKITMSTGYVSTLAGKPQNSGYVNGSAEDAQFKKPLGICIDNDDVMYIGDSENRAIRRLAVE

SEQ ID NO: 26341 - protein, 554 aa, Oryza sativa Indica Group
MEQYEVLEQIGKGSFGSALLMELIAKVRNPYIVEYKDSWVEKGCYVCIVIGYCEGGDMSEAIKKANSNYFSEERLCMWLVQLLMALDYLHVNHILHRDVKCSNIFLTKDQNIRLGDFGLAKVLTSDDLTSSVVGTPSYMCPELLADIPYGSKSDIWSLGCCLYEMTALKPAFKAFDMQTLINKISKSVLAPLPTIYSGAFRGLIKSMLRKSPDHRPSAAELLKHPHLQPFVLELQLKSSPARNLFPDTNKASCSDDENNWKAKYSKSHSFKVDRIVKVDKVAANNGHPSSTGTAKDYQELLKQPMDELLGQLTEKVVDEVIHGNHSRVTKSPAPTPRRASSTPRIRLEPSKTFHARAAETPPSKCSLERASQPTRRASTPVNMLQTPEKRQGADILTRLKSPDVSVNSPRIDRIAEFPIPSFDDEQLHPTTKLKLYPPSITDQSITKDKCTFQVLRSDSSKNHTGDSSDPSILGTDSNPLITSSSDWMKQRRFDTTSYRQRAEALEGLLEFSAQLLQQERFEELGILLKPFGPGKASPRETAIWLSKSFKGTGL

SEQ ID NO: 26342 - protein, 288 aa, Mycoplasma genitalium G37
MIDHLKRTKIIATCGPALTKSLVSLKMLDDNEYAAIKKVAYANIEAIIKSGVSVIRLNFSHGTHEEQQVRIKIVRDVAKAMNIPVSIMLDTNGPEIRIVETKKEGLKITKDSEVIINTMSKMIASDNQFAVSDASGKYNMVNDVNIGQKILVDDGKLTLVVTRVDKQHNQVICVAKNDHTVFTKKRLNLPNAQYSIPFLSEKDLKDIDFGLSQGIDYIAASFVNTVADIKQLRDYLKLKNASGVKIIAKIESNHALNNIDKIIKASDGIMVARGDLGLEIPYYQVPYW

SEQ ID NO: 26343 - protein, 247 aa, Leptospira interrogans serovar Lai str. 56601
MNDLFNVKNKTVLVTGSTRGIGRYFAEGFKNAGAIVYGTGSSQESIKKFDGSGIKGFAADIRQPDVMTPIIESIVKEHGRLDVLVNNAGIASNKPAAFLKEDEIESIIQTNFTGVFRACTAYYKIHKKKGGNIINIASILGMRGTKLASVYSGTKGAVINMTRALAVEWIGSGYRVNAICPGFIDTDMTEMIKEKPDVLEQMTNAIPMGRLGKPEDLVGAAIFFASDASSYVTGQTIVVDGGITAGL

SEQ ID NO: 26344 - protein, 98 aa, Mycoplasma genitalium G37
MIKACRFFNKRSITATQMLDSLEKNIQPTRAEVTDVYFAVDRGNDATMLSGETASGLYPLNAVAVMQKIDKQSETFFDYQYNVNYYLKNSTANKSRFW

SEQ ID NO: 26345 - protein, 297 aa, Thermoplasma acidophilum
MLDMEKDLSEIIDLSIELKKNRYRSYESLRNKVLGLIFEKPSTRTRTSLEVAIDQLGGHAVYLNPSEMQLGRGETISDTGHVLSRFLDAIAYRAYDHRNVVELARSTSIPVINALDDVEHPLQIVADFMTIKEKKGRFTNLKFSYIGDGNNMANSLMLGAAILGTDMYVASPKGFEPKQEFVEKARSIAKQHGSSITITNDPVEAARDADVIYTDVWISMGEESKKGEKEKAFKDFQINEKLVSNAKRDYIFMHCLPAHRGLEVTDGVADSINSVIFDEAENRLHSEKGVLYKLLSY

SEQ ID NO: 26346 - protein, 376 aa, Thermoplasma acidophilum
MTLCNHWYGDLLNLYEYMGKDIFRQYGIPVPNGYVVSSVDEVRKLTNPVAVKSQILLGGRGKAGGIKFAKTDQELKDAVKALLGAKVRNLTVTKVLIEDMLNIKHEYYVSITLNRSARAPTVIASAMGGVEIETVPDEKIFKRIIDPSLGYSDFIGREASTFMGLSPDLSKQFLDLLKKLYNVYKGEDAELVEINPLVETNDGKLIAADAKVVIDSDAMFRHREFNIQDPEKTPLELKAEGKGYAFVELDGDIGVIANGAGLTMATLDALLLHKGKPRNFLDLGGTDNVDIVVNAFDLVLEAKPKAILVNIFGGVTKCDTVAQGIVDAKKKFDIKIPIVVRLSGIHEEEGRQILKENGIEAFSEMMPAIERVTKVF

SEQ ID NO: 26347 - protein, 651 aa, Vitis vinifera
MANHHKGKFFWLYLLFLFASPPAVRIFINCSPDSIELLPINETTEESSIFDRQQIQIQKLEEIVKNLTELVSKLESRLSEPSKVDHDLVGSSLGAEEKEKNDQRKFGDKKWAKEDEDEGFEGRIKDEVRDGEKGRAVSVTKYSPFWSERFQFVSAVKLDSDATCINILPFRDYEGLSKYVVVGDERGRVYVFLRNGDVLVEFYTSSDSPITAMLSYMSVSKNESIVVTGHKNGAILVHRVWEAWNGEEWSSLSMEHVRTFDSETGEDGLEITILEVHHIGRMRYILSTNIGGEIRVFRENGSVHGSAKPMSRPLVFLKQRLLFLTENGAGSLDLKTMKVRESECEGMNHSIAKNYVFDAAERSKAYGFTSDGDLFHVFLLGDIVNFKCRARSKRRFDMGEPLAFQAIKGYLLIVNEEKVFVYNVSSQHYGRVGGPRFVFSTGLDEIRSSFLNYQAMEVDGRRRVIPLIASDREKLVILGLGGGYVGMYRSNLPVFKGEFNTMLWTSPVLFFILFLFGAWQFFAKKKEALISWGPDDPFVSTSAMTGAPLGTSSGDRAFPDSSSRNADIMDLRGGGLRGPSRRYVSPPRYPSGAASSFRPGSTDHNSRPASVDPNFRTASELKFRGSNLESSGFQKRRESMFVNSPAVDDSN

SEQ ID NO: 26348 - protein, 498 aa, Arabidopsis thaliana; identical to SEQ ID NO: 974

SEQ ID NO: 26349 - protein, 262 aa, Lactococcus lactis subsp. lactis Il1403
MKTIGFIGVGKMATAIISGLDKNKFKIIISGHNLTKTQKQAETLNVTATSNHEELVQESDFIILSVKPQVLPSVLSKLINHLTKDKTLISIAAGLTLSDLKHLADSENQPIIRVMPNINAQIGQSTSAIVKNEFVDDSAYATVQEIFKSTGSVHEIAEKDFSTFAAIAGSSPAFIYMFIDAMARAGVLHGIPKDQATAIVAETVRASAEMILQSGENPWSLVDKVSSPGGTTVAGVVSLEQNHFIGTVIDAISATIEKEKNL

SEQ ID NO: 26350 - protein, 312 aa, Sulfitobacter sp. EE-36
MTLKLSEPLMPPLPEILAQLNADMRATDDWGDVAAYIPQLASVDPAQFGIAITTADGEVFTAGDADTPFSVQSITKVFTLAIALGRSGDQLWKRVGREPSGRAFNSIVQLEAEQGRPRNPFINAGAIVTTDEVLTGREPRETLAEILQFVRAAASDDDIHINETVAASETAHGHRNFALAHFLASCGNLNNPPEKTLGTYFHHCAIDMSARQLAMAGRFLIETDKLPRMILPPRIRRLNALMLTCGHYDGSGDFAYRVGLPAKSGVGGGILAIVPGRASIAVWSPGLNRYGNSKKGTQAMARLAREMGWSIF

SEQ ID NO: 26351 - protein, 504 aa, Bacillus halodurans C-125
MFEETVEKLKRGGSEKYHEANQQKGKLFARKRLELLFDDGLAAEDGLFANCQVDGLPADGVITGIGKINGQTVCVMANDSTVKAGSWGARTVEKIIRIQETAEKLNVPMLYLVDSAGARITDQVEMFPGRRGAGRIFYNQVKLSGRVPQVCILFGPSAAGGAYIPAFCDVVIMVDGNASMYLGSPRMAEMVIGEKVSLEEMGGAKMHCSVSGCGDILAPSEEEAIGLARDYLRYFPSSYSKRPPIEDGREPKSFTKTIEEILPKNQNAPFNMYDLIDRVIDEDSFFEIKKLFAPELITGLARIDGKPIGIIANQPKMKGGVLFHDSADKAAKFITLCDAYHIPLLFLADIPGFMIGTKVERAGIIRHGAKMISAMSEATVPKISIIVRKAYGAGLYAMAGPAFEPDVCLAFPNAQIAVMGPEAAVNAVYANKIAELPEEERAAFIAEKREEYKQDIDVYRLASELVIDGIIQGNQLREELKTRLTAYASKELTFTTRKHPVYPV

SEQ ID NO: 26352 - protein, 421 aa, Corynebacterium glutamicum
MALVVQKYGGSSLESAERIRNVAERIVATKKTGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKLQVQGNWTNVLYDDQVGKVSLVGAGMKSHPGVTAEFMEALRDVNVNIVLISTSEIRISVLIREDDLDAAARALHEQFQLGGEDEAVVYAGTGR

SEQ ID NO: 26353 - protein, 828 aa, Frankia sp. CcI3
MSAREGQVPAGGGGRGFADRAATVAVTTPDGSVPWDVANSRATPLLDSDPVTVGTYQLVARLGQGGMGIVYLGRSRDGRPVAVKVVRTDLARQPEFLARFRREAEVAQRVARFCTAEVLEVDVEADRPYLVTEFIDGPTLADAIAANGPMAEADLERLAISVAAALTAIHAAGMIHRDLKPSNVLLSRLGPRVIDFGIARAMDSTTSLTTSTGLIGTPAFMAPEQARGALVTAAADIFAWGGVVTFAGTGIGPFGKATTPVLLYRAVHEAPKIDGLPDGLRSIVAKTMSKEPADRPTASDLYQSLLGLSNVDEAVRGEAGPTAVTVVTDPPVKPPARMDAGASRTPSDSVGSVGSANPAMPPPSDDILSPLDLSPLDRPAPGRGYPEGGEPKQQQRQRRGRWQRRTVVSLVASLCAVAVAVTATLMFVTHKDPASVPESIEVSRRLASEAAAASTTQPQLARQLALAAYRVEPTEEAQRSLIENFGGVEINTLVGHTERVIGVRFSPNGRMLVTGSDDSTVRLWDISNPMATRPLAVIPGDSGTFLQGGFSADGRLLSTSTDDHIVRLWDISVPERPRSLAVLRDVNNSVAFAVGGKTMATAGTDNTAKLWDITDPHQPRLAATLVGHTDWVNTVAFSPDGRMLATGSHDRTIRLWDVSTPTRPTPLAILNGHENAVLGLAFRPDGRILGSTSADRSARLWDIATPTEPKMLYTFTDRSDWVSSVAFRVDLHLMGTTARKAARLWDISDPRNPRPVGGLLGHTATVRRVQFSPDGTLAATSGDDNTARLWDIDPAHIAKRACTDPTAVMSEAEWERHAPQIPYPSRCP

SEQ ID NO: 26354 - protein, 447 aa, Schizosaccharomyces pombe
  misc_feature (1)..(1): Xaa can be any naturally occurring amino acid
  misc_feature (97)..(97): Xaa can be any naturally occurring amino acid
  misc_feature (377)..(377): Xaa can be any naturally occurring amino acid
  misc_feature (386)..(386): Xaa can be any naturally occurring amino acid
  misc_feature (433)..(433): Xaa can be any naturally occurring amino acid
XCLPTIRKIAIIGAGPSGLVTAKALLAEKAFDQVTLFERRGSPGGVWNYTSTLSNKLPVPSTNPILTTEPIVGPAALPVYPSPLYRDLQTNTPIELXGYCDQSFKPQTLQFPHRHTIQEYQRIYAQPLLPFIKLATDVLDIEKKDGSWVVTYKGTKAGSPISKDIFDAVSICNGHYEVPYIPNIKGLDEYAKAVPGSVLHSSLFREPELFVGESVLVVGGASSANDLVRHLTPVAKHPIYQSLLGGGDIQNESLQQVPEITKFDPTTREIYLKGGKVLSNIDRVIYCTGYLYSVPFPSLAKLKSPETKLIDDGSHVHNVYQHIFYIPDPTLAFVGLALHVVPFPTSQAQAAFLARVWSGRLKLPSKEEQLKWQDELXFSLSGANNXYHSLDYPKDATYINKLHDWCKQATPVLEEEFPSPYWGEKERSIRENXWSIRAKFFGIEPPK

SEQ ID NO: 26355 - protein, 352 aa, Bacillus subtilis subsp. subtilis str. 168
MWKGLIHQYKEFLPVTDQTPALTLHEGNTPLIHLPKLSEQLGIELHVKTEGVNPTGSFKDRGMVMAVAKAKEEGNDTIMCASTGNTSAAAAAYAARANMKCIVIIPNGKIAFGKLAQAVMYGAEIIAIDGNFDDALKIVRSICEKSPIALVNSVNPYRIEGQKTAAFEVCEQLGEAPDVLAIPVGNAGNITAYWKGFKEYHEKNGTGLPKMRGFEAEGAAAIVRNEVIENPETIATAIRIGNPASWDKAVKAAEESNGKIDEVTDDEILHAYQLIARVEGVFAEPGSCASIAGVLKQVKSGEIPKGSKVVAVLTGNGLKDPNTAVDISEIKPVTLPTDEDSILEYVKGAARV

SEQ ID NO: 26356 - protein, 201 aa, Griffithsia japonica
GTRGSNKVSGVNATEVVKPEGGVESSRESRRQQRWLRKGMQQVKARHELVTGSMLQERRKAVFCRRSGIHGFGLYAQEEIEAREFVIEYVGVVIRQSVADVREREYEEGGVGDSYLFRLNGEMVVDATRRGGIARFINHSCDPNLTATTQRVGGTERIVFYSRRHIGKYDELTYDYKFALEGDDKKIRCLCKSLNCRKFLN

SEQ ID NO: 26357 - protein, 417 aa, Triticum aestivum
  misc_feature (31)..(31): Xaa can be any naturally occurring amino acid
MARLSRRRFLLSLHVALLLLVPCSCQVAAAXNSWIPPAARDCGVGLYCGDCAAAGRTRPSCIRDLAIQPTSIVKGLPFNRYSWLVTHNSFSIVGEPSRTGVERVTFYNQEDTVTNQLRNGVRGLMLDMYDFGGDVWLCHSLQGQCYNFTAFEPAIDTLKEVEAFLSENPTEIVTIFIEDYVHAPMRLSKLFTAADLMKYWYPISEMPTSGQEWPTVTDMVAKNHRLLVFTSDASKESSEGIAYQWSYLLENESGDPGIDPSTCPNRKESQPLNSRSASLFMQNYFPTIPVESEACKENSVGLPQMVQTCYAAAGNRIPNYIAVNFYMRSDGGGVFDVQDRINGLTLCGCNTIAACQAGAPTGACKNTGAPNQTTSSVNGNVYSGTIEFKTSASRASSTSTWSNLVISLSLALILKPF

SEQ ID NO: 26358 - protein, 377 aa, Mycobacterium leprae
MAANVSSGAQFGYLQLWVVVVANVLAGLVQYLSAKLGLVTGQSLPQAISKQMSHPFRLGFWLQAELVAMATDVAEIVGGAIAFHILFRVSLLLGGVITGTVSLLLLMVKDRRGQLLFERVITGLLFVIVVGFTSSFFVATPSPEDMVNGLLPRFQGTESVLLAAAIIGATVMPHAVYLHSGLALDRHGHPHAGRSRRRLLRVTRLDVILAMTIAGIVNTAMLLVAAINLQHHQVTAYIEGTYTAIQDTLGATIAMLFAIGLLASSLASASVGAYAGALIMQGLLQRSIPMLIRRLITLCPAIAILALGFDPTRALVLSQIVLSFGIPFAVLPLVKLTNNRGLMGNDTNHPATTVLGWAVAILVSLLNVVLIYLTVTS

SEQ ID NO: 26359 - protein, 425 aa, Physcomitrella patens subsp. patens
VGWESFLLKRSLRILLVEYDDATRHVVGALLRNCDYEVTAVANGSIAWGLLEDANSNFDLVLTDVVMPRLSGVGLLSKMMKREACRRVPIVIMSSYDSLDIVFRCLSKGACDYLVKPVRKNELRNLWQHVWRKCHSLDQQPDVGRQQDDDDACVMQDVGPSPGEDNVESPSTSGKDGTTEESSLKAVDLINGIACQPQTQGAEQAEGSENDDGELDQRGRSSPKDHSGSDFGSMLELSLKRPRSAVDNDGDTEERQPLRHSGGSAFSRCMQHEQQQSVITPMSGAPRCGSTGVDGQSGSSNGYGSTGNGNGSMNGSASGSNTGVNNGQNGLVVTPMANANSGNNGVGGTHPAMDGVSGGNGLCTEQIRFARREAALNKFRQKRKERCFEKKVRYQSRKKLAEQRPRVRGLFVRQAAHDPSAGDAE

SEQ ID NO: 26360 - protein, 487 aa, Ostreococcus tauri
MITDETYGRWKSLVPFVYDWFAHTRTSWPSLSARWGEVVDANAYRSRQRVYVTEQTEGEDGRTGKPMPNTILVCQAEVLRPRVAAAEHMIFDEHSKSPALRKEKALWHPGEVNRMRCVPGRENVLMTHTDAPEVFVFDASGPGGKQNSLKRADGTQYTPPAMCLRGHKENAEYALAISQKGEVVASGGKDGMVMIWELADANKGGGKKEDGGVGAPVVGGGLSSTELARHTCVWARCELAGHTDTIEDVCFNPQNEKELCSVGDDRAMFFWDTRTKKATGFANGAHSDDVHCVGWSAHDEHVVVTGGKDTVVKVWDRRMLTNGSNEAMHTFDTHTDSVLCVDMHPHAKGVFMTADEVGRVNVFDYTKVGAEQTPELAKAGAPYLVLQHSGHRGTVWDIQWNPYDPWTVCSTSVGDFQNTLQLWRVNDMIYRDTEECIRELEQHRDIICGRQAPLKSKDAAQENKEDSEGAAEKDDASGADADDAMEE

SEQ ID NO: 26361 - protein, 338 aa, Salmonella enterica subsp. enterica serovar Typhi str. CT18
MIIERARELAVRAPARVVFPDALDERVLKAAHYLQQCGLARPVLVASPFALRQFALSHRMAMDGIQVIDPHSNLSMRQRFAQRWLARAGEKTPPDAVEKLSDPLMFAAAMVSAGEADVCIAGNLSSTANVLRAGLRVIGLQPGCKTLSSIFLMLPQYAGPALGFADCSVVPQPTAAQLADIAIASADTWRAITGEEPRVAMLSFSSNGSARHPNVANVQQATEFVRERAPQLLVDGELQFDAAFVPEVAAQKAPDSPLQGRANVMIFPSLEAGNIGYKIAQRLGGYRAVGPLIQGLAAPLHDLSRGCSVQEIIELALVAAVPRQADVSRERSLHTLVE

SEQ ID NO: 26362 - protein, 342 aa, Brassica napus
MASLALSFPPAAAKTPSYLSSSSSTFFSSSLSFTTSQSHSRNSVFASIKCDLGNGNPSIPIINERTLPKFLESARMEKSANRSNNNTRLKLFSGTANPALSQEIAWYMGLDLGKIKIKRFADGEIYVQLEESVRGCDVYLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSIAAEDLVVVSPDVGGVARARAFAKKLSDAPLAIVDKRRSGHNVAEVMNLIGDVKGKVAVMVDDMIDTAGTIVKGAALLHQEGAREVYACCTHAVFSPP

SEQ ID NO: 26363 - protein, 774 aa, Physcomitrella patens subsp. patens
MLSLLLNVEPRPELEDANSNFDLVLTDVVMPCLSGVGLLSKMMKREACKRVPIVSELSYMLDAVMSSYDSLDIVFRCISKGACDYLVKPVRKNELRNLWQHVWRKCRSSSGSRSGSGSQTGEVARPQSRGVEADDNPSGSNDGNGSSDGNDNGSSRLNAQGGSDNGSGNQACMQPVQVPRNNAAPAAADGDEEGQATSQGMGANLDEEMGHDLEMATRRSTCDTAKLDQQPDVGRQQDEDDACVMQDAGPSPGEDNGESPSTSGNDGTAEESSPKAVDLSHRRRVQSKLKGVRTMTENWISGGGAVRKTTPGQTPLVKCDIELGRWYGSGGTIIQQCHQPGSSLPVGGYPMSGGYGVYGMSGGTSGGSLRLGMGMERCGSSKGSAEGTTPPPLHPQSAEAAGGQDGGGADGYGSARQSAEEAMIAPGMPIAIPIPPPGMLAYDGMGGAYGPAMHPMYYAHAGAWMAASARHMGERVDVYSQTPAFQEQNPCSGHHSQAGPSHQHTHHHQGNQHHHHHHHHHHHGDGGQPSGTAGVQDEQQQSVITPMSGAPRCGSTGVDGQSGSRNGYGSTGNGNGSMNGSASGSNTGVNNGQNGLGVTPMANANSGNNGVGGTDPAMDGVSGGNGLCTEQIRFARREAALNKFRQKRKERCFEKKVQASCIWAAVASDGHHGASVCGEKRGCVVRYQSRKKLAEQRPRVGAKCCIAALRMWRERSKGGVEPAQTDRLPSGRNRRSVASEIIWHGDVKRAEVLDTLRDLEFSHRVFNQEGKKSS

SEQ ID NO: 26364 - protein, 537 aa, Bordetella pertussis Tohama I
MPMPIIESRIDTRSQDYADNARAMQAQLDDLNQKLARTAQGGSETARAKHVGRGKLLPRERVEQLVDPGSPFLELSPMAAHGMYGDEAPGAGMITGVGRIAGTECVIVCNDATVKGGTYYPMTVKKHLRAQEIAAQNRLPCVYLVDSGGANLPRQDEVFPDRDHFGRIFYNQAVMSSQGIAQIAVVMGSCTAGGAYVPAMCDESIIVRDQGTIFLGGPPLVKAATGEEVSAEDLGGGDVHTRLSGVADHLAANDMHALQLARNAVARLNRAKPAALALAPVREPRYDASELNGIIPADTRKPYDVREVIARIVDGSEFDEFKARYGTTLVTGFAHIHGMPVGIVANNGILFSESAQKGAHFIELCAQRKIPLVFLQNITGFMVGRKYENEGIARHGAKMVTAVATAAVPKFTILIGGSFGAGNYGMCGRAYSPRMLFMWPNARISVMGGEQAASVLATVKRDGIEARGAQWSGAEEDAFKQPIREQYEREGHPYYATARLWDDGIIAPADTRRVLGLALSAALNAPIEDTRFGVFRM

SEQ ID NO: 26365 - protein, 338 aa, Vibrio campbellii AND4
MKVLVTGGMGYIGSHTCIQMIEAGMTPVILDNLYNSKPTVLERIEKVSGVKPAFIEADIRDKAALVDAMHAHNIEAVIHFAGLKAVGESVEKPLEYYDNNVNGTLVLVDAMREAGVKSIVFSSSATVYGDPASVPIMENFPTSATNPYGRSKLMVEECLTDFQKANPDWSITLLRYFNPVGSHPTGELGEDPQGIPNNLMPFVSQVAVGRREFLSVFGSDYSTKDGTGVRDYIHVMDLSDGHVAALDKVGNKAGLHIYNLGTGNGYSVLEMVKAFEAACGREVPFKLVDRRPGDIAECWADPSKAANELGWKAERTLEEMTSDTWRWQSNNPQGYPDA

SEQ ID NO: 26366 - protein, 204 aa, Debaryomyces hansenii CBS767
MSAKFVSIPEAIEAFKNGEYLIVMDDESRENEGDLIMSAELMTQEKMAFLVRYSSGYVCVPLSTERADALNLHPMLANETDRHGTAYTVTCDYADGTTTGISAHDRALTSTKLADPNSKPVDFIRPGHILPLRAVPGLLKKRRGHTEAGVQLCELAGLQPAAVICEMVRDEDGLMMRLDDCTKFSKTHNIKMITIEQLVEHISQ

SEQ ID NO: 26367 - protein, 539 aa, Arabidopsis thaliana
MAYASRIINHSKKLKDVSTLLRRENAATIRYYSNTNRAPLNREDTFNSRLGYPPLERISICSTSTLPVSIIFSTTRSNLSSAMGRPIFGKEFSCLMQSARGFSSGSDLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDIEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKESSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 26368 - protein, 270 aa, Saccharophagus degradans 2-40
MTDTTAPLSENYLYRFGGIARLYGRDGLEALHRAHFVVVGLGGVGTWVAEALARTGVGELTLIELDEICVTNTNRQIHALASNVGRSKNTALAERLLDINPELKIHSVHDFLTQKNLPDLIGKQHHVVIDAVDSSSVKAALVAYCSRNKIRLIMSGSSGGKRDPLKITISDLGQTICDPMLAKVRNILYRHYKFTKSSNRQFRVDAVYSTEQMVYPKPDGSVCQEKKGLQDGVKLDCAGGFGSATMLTGSFGFAAANKAIERYLASALTK

SEQ ID NO: 26369 - protein, 219 aa, Streptomyces avermitilis MA-4680
MRRPGAVVRRAGGYVTNLMPTAAGDPIGGGLGDQVYNRLLGERIIFLGQAVDDDIANKITAQLLLLASDPDKDIYLYINSPGGSITAGMAIYDTMQYIKNDVVTIAMGMAASMGQFLLSAGTPGKRFALPNAEILIHQPSAGLAGSASDIKIHAERLLHTKKRMAELTAFHTGQTVEQVTRDSDRDRWFDPVEAKEYGLIDDIMPTAAGMPGGGGTGAA

SEQ ID NO: 26370 - protein, 226 aa, Streptomyces avermitilis MA-4680
MNDYPGSGLHARTQAEYTGARAESRYVIPRFVERTSQGVREYDPYAKLFEERVIFLGVQIDDASANDVMAQLLCLESMDPDRDISVYINSPGGSFTALTAIYDTMQFVKPDIQTVCMGQAASAAAILLAAGTPGKRMALPNARVLIHQPYSETGRGQVSDLEIAANEILRMRSQLEDMLAKHSTTPIEKIREDIERDKILTAEDALAYGLIDQIISTRKMNNSAVA

SEQ ID NO: 26371 - protein, 759 aa, Salmonella enterica subsp. enterica serovar Typhi str. CT18
MDEQLKQSALDFHEFPVPGKIQVSPTKPLATQRDLALAYSPGVAAPCLEIEKDPLAAYKYTARGNLVAVISNGTAVLGLGNIGALAGKPVMEGKGVLFKKFAGIDVFDIEVDELDPDKFINVVAALEPTFGGINLEDIKAPECFYIEQKLRERMNIPVFHDDQHGTAIISTAAILNGLRVVEKNISDVRMVVSGAGAAAIACMNLLVALGMQKHNIVVCDSKGVIYKGREPNMAETKAAYAVDDSGKRTLDEVIDGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMDSGVATRPIADFDAYIDKLTEFVYKTNLFMKPIFSQARKDPKRVVLPEGEEARVLHATQELITLGLAKPILIGRPSVIEMRIQKLGLQIKAGVDFEIVNNESDPRFKEYWSEYYQIMKRRGVTQEQAQRAMIGNHTAIGAIMVQRGEADAMICGTIGDYHEHFSVVKAVFGYRDGVHTAGAMNALLLPSGNTFIADTYVNEDPTPEQLAEIAVMAAETVRRFGIEPKVALLSHSNFGSSNSLSASKMRETLERVRERAPDLMIDGEMHGDAALVESIRNDRMPDSPLKGAANILVMPNMEAARISYNLLRVSSSEGVTVGPVLMGVSKPVHVLTPIASVRRIVNMVALAVVEAQTTPL

SEQ ID NO: 26372 - protein, 489 aa, Vibrio sp. Ex25
MSIWQRVSFTHRFSQLPSAFYTLVEPQPLDNTRWVAWNGEFAQQFGLPAEQSDELLAVFSGQSEFEPFRPLAMKYAGHQFGVYNPDLGDGRGLLLAEIEHQDGTWFDIHLKGAGLTPYSRMGDGRAVLRSTIREYLCSEAMVGLGIPTTRALGMMVSDTPVYREKTEFGAMLIRMAETHVRFGHFEHFFYTNQLAEQKLLADKVIEWHFADCASAEKPYAAMFGEIVQKTADMIAYWQAYGFAHGVMNTDNMSILGQTFDYGPFGFLDDYEPGYICNHSDYQGRYAFDQQPRIALWNLSALAHALSPLVEREDLEASLSQFEVRLSQQFSRLMREKLGLKTKIAEDGRLFEAMFELLHQNNTDYTRFFRTLSNLDTDSSQAVIDLFLDREAARAWLDLYLARCELEVDELGELISAEQRCEQMRQANPKYILRNYLAQLAIDKAEEGDFSELHRLAELLKRPFDEQPEFDDYAKLPPEWGKKMEISCSS

SEQ ID NO: 26373 - protein, 137 aa, Streptomyces avermitilis MA-4680
MSQRTLVLLKPDAVRRGLTGEIISRIERKAGWAITALELRTLDQDTLEQHYGEHKGKPFYEPLVEFMASGPVVALVVEGERVIEGVRALAGPTDPIAAAPGSIRGDYGVIVRENLIHASDSEESAERELKIFFPGRV

SEQ ID NO: 26374 - protein, 169 aa, Zea mays
MEGGSRADGRNPNQLRPFTCTGNPLHRAHGSARWAQGDTVVLAAVYGPKSGTRKGENPEKASIEVVWKPKTGQIGTLLFPSSSLRPTAARVTGSLKWRVVFAGRQEREYEMTLKRTLQSICLLTVHPNTTTSVVLQDDYFNCIERGVMASSRISDFMRKTLQKEASRDA

SEQ ID NO: 26375 - protein, 433 aa, Bacteroides fragilis NCTC 9343
MKYYSTNKQAPLASLEEAVVKGLASDKGLFMPMTIKPLPQEFYDEIENLSFREIAYRVADAFFGEDVPAETLKEIVYDTLNFDVPLVPVKENIYSLELFHGPTLAFKDVGGRFMARLLGYFIRKEGRKQVNVLVATSGDTGSAVANGFLGVEGIHVYVLYPKGKVSEIQEKQFTTLGRNITALEVDGTFDDCQALVKAAFMDQELNEQLLLTSANSINVARFLPQAFYYFYAYAQLKKAGRAENVVICVPSGNFGNITAGLFGKKMGLPVRRFIAANNKNDIFYQYLQTGQYNPRPSVATIANAMDVGDPSNFARVLDLYGGSHAAIAAEISGTTYTDEQIRESVKACWQQTGYLLDPHGACGYRALEEGLQPGETGVFLETAHPAKFLQTVESIIGTEVEIPAKLRAFMKGEKKSLPMTKEFADFKSYLLGK

SEQ ID NO: 26376 - protein, 471 aa, Mycobacterium smegmatis str. MC2 155
MSTDTQDSADARAKTPGQLTGAVVIVALVSAVSGMLYGYDTGIISGALLQITKDFSIAEAWKQVIAASILLGAVIGALVCSHLSQKRGRKGTLLMLAVVFVIGSLWCAISPNPVLLSVGRLVLGFAVGGATQTAPMYVAELSPPKYRGRLVLCFQIAIGVGIVIATIVGASEHIPWRWSIGAAAVPAAIMLVLLLRLPESPRWLIKDGDPDKAREVLERVRPDGYDIDGELDEMTTLVRKEQTAKTRGWPGLRAAWVRPALILGCGIAIFTQLSGIEMIIYYSPTILTDNGFSESVALQVSVALGVSYLVAQLVGLSIIDKVGRRRLTLIMIPGAAVSLFVLGTLFATGHSGRDSVPFIVACLVVFMLFNAGGLQLMGWLTGSETYPLAVRPAGTAAQSAALWGTNLLITLTLLTLISGIGVGPAMWLYGLFNVAAWLFVYFRMPDLTGRSLEEIEGKLRDGKFRPADFAR

SEQ ID NO: 26377 - protein, 286 aa, Pediococcus pentosaceus ATCC 25745
MEYVKLNDGNQMPQLGFGVFQVSDLSQAEQAVSDALDTGYRLIDTAAAYDNEEAVGAAIKKSGINRSEIFVTSKLWVDHFTYEKAQQGIEDSLNKLGLDYIDLYLLHQPYGDTAGAWRALIEAQKAGKIKSIGVSNFAPDQLMNLELMSDVKPALNQIEVSPWYQEGEAVGFAQSQDVQVEAWAPFAEGKHNIFSNETIAEIGQKYGKANGQVILRWLLQRGIVVIPKSVHKTRMAENLDVFDFELSDDDMQKMSSLDKNESQFFDHRDPEAIVSIFGESLKALRK

SEQ ID NO: 26378 - protein, 347 aa, Pediococcus pentosaceus ATCC 25745
MKAAVFIEPGKVEVKEVPKPQIDGDNQAIIRIVRASVCGSDLWWYRGISERQTDTFIGHEAIGVVEETSADVDNIQVGDFVVVPFTHGCGHCVACLNGFEGDCLNRKSGDNGGYQAEYMKYEPANSGLVKIPGKPEDYTDAQLASFQTLSDVMATGYHAAQNAEVKPGSTVAVIGDGAVGLCGVIGAKLLGASKIILLSHHEDRAELGKAFGATDIVDTRGDEAIQDVLKLTKENAGADAILECVGATSAIEQAGQIARPGAVIGRVGVPQSEPKSNQLFWKNVGLRGGIASVTKPDKEVLLQAVLDGEINPGQVFTKSFDLDHIEDAYEAMSNRQAIKALLVISDK

SEQ ID NO: 26379 - protein, 122 aa, Brassica napus
MVGSGGDRSKDAVGMMALHEALRSVCLNSDWIYSVFWTIRPRPRVRGGNGCKIGDESGSLMLMWEDGFCGGGRSEDLCLEPDIESEDLVRKAFSKMSIQLYNYGEGLMGKVASDKCHKWVFK

SEQ ID NO: 26380 - protein, 491 aa, Pseudomonas syringae pv. tomato str. DC3000
MTTQPLNSHRVDPHTAQKFYIDGHWSAPLSPVSIAVVNPATEEVVAHVASGSAADVDRAVAAARAAFAGWSGTSPEVRAQVIGRIHELIIERKEELAQAISLEMGAAISSARAMQVPLAAEHVRVARDLLATYRFQTVEGGTAIEREPIGVCALITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFANAVPPGVMAAFRNVGQSCSAPTRMIVPRNRLAEVEALAAQTAGTIVVGDPQLEHTVLGPIANEAQFHRVQAMINAGICEGAKLVCGGPGRVQGHEQGFYTRPTVFSEVDSSMRIAREEIFGPVLCLIAYDTIDEAVAIANDTVYGLGAHVQGQDLELARSVASRIRAGQVHLNYPSWNPMAPFGGYKRSGNGREYGVHGFEEYLETKAIVGFAPADLM

SEQ ID NO: 26381 - protein, 327 aa, Zea mays
MLGTMHSEVNRDSGSLHNEVVAPFVKPISCEAAVGISDDVAGGSSVLESSEPCLQNSLVAWNPELAHCNQKTTHDTTDISKGEERVRIPVVNEFGSETCPPSFYYIPRNLVFQNAYVNISIARIGDEDCCADCSGNCLSSLVPCGCARVTGGEFPYTPEGLLKTEFLDECTSVNHFPQEHHRFYCTVCPLERSKNKASPGPCKGHLMRKFIKECWSKCGCGMQCGNRVIQRGITCKLQVFFTREGKGWGVRTVEDLPKGSFVCEYVGELAFFTNKKVEAFEELTWDYGIGFDDTEGPSKPFRCMCGSRYCRDPNNLRRMARAAAKRK

SEQ ID NO: 26382 - protein, 428 aa, Oryza sativa Indica Group
MTRPLMTSSDQFSASSVNKTELPNRLRLSFANFTHHPCEGFSVAPPLVDPKRTGPRPCDVCYVPVDQAFALMPLQPSPSPVLKNLSYVFEDNITANFSNQGSVFGGHPSLEQRNKSFDIRESMTVHCGFVRGKKPGQGSGFDINDDDLLEMEKCHEETEAYVKNSSSLYRNNKVGLWRLVVVRNLPYEDPRRTGKIPKLLLHRLFPNVRFSVWIDAKLKLVVDPYLLLERFLWRKNATFAISRHYKRFDVFEEAEANKAAGKYDNASIDYQIEFYRNEGLTYYAPAKLPITSDVPEGCVIIREHIPITNLFTCLWFNEVDRFTSRDQISFSTVRDKIRARVGWMPEMFLDCERRNFVIQGYHRELLEQMIASGWKPPPMASEPSRKLRLGSRKAPPSKKSSMKRKRVKKSSSRRRLPKPITGMTDSTT

SEQ ID NO: 26383 - protein, 153 aa, Streptococcus pseudopneumoniae
EHFIRGQYRSGKIDGMKYISYRSEPNVNPESTTETFTSGAFFVNSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 26384 - protein, 336 aa, Thermotoga maritima MSB8
MMKALILAGGSGERFWPLSTPETPKQFLKLFGNKSLMRWTFERVLEEMDPKDVIVVTHKDYVERTKKELPELPDENIIAEPMKKNTAPACFIGTKLADDDEPVLVLPADHRIPDTKKFWKTVKKALDALEKYDGLFTFGIVPTRPETGYGYIEIGEELEEGVHKVAQFREKPDLETAKKFVESGRFLWNSGMFLWKAREFIEEVKVCEPSIYENLKDVDPRNFEELKKAYEKVPSISVDYAVMEKSKKVRVVKADFEWSDVGNWSSVREIEGYTEESDEVILVDSDRVFVKTHNKPIAVVGLSDVIVIDTPNGILICKEEYAQKVREVVKKLFRTS

SEQ ID NO: 26385 - protein, 420 aa, Cryptococcus neoformans var. neoformans JEC21
MTENKPSKSPVSKTRLSSCSRSRNGPETPDPLIQRKAALVVVFALSIWSFYVIVGRMCTPMIRNRSDSGLGRSVGAGALVGFVILWLLFLWSYIKMIATPPGYARDKVSKSSPPDPANYPQPYPINPNAIHPHPDQDQGPDPSTWAPTMNLATQTVGDWQPNASPAPFMGQAPPPEVKDKPKKGVKDWREVQRPVPHVEYVPRWCRFCEIVKPDRTHHCRHCGTCVMQFDHHCLWIGQCVGWANHKFFIIFNLWTALYCFYIMILLIIAEARSNSMDGQMIALIIVAAIFGLFAVTMLFTHIQLILSGRTTVESFAARDQRERENAILQTEYGYFWHNLEKRKVRKKWKEEWGGSPVDGRWRYGTRMDRWKQEMGIAPLGWILPIGSPQGNGLYFKSNPKFGPYGEWLKKEDWPAELLSV

SEQ ID NO: 26386 - protein, 487 aa, Agrobacterium tumefaciens str. C58
MMKFDNSYAHLPERFSAAVLPTPVKAPRLIAFNRTLAEELLLDVADLDDDRLAAIFSGNVVPQGAEPLAMAYAGHQFGGFVPQLGDGRAILLGEVIDVNGRRRDIQLKGSGPTPFSRRGDGRAALGPVLREYIVSEAMFALGIPATRALAAVLSGDRVQREVGLPGGVFTRVAASHIRVGTFQFFAAREDDEAIRSLADYVIDRHYPDAKNTENPYLALLRGIAERQCALIARWMMVGFIHGVMNTDNMAVSGETIDFGPCAFLDEYHPNKVFSSIDAQGRYAYNNQPGIAQWNIARLAECLLPLLDPEVEKAAELANAVLADFAAAFPQRWLTGMREKLGLTTEEEGDMDLIQSLLSLMQASEADFTLTFRRLSHAANGDAEPFRGMFIDIAGADAFLTRWRERAGREGISDSERSAAMLSINPAIIPRNHRIEELIEAAVEDGDFEPFHAMLTAIATPFEERPDNFVYMQPPMSHERVFRTFCGT

SEQ ID NO: 26387 - protein, 810 aa, Cryptococcus neoformans var. neoformans JEC21
MADDPSRAVQDDSTATAILRQKRSPNRLVVDESPSDDNSVAILHPNTMEALGLFRGDTIIVRGKRRRDTVLICLSQDDIEEGKVAMNKVARGNCAIKLGDLVHVSAANDIKYGKRIHVLPFADSIEGLSGNLFDVYLRPYFLEAYRPVRKGDVFQVRGGMRTVDFKVVEVDPSPYCIVASETVIHTEGDPLDREAEEATLNDVGYDDLGGCRKQLAQIRELVELPLRHPQLFKAIGIKPPRGILMYGPPGTGKTLMARAVANETGAFFFLINGPEIMSKMAGESESNLRKAFEEAEKNSPSIIFIDELDSIAPKREKANGEVERRVVSQLLTLMDGLKARSNVVVMAATNRPNSIDPALRRFGRFDREVDIGIPDPTGRLEILRIHTKNMKLSDDVDLEQIAADTHGYVGADMASLCSEAAMQQIREKMDLIDLDEDTIDAEVLDSLGVTMENFRFALGVNNPSALRETVVEIPTTTWNDIGGLDKVKRELQETVQFPVEHPEKFLKYGMSPSKGVLFYGPPGTGKTLLAKAIANECQANFISIKGPELLTMWFGESEANVRDVFDKARAAAPCVMFFDELDSIAKSRGNSAGDGGGSSDRVLNQILTEMDGMNAKKNVFIIGATNRPDQIDSALLRPGRLDQLIYIPLPDEESRLSILKATLRKSPIDPRVDLDFLAKNTAGFSGADLTEICQRAAKLAIRASIDADIRKERERNEKAEAAGQDVELIDEENEEDEVPAITVEHFEEAMRYARRSVSDADIRRYEMFSTTLQQSRSFGSNFKFPESGQTDNAAAGATFQNEADDDDLYA

SEQ ID NO: 26388 - protein, 503 aa, Ustilago maydis 521
MQALRALQRSGLQKAVAAASSSSSTLSHRSFHSSRRALEFSKFNMPAMSPTMTEGGIAAWKKQPGEAFSAGDVLLEIETDKATMDVEAQDDGVLAKILVGDGAKAVQVNSLIAIMAEEGDDLSGADAFAAKASSEGGEAKPAAKEEPKEEPKEEPKEESKPKDEPKQQESTPSSSSSSSSSSSFGSQSSGDRIFATPVARRLAQDKGIALNKIKGTGPEGRIIKADVENYKPEAAVAAPAASSAAPAKSAGAPAPAPAASEGGDYTDIPVSNMRRTIAARLTESKSSIPHYYVSIDVEMDKVLKLREVFNKAAAEKAGKDVEKAKAAKLSVGDFITKAAGVALKEVPEVNSAWYGDFIRQHNKADISIAVSTPTGLITPIVKDVGGSGLATISAATKSLAAKARAGKLAPQEYQGGSFTISNMGMFGITHFTAIINPPQSCILAIGGTEARLVPDAESEQGFRKAMIMQATISADHRTVDGATAAKWMKAFKDALENPLSFML

SEQ ID NO: 26389 - protein, 210 aa, Clostridium difficile 630
MKVFDLTHVTHNDMPVYAEPNRPDIKKVAIIEENGYQETLISVFSHNGTHMDSPRHMYTKGETLDKLDIENFVGKAYVLELEKGNENIELEYLKKYEDEIKNSDFIIFKSGWSKFWDKKQYYVGYPTLTKEAANYIANTNIKGIGIDMLSVDRYDTSVFEVHHILFEKGKIIIENLTNLENVPEKFLFIAAPFKYNDADGAPVRAIAIVE

SEQ ID NO: 26390 - protein, 318 aa, Burkholderia pseudomallei K96243
MSSHDGLMVFTGNANPALAQEVVKILGIPLGKAMVSRFSDGEIQVEIQENVRGKDVFVLQSTCAPTNDNLMELMIMVDALKRASAGRITAAIPYFGYARQDRRPRSARVAISAKVVANMLEIAGVERIITMDLHADQIQGFFDIPVDNIYATPILLGDLRKQNYPDLLVVSPDVGGVVRARALAKQLNCDLAIIDKRRPKANVAEVMNIIGEVEGRTCVIMDDMVDTAGTLCKAAQVLKERGAKQVFAYATHPVLSGGAADRIAASALDELVVTDTIPLSAESLACPKIRALSSAGLLAETFSRIRRGDSVMSLFAES

SEQ ID NO: 26391 - protein, 433 aa, Ustilago maydis 521
MMLTAATIRTAVRASQAPLLGAMSLPAVRQFKSTWAHVKAGPPDPILGVTEAFKRDQDPRKINLGVGAYRDENGKPYVLPSVRQAEELVITAKGDKEYLPITGLADFTKNAAVLAYGKDSAPIKENRIAITQSISGTGALRIGGAFLQRHYPEAKTIYLPTPSWGNHTPIFRDSGLEVKQYRYYDKKTVGLDFKGMIEDIKAAPAGSIVLLHACAHNPTGVDPTVEQWKEISNVVKEKGHFPFFDMAYQGFASGDTDKDAFAVRHFVAEGHQICLSQSFAKNMGLYGERVGAFSIVCADPDERARVDSQIKIIVRPMYSNPPMHGAKIAGTILADQQLYQQWLGEVKGMADRINGMRSTLKDLLVQDFNSKLNWDHITNQIGMFAFLGISPEQVAKLVNEHHVYLTGDGRISVAGITDHNVKHLAESLHKVTS

SEQ ID NO: 26392 - protein, 619 aa, Salmonella enterica subsp. enterica serovar Typhi str. CT18
MNRFIMANSQQCLGCHACEVACVMAHNDERHVLTPQRYQPRITVIKHQRQRSAVTCHHCEDAPCARSCPNGAIAHINDSVQVNAQKCIGCKSCVVACPFGTMQMVLTPVAPNQFKASAHKCDLCQGREQGPACVENCPADALQLVTEDSLTRLAKTRRLRTARQEIRPWHTVDTQHSGTACSKVERMQATPPRGEPDKLAIEARKTTFEEIYLPFRAAQAEREAARCLTCGEHSICEWTCPLHNHIPQWIELVKAGDIDAAVELSHQTNCLPEITGRVCPQDRLCEGACTLRDEYGAVTIGNIERYISDRALSKGWRPDLSDVQKSDKRVAIIGAGPAGLACADVLARRREIFSAMGIRFELNCEVGKDISLETLLESYDAVFVGVGTYRSMKADLPNEDAPGVYDALPFLIANTKQVMGLPALPDEPFIDTAGLNVVVLGGGDTAMDCVRTALRHGAANVTCAYRRDEANMPGSKKEVKNAREEGANFEFNVQPVELVLDTHGRASGIRFLRTRLGEPDGQGRRRPVPVPDSEFVMPADAVIMAFGFHPHGMSWLESHGVKVDNWGRIAASVESEFRYQTSNPKIFAGGDAVRGADLVVTAMAEGRHAAQGILDWLAK

SEQ ID NO: 26393 - protein, 446 aa, Physcomitrella patens subsp. patens
MDNPKWPYFDPDYETTCSSFNSPRVTVETEASENATIVKVNSANRHGILLNVVQVLTDLDLTITKSDIFHDLGWFMDVFHVVDSNGNKALDKQTCDHIMNSLGYRTRREQFSADSLRRSTGLTVADHTVIELTGPDRPGLLSELSAVLTRLECNVNAAEVWTHNLRAASIVYFTDSSTGRPITNQSKLDYIKEQLSRVMKGDHDEEVARCKIEYATEITHVERRLHQLMYDDRANEVPDRSGNMQGRPAIHIKRNERGYSVVSIHCKDRPKLLFDIVCTLTDMQYVIYHALINFPGSETSQEFFIRHVNGCTLDTAAEQHLKACLEAAISRRTSEGLRLELCMNDRVGLLSDVTRIFRENGLSVARADITTRHDKAINVFYVVDASGRPVNMKVVEAMRETIGSSLEVKGLPRSEPELPSTKLSLGGLFRNIYGLTNITWRSTATA

SEQ ID NO: 26394 - protein, 605 aa, Aspergillus terreus
MPSLKDWVAAGLVPMTIASSTGRLPSNCTNGPSSRRCWQDGFDIWSDYTDPKVAPPGKLVEYDLTVTQVTISPDGYERLGTVFNGQYPGPLIEADWGDTLRITVHNNLTNGNGTAVHWHGIRLFETNWIDGVPGVTQCPIPPGESQVYEFRATQYGTSWYHSHFSLQYSNGLYGPLVIHGPSSSDWDVDLGPWTLTDWYHEDAFTLNWISLAGQLAPIPVSTLLNGKGTYDCDPGLDPACTGKQEYFETTFQQGTKYKMAIVNTATLLTYTFWIDGHNFTVIEVDFVPVEPYSTNVLNVGMGQRYEIVVEANADRTQGSSFWIHAHYCDIPDVIPNNKVGIIRYDESDTSEPATPPLSEQHRDFGCSDPSLGDLVPVVKKTVGPRVNQIGPHDYLTIGEQGKIPTPWEKDPRVHLWTIKNTAMYVDWQTPSLGKLTADHDEEFPPETVPVTLDFDTGEWVYFLLTSNYSLEDVVTPRNLTPSVHPIHLHGHDFAILAQGKGPFTPDIAPQLDNPPRRDVVDVDIGGYAWIAFEVDNPGAWLLHCHLQYHASEGMALQYIEQPSKIKPLIENAGVLNDFENRCASWKRYYNAVDIPNDRPQDDSGI

SEQ ID NO: 26395 - protein, 259 aa, Bordetella pertussis Tohama I
MISLPYLQRFALSGQVALVTGSARGLGLRIAQALAGSGAHVLINGRDAHAVEAAVSDLRQQGLRASAQPFDVSDEQAMEQAFARIDAEHGRLDILVNNVGARNRKPLAETSPAEIRAMMDTNLIAGILLARLAAQRMMRQRYGRLIAITSVAGELARANDAVYPAAKQGLTGMMRALAVEFGGHGITSNAIAPGAFATETNAAIANDPQAGAAMAARNPTGRWGDPEEIAGAAVFLASPAASYVNGHVLVVDGGLSVQF

SEQ ID NO: 26396 - protein, 484 aa, Oryza sativa Japonica Group
MASLADSFLADLDELSDNEAYPEEENAEAVGMDEDGGEDMLDLESLNYDDLDSVSKLQKTQCYNDIMQKVEDALQKGTDFSNQGSILEEDPEYQLIVDFNALSVDIENEIIIIHNFIRDKYRLKFPELESLVHHPIDYARVVQKIGNEIDLTLVDLEGLLPSAIIMVVSVTASTTNGKPLSEENLAKTIEACERALTLDAAKKKVLDFVESRMGRIAPNLSAIVGSAVASKLMGTAGGLGALAKMPACNVQLLGAKKKNLAGFSSATSQFRVGYLEQTEVFQSTPPALRTSACRLIAAKSTLAARINSIRGDPTGKAGRNLLEEIRKKIEKWQEPPPAKLPKPLPVPDSEPKKKRGGRRLRKMKERYAQTDMMKLANRMQFGVPEESSLGDGLGEGYGMLGQAGSGKLRVSAAQSKLAAKVAKKFKEKSYGSSGATSGLTSSLAFTPVQGIELSNPQSHGNLLGSGTQSTYFSETGTFSKIKRN

SEQ ID NO: 26397 - protein, 477 aa, Bordetella pertussis Tohama I
MKQHFIDNASVPGSSGERIPVIDPSTGQEFDSIARGNAADIDLAVQAARRAYEGAWGRLSAAERGRLMLALSLKVLEHRDELTALESRDCGKPLKQARADVIAIARYFEYYGGAADKLHGETIPYQQGYTVLTLREPHGVTGHVVPWNYPLQIFGRSVGAALAAGNACVVKPAEDACLSLLRVAELAAETGFPAGALNIVTGYGHEAGDALTRHPGIDHISFTGSPRVGVLVTQTAAERHVPVTLELGGKSPQIVFADADLDALVPVAVNAIVQNAGQTCSAGSRLLVERGAYERVLERLGAAFAALRAGPAQSDLDCGPLIRKTQQERVRGFLDLARGDGIATVAQGRIVPEAPAEGYYQAPTLLRDVPVDHPLAQEEVFGPVLAAIPFDDEADAVRIANATEYGLAASVWTRDGGRQLRIARKVRSGQVFINNYGAGGGIELPFGGVKASGHGREKGFEALYGFTVLKTISIKHD

SEQ ID NO: 26398 - protein, 252 aa, Bordetella pertussis Tohama I
MRLNGKTAIVTGAGSGFGEGIAAAFAREGAKVAVADINEAGGQRVAAAINAAGGQAVFVRADVSDNAAVANLLAATLKAFDGLDIVVNNAGTTHRNRPMLEVEEDEFDRIYAINVKSIYLTAKHMVPYFRAHGGGSFINIASTAAIRPRPGLTWYNGSKGAVVTTSKSMAAELGPDNIRVNCVNPVIGATGLLADFMGVPDTPENRKRFLATIPLGRFSTPQDIANACLYLASDETAFITGACLEVDGGRCV

SEQ ID NO: 26399 - protein, 193 aa, Oryza sativa Japonica Group
MSHQPDWSACLLIGKGCNEIWVYFSEAPIEVVKEQDKDLSKLGADAIIPAMPGHVMQAFTLLKSSPEAQGVVASLASDKNVWDAVLKNEKVMEFYKTHQQSLVYTFPEGTASVVSPEKLADASSENSSSGEKPESSPFADFMDNARKTVIDIVNNITNFFQDMFRKPNEAEILGGSFMALAIAVILLIMFKKA

SEQ ID NO: 26400 - protein, 189 aa, Physcomitrella patens subsp. patens
MDVWLASYQGASEHGGFLHTRRVSQRLQVSAAVKEVTGSLVKGAGLRFGVVVGRFNEIITKPLLAGALDAFYKHQVREEDIDVTWVPGSFEIPVVAQQLAMSKKYHAILCIGAVVRGATTHYDAVANSAASGIMSASLKSNVPCIFGVLTTENMEQAIDRAGGKAGNKGAEAAITALEMASLIQHHLVD

SEQ ID NO: 26401 - protein, 504 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSQPLAARNPEAQRAVQKKNLVVKQQTKPVEVIETKRNAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLSFSSHKSIVKSDQFCKKFNLCQEVTAPASEFHLGNCEAWRETVTKLKDPETKGSLVSRDFSSCKELLIKGFKMKECLAAKKI

SEQ ID NO: 26402 - protein, 361 aa, Glycine max
MELDLTPKTAEVLFEGDGGGYYTWWSSKVPLLAKTNVGAGRLVLQPQGFAIPHYSDISKVGYVLQGNDGVAGMALRNSTTREEVVVKLKKGDVIPVPIGSVSWWFNDGDSDLVIVFLGETSKALIPGEISYFFLTGLQGVIGGFSNELTSKIYGLDKDGVEKLTKSQSGVVIIKLDKSQSLPKPQMEITKKLVYNIDVAHPENVVENAGIVKTLTEQDFPFIGDVGLSVIRVKLEPGAIKAPSYPINPTVQLIYIARGSGKIEIVDFSGKCALETQVEAGHLLVVPQFFVVAQIAGEEGIESYSIVTTTKPLFEELGGRASIWSALSPSVQQASLHVDSEFQSLFISKIKETTNLIPPTTN

SEQ ID NO: 26403 - protein, 261 aa, Nocardioides sp. JS614
MNAARPNRRVRLLVVLCVALAAGSCSGDGDGTRTEPGDHGSEAGRAEHWSYDDVEAWEEACATGREQSPVDLAGATSRDLPDLGFAYRPAPATVVDNGHTVQASVEGAGSLELDCETFELRQLHFHSPSEHLVAGASYAAEVHLVHEGTDGRLAVVAVLVQEGSANPVVAALLDQVPAAGAEPVAADAPVDPVRVLPADRRAFRYDGSLTTPPCTEGVAWSVLAEPITWSAGQLAEFAERHPDSHRPPQPRDGRVLLHDER

SEQ ID NO: 26404 - protein, 386 aa, Sulfitobacter sp. EE-36
MTATTSPRPTACLALADGSIFYGMGFGATGETVAELCFNTAMTGYQEIMTDPSYAGQIVTFTFPHIGNTGTNPEDDETGDPVAAGMVVKWMPTDPSNWRSVQPLSEWLASRGRIAIGGIDTRRLTRAIRQQGAPHAALAHNPDGVFDVEALVAAARGFAGLEGMDLAKDVSCKQSYRWNEMRWAWPDGYTAQENAPHKVVAIDYGAKRNILRCLASAGCDVTVLPASATYEDVMAHNPDGVFLSNGPGDPAATGVYAVPMIKDVIEKTELPVFGICLGHQMLALALGGQTVKMGHGHHGANHPVKDIDTGKVEITSMNHGFAVDAQSLPSGVVETHQSLFDGSNCGIRMEGRPVWSVQHHPEASPGPQDSFYLFERFAAAMAERAS

SEQ ID NO: 26405 - protein, 385 aa, Sulfitobacter sp. EE-36
MFARNHQEDIMPALLNSVDPEGLEEFSVVFTDRSLNHMSAVFQEVMRDISALLKDVYKADAVAVVPGGGTYGMEAVARQFARGAEVLVVRNGWFSYRWSQIIESGDLTGNATVMKAQMQGNSTPAPFAPSPIDDVVKAIETHKPEVVFAPHVETSAGVILPDDYIKQMAEAAHAVGALVVLDCIASGCAWVDMKALGVDVLLSAPQKGWSASPSAGLVMMSDRAVARMGETTSDSFAIDLAKWHSIMKAYEDGGHAYHATMPTDALRQFRDTMLETKSYGFDRLKEAQWRLGDSVRKMLAERGVTSVAAEGFGAPGVVVSYTADPSVQNGKAFAAEGMQIAAGVPLMCDEPEDFQTFRLGLFGLDKLYDVDATLARLAAVVDKVL

SEQ ID NO: 26406 - protein, 245 aa, Spiroplasma citri
MRKPIIIGNWKMHKTINETIDFLKQVDHVCHDLKLDAGIAIPFVNLAVAKQHAHNLIIAAQNCHYEDFGAFTGEISVEMLENLKITHVIIGHSERREMFNETNETVNLKAKKILATGMVPIICCGETLQQYENNETQQIVETQIEKALQGIDFEDAKTIVIAYEPIWAIGTGKTATAEIAQNVCAIIRTKIASLYDEVVANVIRIQYGGSVKPENIQELLAQPDIDGALVGGASLEPKTFLGLVK

SEQ ID NO: 26407 - protein, 123 aa, Triticum aestivum
  misc_feature (69)..(69): Xaa can be any naturally occurring amino acid
  misc_feature (86)..(86): Xaa can be any naturally occurring amino acid
  misc_feature (108)..(108): Xaa can be any naturally occurring amino acid
LTSFGSRATKLSSTATKMSTVTGAHLDQRLAAAKRCSREAAMAGAKAAAVATVAAAVPTLASVRMLPWXAKAHLNPAGQALIISTXWAGMAYFIVADKTILSMARKHXSFEDAPDHLKNTSFH

SEQ ID NO: 26408 - protein, 585 aa, Emericella nidulans
MARSRQPTRFSSEAPSESSSSTSPERAADDDTDFFTLQANDSQSSIGAGNPRDSHIQNDPETVLPPIAYLPPEILISIFSKLSSPRDLLSCLLVCRIWALNCVGLLWHRPSCNNWDNLKKIAAAVGEEDSFFLYSSLIKRLNLSALTEDVSDGTVVPFSQCNRIERLTLTNCRKLTDIGVSDLVVGSRHLQALDVSELRSLTDHTLFKVAENCNRLQGLNITGCVKVTDDSLIAVSQNCRLLKRLKLNGVSQVTDKAILSFAQNCPSILEIDLQECKLVTNQSVTALMTTLQNLRELRLAHCTEIDDSAFLDLPRHIQMTSLRILDLTACENIRDEAVERIVSSAPRLRNLVLAKCKFITDRAVWAICKLGKNLHYVHLGHCSNINDSAVIQLVKSCNRIRYIDLACCSRLTDRSVQQLATLPKLRRIGLVKCQLITDASILALARPAQDHSVPCSSLERVHLSYCVNLTMVGIHALLNSCPRLTHLSLTGVAAFLREELTVFCREAPPEFTRQQREVFCVFSGEGVNRLRNHLNREAAPQRDANEATMYDDEEELDEDEGQVTGLMHAAAINDDDYINITPPHA

SEQ ID NO: 26409 - protein, 510 aa, Spiroplasma citri
MSLINIENLSHANGGKVLYKNSAIRINKGEHLALIGANGTGKTTLLSIIYGKLTPDEANIEVHPRVKIGYLDQHQELDGTLTVEQFLKLTYQHLFEIEKKIHAIYEKMSLNYDEDELVKSLKLQEHLDQNGFETIDKEIRSLVDGLGIDPEKLNVKLSELSGGQRGKVILAKLLLSENDFLLLDEPTNFLDLEQVEWLAKFLQNYEKAFLVVSHDIDFINKVAKIIYAIENLSINRYAGNYQQYLALSKLKNEQYDKVQKGQERLIKKLETYVAKNKARASTAKSAQSRQKQIDKIEVMDKRHELTKPKFIFKYKRPASTTIVSAEQLAIGYQFPLIKPLTFDIRDGEKCIVRGYNGIGKTTFLNTLAGNLPKLGGTLKIDNGVFIAYFHQIEQLMDITPIEYLKNLYPDLEEGRIRSILANFGVKSTLMQNQMTKLSGGEQTKVRLSALSLQPCSLLILDEPTNHIDVLAKEALLEAIQAFDGTVLITTHDINLNVNWADKVLDFETMV

SEQ ID NO: 26410 - protein, 171 aa, Populus trichocarpa
MVGRIPPPHLSPFVDNDAEGYIPDYAETIKRLQAAAKNEVLPMPRVGKEDLDDPQNLLVEGYISRAEANEAVKTKKKMATLEKQYHEELQRELQGAVMKKSKQGSEEDAKASEESVPDPKQIAEDIDTMSKLGMSRKKRGLLEAIEKRKERDTARISKLKERKKKLKSSEN

SEQ ID NO: 26411 - protein, 880 aa, Cochliobolus carbonum
MSAAIDNEDLEELSISMPSQRRGAAQTSTTKAQDPAPPPPTALGTAVHETKSKDTKASQRLGQYTIVRTLGEGSFGKVKLATHQVSGQKVALKIINRKRLVTRDMAGRIEREIQYLQLLRHPHIIKLYTVITTPTEIIMVLEYAGGELFDYIVNHGKLQEAQARKFFQQIVCAVEYCHRHKIVHRDLKPENLLLDHDSNVKIADFGLSNIMTDGNFLKTSCGSPNYAAPEVISGKLYAGPEVDVWSCGVILYVLLVGRLPFDDEYIPTLFKKIAAGQYSTPSYLSPGATSLIRKMLMVNPVHRITIPELRQDPWFTTDLPAYLEPPAQEFFDSGADPNKAIDPKALAPLADAPRVQALHENVVTKLGKTMGYAKHDVQDALARDEPSAIKDAYLIVRENEMMRENPLLTNQDGVPVWNHQSPPAHDSYMEKFRPQSLNAVSRPQFIPPAPSDHERARQGSNASSQLASIRSPVSTIAILPSSLTEYHKAYMKGHPRPTNKISESEALPPTPEQTEEQRQISARRLKPNFRTMPEAGRTKPEPMTSLPTKKPRATKWQFGIRSRNQPAEAMLAIFKALKAMGADWEVPKIRRAGGRSGSRSRSTSQAPEDRKSKSRNHSQDSISSHSSDEDQGSRKGSPRREPLSVRNNGTSEQEARGRQKKHYNHTNDWGYHVPEDPWVIHARFLKEGMFPPGVAHPSSTHSSRVDLANDSSGARRRSSTNTSTSSAGHGVEGMTPSERAGSVSEDHVNPDEAVYIYMSIQLYSIDRDFFVVDFKCAGYERLVTNLVREIKASIPLSGSHQPPPHHQDGWDDEQGVWRRLDENEPLPEDLAKKLNEGGTEILRERTELVGAGRQEGEKIVTSPFPFLDVASTLILQLSGE

SEQ ID NO: 26412 - protein, 289 aa, Oryza sativa Japonica Group
MEGKEEDVRLGANRYSERQPIGTAAQGAGDDKDYKEPPPAPLFEPGELKSWSFYRARDRRVRRHLPLPLHHNPHRHGVSKSSSKCATVGIQGIAWSFGGMIFALVYCTAGISGGHINPAVTFGLFLARKLSLTRAIFYIVMQCLGAICGAGVVKGFQQGLYMGNGGGANVVASGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 26413 - protein, 443 aa, Neurospora crassa
  misc_feature (199)..(199): Xaa can be any naturally occurring amino acid
MDSERRPLLANGTGNGGRWTTESDSDFSWRDFFLDTTKTPGTNHPNPLVKYPTRVWNVTKVTLLSSWINILLIFVPLGIIAGERGWSAPAVFTLNFFAIIPLAAVLSFATEEIAHRLGETLGGLVNATFGNAVELIVSIVALRAGEIEVVQASMLGSILSNLLLVLGMCFLLGGIFNMRDSNGVGIEQTFASGTAQTTXSMMTLASASLIIPAALYTMLNHSDSQEKQDSILMLSCGTAVILLLLYCAYLVFVLRTHKELFEPEAQAVVDVVTEPKEDPVLSPWSAALVLIVTTVIISYAADYMVDSIDDIAATGAMSKTFIGLILIPIVGNAAEHVTACVVAVKNKMDLAMGVAIGSSIQIALLVTRLWVLLGWAIGQPMSLHFETFETIAFALSVMVVTYTVQDGKSNYLEGAMLMGLYIIIALAFWASPADALQKLSTIF

SEQ ID NO: 26414 - protein, 359 aa, Ustilago maydis 521
MRRAHHHARESSLVEHRPSAKTSLRPLPSCSVLHNVGLSAAYTHSAPSWLVWLSDFLLHDASASTVARRKTLFDDRPVEISELTYIIKHDIAAINKQLADLQAFNKANKSGRTADRAEEHRGNVVTLLQSKLAGATTSFQDILEVRTQNMKASKDRSEQFMFSNSATGAVPGENSVLRSRGKPTATAGTDSPLYNPTRTGSAMAHRTAPSALNDGLQHSASSDGYDAKGKTKAGESDFLALDMGSSSNASAVGSEQYLQMQLMDTQQTNYMQQRSTAIESIESTISELGQIFSQLAHMVAEQRETVQRIDDNVMDVVDNVGGAQRELLKYYASVSSNRWLMLKIFGVLIVFFLLFILVS

SEQ ID NO: 26415 - protein, 280 aa, Physcomitrella patens subsp. patens
MAERGGERGGFGRGFGRGDRGDRGGRGDRGRGDRRGGRRGPKRDEEEKWVPVTKLGRLVKEGKIKSLEQIYLFSLPIKEHQIVEFFLGSALKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRLVPAPRGSGIVAARVPKKVLQFAGIEDVFTSSRGSTKTLGNFVKATFECLLKTYGFLTPDLWRETRFSKSPFQEFTDFLAKPHKISVVEDVEKTPIY

SEQ ID NO: 26416 - protein, 376 aa, Thermotoga sp. RQ2
MDALEIHRFLKGKIRTALPVEKVDRETLSLLYTPGVADVAKICAEDPEKTYVYTSRWNTVAVVSDGSAVLGLGDIGPYGALPVMEGKAFLFKAFADLDAFPICLSESDEEKIISIVKSLEPSFGGINLEDIGAPKCFRILQRLSEEMNIPVFHDDQQGTAVVVSAAFLNALKLTGKKIEEVKVVVNGIGAAGYNIVKFLLDLGVKNVVAVDRKGILNEKNPETCLNEYHLEIARTTNPEGLSGDLETALEGADFFIGVSRGNILKPEWIRKMNRKPVIFALANPVPEIDPELAREAGAFIVATGRSDHPNQVNNLLAFPGIMKGAVEKRSKITKNMLLSAVEAIARSCEPEPERIIPEAFDMKVHLNVYTAVRDSA

SEQ ID NO: 26417 - protein, 208 aa, Zea mays
  misc_feature (163)..(163): Xaa can be any naturally occurring amino acid
MDLHYGARVGEAMAVGEAAYIATAGAGVGAGPSTVVDVVTRESAAQALGTVVQLHFDKTVEKKRAADAQKQELWRLFLAFFFLLALVLSGVAASPPARLQCRHLWAPAGLLSLAHLAFYAAVAHHLRCLNGFRYQRRCHKLTLALAADRLRMLKSAADVVPAXDVEVPSQEPPEASLPKFRGSWAIHFAFLIPTFAFWVAASVAIFCF

SEQ ID NO: 26418 - protein, 230 aa, Bordetella pertussis Tohama I
MSNVVPTPVFPLFAQPFATRLERALQHLRIGRPVILMDDFDRENEADLIVAADKLTVPVMAQLIRDGSGIVCLCLPGETLDRLELPPMVDSNRSRYSTAFTVSIEAREGVTTGVSAVDRVTTIRAAIAPGARSGDVVSPGHVFPLRAQPGGVLTRRGHTEGSVDLAALAGLRPAGVLCELMNADGTMMRGASLERYAAKEGLVALAIDELAAHLQARGATGAPAELAVAA

SEQ ID NO: 26419 - protein, 348 aa, Thermotoga sp. RQ2
MKLGILEKYRRFLPVTDKTPMLSLNEGNTPLIPLVNMSRELGINIYVKYEGSNPTGSFKDRGMVVAVAKALEEGSKAIMCASTGNTSASAAAYAARAGIKAIVLIPEGKIALGKLAQAMIYGAVVLQVRGNFDKCLELVKEITSKYPITLVNSINPYRLEGQKTAAFEIVDELGDAPDYHFIPVGNAGNISAYWMGYKEYYQHGFSTKLPKMMGFQAEGAAPIVRGHPIENPETVATAIRIGNPANWEKAVRARDESGGDIDMVSDEEILRAQRLLAQKEGIFCEPASAASIAGLLKKHRQGIFRGGEIVVCTLTGNGLKDPNIVISQLEPPRTIEGRVEEILEVLDI

SEQ ID NO: 26420 - protein, 669 aa, Burkholderia pseudomallei K96243
MISPLEMTLLLLLASVVGVVVFRSLNLPPMLGYLTVGILVGPHALGFAADLERAEHLAEFGVVFLMFSIGLEFSLSKLRAMRRLVFGLGLAQVLGTIAIALVLGALFERWMHITWEGSVALGGALAMSSTAIVSKMLAERLEIETEHGRNIFGVLLFQDLAVVPLLIVIAAFGGESSKDLAMSLGFAAVKIVVALALLLIVGQRFMTRWLNVVARRRSQELFVLNLLLVTLGAAFITDRFGLSLALGAFIAGMLISETPYRHQVEEDIKPFRDVLLGLFFVTTGMLLDPSVIWRHPLLVLAFFVGQVLLKSVMITGLARAFGATPGVAMRTGLGLAQAGEFGFVLLNLILDRHLVDATLLQSILASMLLSMLAAPFLIQNADRIVMRLSAAEWMQQSLQMTRIATQSIKQKGHVIICGYGRAGQNLARMLEQEGIAYVALDLDPDRVTAAAAAGESVVFGDAARRESLLAAGIHRAAAVAVTYANTPSALRVLHNVHELEPTLPAIVRTVDDADLEKLLAAGATEVIPEIVEGSLMLASHTLVLMGVPMRRVVRRVEEMRDARYSLLRGYFHGADDADDDDHEQVRLQSVPVDARADAVGRSLSELGLFALGLEVTAIRRHGIRGVEPDPETKLRASDIVVLRGLPEALAQAEERLSRHRREGGSAAVA

SEQ ID NO: 26421 - protein, 720 aa, Thermotoga sp. RQ2
MRVGIAGLGTVGGSIYRILKERGNEIEKRIGEKFIISKVINRSPQKYELLGVPKEEIAFDFDDLILNSDVIVEAIGGTDVAVDLVRRALELGRIVVTPNKNLISEYGNEFSEYIKKRKLFFEASVGGGIPIISLLQDYLIFQKVTRIRGIMNGTTNYILTEMSKGRHFEEVLKEAQELGYAEADPTNDIEGYDVAYKVSVLAGVVTGRFPGINSVQFEGITRIDPEYLKEIVRSGKKLKLIGELDFSTNRYEVRLREVTPEDPFFNVDGVDNAIEVSTDLAGDFLLKGRGAGGYPTASAVIADLFRVAKYKVLGGAEKFSVVVMKFGGAAISDVEKLEKVAEKIIKRKKSGVKPVVVLSAMGDTTDHLIELAKTIDENPDPRELDLLLSTGEIQSVALMSIALRKRGYKAISFTGNQLKIITDKRYGSARIIDINTDIISRYLKQDFIPVVAGFQGITETGDITTLGRGGSDLTAIALAYSLGADLCELYKDVDGVYTADPRIVKNARVIKELSWEEMIELSRHGAQVLQARAAEFARKYGVKVLIKNAHKETRGTLIWEGTKVENPIVRAVTFEDGMAKVVLKDVPDKPGVAARIMRTLSQMGVNIDMIIQGMKSGEYNTVAFIVPESQLGKLDIDLLKTRSEAKEIIIEKGLAKVSIVGVNLTSTPEISATLFETLANEGINIDMISASSSRISVIIDGKYVEDAVKAIHSRFELDRE

SEQ ID NO: 26422 - protein, 349 aa, Triticum aestivum
  misc_feature (106)..(106): Xaa can be any naturally occurring amino acid
  misc_feature (254)..(254): Xaa can be any naturally occurring amino acid
SKEVSDFAAKYMYHNPLHLDTYKEVSKMEAEILRMTASLVSKNPAYGVITSGGSESLIMSLYAYRKYFNKAKPNIVVPNTIHAAIDKGAMYLNIEVRKARLNERFXVDVAHMKSLIDHNTIALYASYPNFPHGIIDPIADIAPIAKKHKIGFHVDGCLGGFVAAFLKEHEGKFSLDIDGVTSISLDNHKFGLAPKGVAVLLFKEKKLRPSMYFIYTEWVGGIYATPSFPGSRSGFASAGAWYALTHVGRKQYLXNSMRVVEATKKAAKELAKIEGVRVLGNPELCVLAFQTDIVDCFSVSSFLTKEKGWKISAIHLPKGLHISVTLANCNNVGQNLAKDVKEAIEKVKL

SEQ ID NO: 26423 - protein, 448 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLVLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGIAA

SEQ ID NO: 26424 - protein, 629 aa, Vibrio campbellii AND4
MEAELLEIYNFLAKYPPFDELPEETLTKVTENIEISYFRQDTPIIHLGDQIDELYMVRSGVVEVYRRKGELYNRLDEGDLFGQMGLLTSNKVRFPVKAIEDSLIYCIPQDIFLELYDNYDSFADFVEVENSARLRQVVSDNNDANDLTTSKVKTLLTRDAATIGRDQSIQEAAQLMAQDNVSSLLIVEPDFVLDEDDPQSPVVGIITDRDLCTRVLAEGLSPQDEVSTVMTTEVISLDHNAYVYEAMLTMLRSNVHHLPVVKDQMPIGVIEATDIVRYESQNSLLLVSSIFQQQTIEDLAIVADEVKSSFVRLVNEDANSHMVGSAMSVIGRSFKQRLLEMAEEELGPPPIPYCYLALGSMGRDEQLLVTDQDNAIILDDTYKEERHGQYFEALAQYVSDGLNVCGYKYCTGDIMATNPLWRMTRSQWEECFADWIDDPNPKALLNASIFFDLDGVYGRLKWAEQLTSFIVRRARKNNRFLACLARNALNRTPPLGFFKDFVMEKDGQHKNSINLKRRGTAPLVDLIRVHSLAVGSRAQNSFERLDDIIDAGILPKGRAQDLKDAMEFISMVRIRHQAIDVELGIEPDNNIEPESLSDFERRNLKDAFQILSNGQNFLKFRYQASNKFK

SEQ ID NO: 26425 - protein, 187 aa, Burkholderia pseudomallei K96243
MMSTSDAPLDPVEFIHSRIRTVPDWPQPGVMFRDITPLLQSAKALRVLVDLFVERYVDAKLDYIAGLDARGFIIAPIVAYELSVGFVPIRKVGKLPYATQRESYALEYGTATVEIHEDACKPGDRVVIVDDLIATGGTMMAGKNLLERLGAVVVEGAAIVDLPDLGGSALLRGAGLPLYTVTEFPGH

SEQ ID NO: 26426 - protein, 256 aa, Xanthomonas campestris pv. campestris str. ATCC 33913
MSIQILDHGRLREIRLARPPVNALDTALCQALTAAVQQVGSEVDGVVLSGSERIFSGGMDVPHLLSHGTNRGALLESWTAFFDAANALAHCPVPVVAAIGGHAPAGGCVLALCCDYRVMARSADTARPYAIGLNEVQVGLAAPEGIQRLLRRVVGAHRAERLLIAGQLVPAEEAVKIGLVDELVDGELVTARAVAWLQDLQQLPRQPMLATRAVARADLRAALAPELIQLERFIDGWYAPDAQAALHGLVARLQKA

SEQ ID NO: 26427 - protein, 514 aa, Vibrio sp. Ex25
MESQPEKKVNQTGADYLRQILRAPVYEVATVTPLQEMPRLSARIGNNVQIKREDRQPVHSFKLRGAYNMVASLSEAQKAAGVIAASAGNHAQGMALSGTKLGIKTTIVMPKTTPDIKVDAVRSFGGNVVLHGSNFDEAKAEAERLSEQYGYTFVPPFDHPLVIAGQGTIGMEMLQQNGHLDYIFVPVGGGGLAAGIAVLVKQLMPEIKVIAVEPEDSSCLKAALDAGEPVVLDQVSMFADGVAVKRIGEETFRLCQKYIDGHIAVSSDEICAAVKDIFEDTRAIAEPSGALALAGLKKFAEQNKLKDKNLGTVLSGANTNFHGLRYVSERCELGEKREGLLAVTIPERQGAFFEFCNLIGGRAVTEFNYRYNDDELANIFVGVRLQGGQEELENIIHDLREGGYPVVDLSDDEMAKLHVRYMIGGKPSKQLKERLYSFEFPEYPGALLKFLSTLGTHWNISLFNYRNHGADYGRVLCGFELDEGDLAQFSAHLRELGYQCKDETDNPSYKFFLS

SEQ ID NO: 26428 - protein, 264 aa, Mucor racemosus
KVDGQKVKADAEKVKAFRKSLTSLADVYVNDAFGTAHRAHSSMVGVELPQRAAGFLMQKELEYFAKALENPSRPFLAILGGAKVSDKIQLIENMLDKVNSLIVCGGMAFTFKKTLDNVKIGTSLYDEAGSKLVENLMKKAQEKNVKILFPVDFVTADKFAPDAKTGYATDATGIPDEWMGLDCGEESSKLFRDEILKSKTIVWNGPSGVFEFDAFANGTKAVLNAVVEATKEGATTIIGGGDTATAALKWGAGDKVLTSLPVVV

SEQ ID NO: 26429 - protein, 537 aa, Thermosynechococcus elongatus BP-1
MAAILETLALILLLGFFAGQLARRLGAPALIGMMLAGILLGPAALNLLDTDILRAAPTLRAVAVMVILMKAGLGLDRQKLVQQGTVALRLGVLPALCEMAVVAGMAILLLGFDLRQGLLLGAIVAPESPAVIVPGMLRLKSLGWGVDKGISDAILSGSAISDVVVLLLFSLLMGADQGRGFLGDLPPAIAVGVQALLEIGGGLIVGYGLAWALVFVLVKQNWSQNRVQTTLVAAAVALGAVGLADRLPLFSGYVAVMSAGFFLIEMDAPLGRQLRVGFDGLWQVAEIFLFVLLGASVQLGVLQRSLGVGLVILAGGTFIGRGIGWYLSTLGSDWTRSERLFLLPGNSAKATVQAAIGALPLSAGVPGAETMLAIAVLSILITAPIGAWAIPTFAPKLLQKGEVDPTKVLLQPRVVLLAPVDVSSVTPYVLQKAAELARRADAEVIVLHVQDIPDPQAVATLKAQMKQYLADIRYRFILTAGPITEAILETATLYNVTEIILGKHGQKGLKRVLMGSVCQSILEASTRPVLIVEEPRL

SEQ ID NO: 26430 - protein, 678 aa, Physcomitrella patens subsp. patens
MFVPRVVQLRTQKQPPLPRTGPSLFPSLPSGGQPMASSGVDQLVADFLRKRGLTKTLKAFVSESSYKDPKIPASIDLGTICSDYFVKIKETGGKSRVDITNRNTTKADAKNGAKKPAVKESDITSDDSDESEDDEKLPENSAKQSTAKGVKTVAKKPAVKEPESSSDDSDDSSDESDDEKKKPVVAKKPAPTVPATKVSVESSDDDSSSDEDDDDVKPAKTIAKTNGFVKAKTTAAPSDSSSSDSEEDEEETSTKAKAVVVVASKKDEPSSSDDSDEDSEDEKVVAKTSPPAAAKGVKSAAAPKSSSSSSSDDSSSDDEEVTVQPIKTVNSVKPADDSSSEEDSDIDMKTATPAVSDKKVSKPSSSSDDSDSSDDEMEVDPKPAIKAVQKSVSVKTEAKKAASSSDSSSDEDSDDETEKKKNVKKPVVANSTNVKKAESSSDSSSEEEDEPKAVAKTGKAKTPATAKVVSAKDSDNDSDSSDESVEIKSSIKGSAKASNGKQESSDSSDSSDDDESEVVKKPAGKKESKVKIAKDVAPVVVASPVNKKRKAVEEEADTGHVSKKANVEGVAVATSAGMNSAKKQKLGSAQKTPSTARAFQRVKVEEVEIKDARLADNSYWAKSGAEEGWGAKAQEILGQVRGKGFRHEKTKKKRGSYKGGIIDNASHSIKFQNSDDDE

SEQ ID NO: 26431 - protein, 315 aa, Magnaporthe grisea 70-15
MTSKEDIRIMGMPPFVVDFLMGGVSAAVSKTAAAPIERVKLLVQNQEEMIRAGRLDRRYDGIVDCFKRTSQAEGVMSLWRGNTANVIRYFPTQALNFAFRDKFKAMFGYKKDKDGYAKWMAGNLASGGAAGATSLLFVYSLDYARTRLANDAKSAKGGGDRQFNGLVDVYRKTLASDGIAGLYRGFGPSVAGIVVYRGLYFGMYDSIKPVLLTGSLETNFFASFALGWCVTTGAGIASYPLDTVRRRMMMTSGEAVKYSSSFDAFKQIVAKEGVKSLFRGAGANILRGVAGAGVLSIYDQLQLIMFGKAFKGGSG

SEQ ID NO: 26432 - protein, 792 aa, Nocardioides sp. JS614
MTGIVPAVVEVSGGNLVLVIVVALIALGALAMAAMFRQEVLAAGEGTDNMKNIAQAVQEGANAYLQRQFRTLAIFAVVAFFLLLALPADDAMVRIFRSVFFLVGAGFSATVGYLGMSLAVKANLRVAAAAQTQGRDPAMNIGFRTGATVGMLTVGLGLLGASVVVILFQEDAPHVLEGFGFGAALLAMFMRVGGGIFTKAADVGADLVGKVENNIPEDDPRNAATIADNVGDNVGDCAGMAADLFESYAVTLVAALILGSQAFGDKGLVFPLLIPAIGALTAVVGVYLCKPRAGENGLTTINRAFYISAAIGAVASIILALVYLPGDFADLTNSTVDADASPRVVAALAVLIGIVLAAAILGLTGYFTGTDHRPVKDVGKTSLTGAATVILSGLSVGFESAVYTTLVIGAAVFGAFLVGAGSIPVALFAVALAGCGLLTTVGVIVAMDTFGPVSDNAQGIAEMSGDVDEHGAQILTELDAVGNTTKAITKGIAIATAVLAASALFGSYTNALQDAIDEVTLTEEPGALTSLAFSFNASYPNILVGMLLGAAVVFLFSGLAINAVGRAAGAVVYEVRRQFREIPGIMEGTGRPEYGRVVDIVTRDSLRELATPGLLAILAPIAVGFGLGVGPLAGFLAGAIATGTLMAVFLANSGGAWDNAKKLVEDGNHGGKGSDAHAATVIGDTVGDPFKDTAGPAINPLLKVMNLVSLLIVAAIVKLSIGEDANTPLRIVIALAAFAGIVAAVYVSKRRPVHIEGDDDGTTAPPPPPPPVEAVPPTEPAPTQQFEAPQQH

SEQ ID NO: 26433 - protein, 332 aa, Carboxydothermus hydrogenoformans Z-2901
MAHRVTLIPGDGIGPEIVEAARRVIDASGANIEWEVVEAGEKVMAEYGTPLPEYVLESIKKNKVALKGPMTTPIGTGFRSVNVALRKALDLYANVRPAKSLPGVVTRYENIDLITVRENTEDLYAGVEHMVGDDAAESIKIITRKASQRIVRFAFELARKEGRKKVTAVHKANIMKYTDGLFLAVAREVAAEYPDIEFEDMIVDAMAMKLVQTPEKFDVMVMPNLYGDILSDLCAGLVGGLGVAPGANIGDEYAVFEPVHGSAPKHAGQNRVNPLAEILSGVMMLKHLGEMDAAAKIERALTKVLPNKDMVTYDLGGTAKTSEMADYIIKHL

SEQ ID NO: 26434 - protein, 131 aa, Brassica napus
SRYHSDHGSGSQAISDNGEDKLMGDVKPLFESFDVTMDLIGGIDKRSECYYGDNAREQHVGPELGLSLKRSCSERSLEKNQDESKHQKISLSDASAFSRYENGKAGEKAVVVAVEASSSAEPKTPSESHEK

SEQ ID NO: 26435 - protein, 379 aa, Lactococcus lactis subsp. lactis Il1403
MNDILQLTIVLIASLIATLVSRRLKIPAVVGQMLVGILIAPSVLGLVHSGHVLEVMSEIGVILLMFLAGIESDLTVLKKNFKASMLVAVGGVIVPLIAFGLVAFGFGYGISTSFFYGIVFAATSVSITVEVLQEYGKLSTRAGSIILGAAVVDDILAVLILSIFTSFKNGGSGSHLFIQFLLELLFFAFLFLVHKLIPRFWKFVQKLPIANKNTIVALIICLGLSLLADSVGMSAVIGSFFAGLAISQTEVSHKIEEYTSAIGYVIFIPVFFVLIAISVQFDSLIHHPWIILLFTFLAILTKFIPAYFVGKASKLSTGESMLIGTGMISRGEMALIVAQIGLTSAIITDEVYSELVIVIILATVLAPFLIKMVLKKYDN

SEQ ID NO: 26436 - protein, 869 aa, Sulfitobacter sp. EE-36
MGKAITPCHTTAKAYAAQEPKGAAVQKTAMTTLVTQTAPIANDTHGGRAKCLQRLVRLDLPVPRTVALPFDVVLEIAQGQIPDLQAVADEFPQDALLCVRPSSQDPDWGGPGAVMNIGMNDDRYADYCERMGEGPASALYTRFVQSYAVNVARLDPDMFDDVEGDGREALLQSLRAYELETEESFPQDRVTQLTAVLSSMARAWEGTSARLLRQAKGAPADAGLGLIVQQMVFGVGTGICGSGVLQLVDSTTGLPQITGRYLSQSQGRDALQDTADALYLTRDPRGPSLEEHAPEAFEMLKQHAALMRVRLRAEMQVEFVISDGELFILDGVRVSRSSRAAVRIAVALADEGIIPREEALMRVQPRTLTELLHRQVDPRVKRDVIGRGIAASPGAATGRIVFNANDAQASAARGEKCILVRRETSPEDIRGMHAAQAVLTERGGITSHAAVIGRGMGLPCVVGASSMRFDLVKGVITAPDGRMFKAGDEITLDGTSGEVLCGAADMLEPLLDATFQKLMSWAEDAADIGIRANADTPADAQTARNFDAQGIGLCRTEHMFFDPSRLTVMREMIFADTSEGRRAVLERLLPMQRDDFIQLFRIMQGQPVCIRLFDPPLHEFLPSTRTGQRDLAEALDLPLSNVTRRIEAMTEYNPMLGLRGVRLGVTVPEIYEMQARAIFEATIEASRDGDPVVPEIMIPLVSAKREVELIKASVDKIATAVKSERGASFTYRLGVMVETPRAALRAGEISPHCSFLSFGTNDLTQMTYGLSRDDAGRFMSTYVQQGVFPEDPFHMLDRDGVGELLQLGAARGREAQPGITLSICGEHGGNPESIAFCRAAGFDYVSCSPFRVPVARLAAAQLAIADKIG

SEQ ID NO: 26437 - protein, 131 aa, Brassica napus
MASFTSSVTCPTLLLKPSVTASSTETVYGLPSMIRRSSGVKCSMETNQPKKEKNSTPVFSAVGVMLTAVMSSSPAMALVDERMSTEGTGLPFGLSNNLLGWILLGVFGLIWAIYFNYVSSLDEDDDSGLSL

SEQ ID NO: 26438 - protein, 570 aa, Oryza sativa Japonica Group
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 26439 - protein, 221 aa, Gibberella moniliformis
SSGVFTTIDKAKAHLTGGAKKVIISAPSADAPMYVVGVNENKYDGSADIISNASCTTNCLAPLAKVINDKFGIVEGLMTTVHSYTATQKTVDGPSAKDWRGGRGAAQNIIPSSTGAAKAVGKVIPELNGKLTGMSMRVPTANVSVVDLTVRLEKGASYDQIKKVIKEASEGDLKGVLAYTEDDVVSSDLNGNTNSSIFDAKAGISLNDNFVKLVSWYDNEW

SEQ ID NO: 26440 - protein, 307 aa, Chlamydomonas reinhardtii
MWAVRKSGAANLKMTISKEENAETQILMPKPSLGSNNGSAMGKHIFGLPSVLVAGLCYCAASGSMVLLNKHALASFGFGSPTALLCFQCALAAILVKLCELVGFVKLQPLKPDLVAVWFPVNLIFVGMIGTSFYALKEVGVGMVTVWKNLSNVVTACGDVFIYKRTYTWQVWGCLGLMLVSAVAGASTDSRFTWLGYSWQIANCFFTSAYALYLRSVMDKVAEHTTNKQKWTSSAWCTTTTCCPSRPSWWRCGTSASSRGCSTSRPCATPTSCSCQPWAASSASASASAACGTCPRPPPPSTRWWAR

SEQ ID NO: 26441 - protein, 2135 aa, Cryptococcus neoformans var. neoformans JEC21
MCGVGFICHIKGHAAHKIVSDARNILCNMTHRGATGADARDGDGAGVMTGIPHDFFVREASFCFDAKLPGEGHYAVGNVFFSTDDYAQQQGTFESIAKSLGLRVLGWREVPTDNSILGPASKSKEPKILQPFVVLEEHYGPGQDSQDGNFDERKFERELYILRKQATHKIGLKNGFYVCSLTTSNIVYKGQLSPIQVYNYYHDLNHALYASHFALVHSRFSTNTFPSWDRAQPMRWAAHNGEINTVRGNKNWMRAREGNLRSDRFGDDLELLYPIVESGGSDSAAFDNVLELLVVNGVMTLPEAVMMLIPEAWQNNDLMEPEKKAFYAWAGSLMEPWDGPALFTFSDGRYCGANLDRNGLRPCRFVVTSDDIMVCASEVGTITIEPEKIIQKGRLKPGRMLLVDTKEGRIVDDRELKLTTAKRQPFAAWVESQVLRLPEVVRRVQRFENIDVSLDEVPLSTDPKLLAFGYTIEQLNMLMLPMVHEGHEALGSMGNDAALACMSTTPRTVYDYFRQLFAQVTNPPIDPIRESIVMSLETMVGNEGNLLEIKPSQLHRLHLKSPILTIQEMNSVKHMKLANSGWPSITIDITFDKREGLPGYRNALDRVRQEVINAVDAGFKSVILSDRATSPDRVPLSAILAVGGAHHFLVKERKRSKVALMVETGEAREVHHMCVLIGYGADAICPWLIMEMIYKVGREGLVKESQSVEKLVANYMKATDEGILKVLSKMGVSTLASYKGAQLFEILGLHEEVVGDCFVGTASRVQGATYELLAMDAFEFHERAWPTRDAVMVPGMPESGEYHYRQGSEMRVNDPVSIAQLQDAVRQKNQAAYDTYSKNSRESIKRGTLRGLLEFNFENATPVPIEQVEPWNEIVRRCVTGAMSYGSISMEAHTALALAMNRLGGKSNTGEGGEDAERSIPIPGPGAELNGQPFTHAMELKPVWDSRRSAIKQVASGRFGVTSNYLADSDELQIKMAQGAKPGEGGELPGHKVSASIGRTRHSTPGVTLVSPPPHHDIYSIEDLKQLIYDLKAANPRARVSVKLVSEVGVGIVASGVVKAKADHITISGHDGGTGAAKWTSIKYAGLPWELGLAETHQTLVLNNLRGRVTVQTDGQIRTGRDIAIATLLGAEEWGFATTPLIAMGCIMMKACHKNTCPVGIATQDPALRAKFAGQPEQVINFFYYVIEELRQIMAKLGFRTINEMVGRADMLTVDDSLRTPKTAHLDLSHILKPAQLLRNDVATYRVRAQDHKLYVRLDNKFIDEAEPALQKGLPVTIDCDVVNTDRALGTTLSYHVSKRYGEEGLPRDTIHINMKGSAGQSLGAFLAPGITIELEGDANDYVGKGLSGGRLVVYPPKSSPFKAEENIIIGNVCFFGATSGQAFVRGIAAERFAVRNSGATLVVEGTGDHGCEYMTGGRVVVLGLTGRNFAAGMSGGIAYVLDMAHSFAPKVNMSTIELGPVSDPQEVAELRSLIEDHRHYTGSEIADRVLRNFHHLLPMFVRVMPLDYKRVIEQEAQRAAEEKKRQSVIDLIPSQTASQVDLVATGYDPVLPRDANALTVSTSALISPEGSPKHKPQEPQIVDVEDAMVDETATKERLAKVDKVRGFMKYKRLNEAYRPPRKRVKDWKEISTRLKPSELKYQSARCMDCGIPFCQSDTGCPIANVIPKWNTMIFEGRWLDALNRLLKTNNFPEFTGRVCPAPCESACVLGINEAPVGIKSIECAIIDKGFEMGWMTPNPPEHRTGKRVAVIGSGPAGLAAADQLNKAGHIVTVYERQDRVGGLLMYGIPNMKLDKGVVQRRVDLMAAEGVTFITNAHVGVDSQYDPLNIKAENDAVIVATGATWPRDLKLPHREVDGIHFAMDFLTPNTKVKAFGDDAPGFISAQGKDVIVIGGGDTGNDCIGTSMRHGAKSIVNFELLPEPPKSRAPDNPWPMFNRSFRTDYGHAEVQAHFGHDPRKYCMATKKFVLDDEGKLKGLDTVQVEWTKQNGQWKMEEAVGSEKFYPAQLVLLALGFLGPQQECLKALGVETDPRTNIKTAPNSYSTNVPGVFAAGDCHRGQSLVVWGIREGRQAAAEVDTFLMGSTHLAWQGGIEKRQYVVPSISKPLHGLDEKAGDIETSSQGVDLESASVTASA

SEQ ID NO: 26442 - protein, 466 aa, Burkholderia pseudomallei
MKITIIGTGYVGLVTGACLAEIGHDVFCLDVDPRKIDILNNGGMPIHEPGLQEIIARTRAAGRIAFSTDIEASVAHGEIQFIAVGTPPDEDGSADLQYVLEAARNIGRHMTGYKVIVDKSTVPVGTAQRVRAVIDEALAARGLAGSAEHRFSVVSNPEFLKEGAAVDDFMRPDRIIIGVDDDAAGAIAREKMKKLYAPFNRNHERTIYMDVRSAEFSKYAANAMLATRISFMNEMSNLADRVGADIEALRRGIGSDPRIGYHFLYAGVGYGGSCFPKDVQALIRTASENGQPLRILEAVEDVNHAQKNVLLDKIEKRYGADLAGRTFAVWGLAFKPNTDDMREAPSRRLIASLLARGAMVRAYDPVALDEARRVFALDLHDGADALARLAFVDSADDALAGADALVIVTEWKEFKSPDFAHLKSVLKAPVIFDGRNLYEPDAMAELGIDYHAIGRPYVEPFSSERG

SEQ ID NO: 26443 - protein, 109 aa, Populus trichocarpa
MAVRSLLAMMVLLFCLAEVSSDLKIDTEIPQVFQLVVRGGNRRLMQDIDCGGLCKQRCSLHSRPNLCNRACGTCCVRCKCVPPGTSGNREVCGTCYTDMTTHGNKTKCP

SEQ ID NO: 26444 - protein, 279 aa, Phaseolus vulgaris
QDYHGLPSFKKALVDFMAEIRGNKVTFDPNHIVLTAGATSANETLMFCLAEEGDAFLLPTPYYPGFDRDLTWRTGAEIVPIQCTSSNNFHITESALKQAYEEAGRRNLRVKGVLVTNPSNPLGTTMSRSELNLLVDFIKEKKDSHLISDEIYSGTVFSSPGFVSIMEILKERNDADGIWNRVHVVYSLSKDLGLPGFRVGAIYSENDTVVAAATKMSSFGLISSQTQYLLSAMLGDKKFTRNYIVENQKRLKRRQRMMVSGLQKAGISCLESNAGLFCW

SEQ ID NO: 26445 - protein, 620 aa, Salmonella enterica subsp. enterica serovar Paratyphi B str.
MDSHTLLQALIYLGSAALIVPIAVRLGLGSVLGYLIAGCIIGPWGLRLVTDAESILHFAEIGVVLMLFVIGLELDPQRLWKLRASVFGGGALQMVVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVVLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARPLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKSHFPHLQIIARARDVDHYIRLRQAGVAMPERETFEGALKSGRQALEALGLGRYEARERADLFRHFNTRMVEEMAKGENDPLSRAAAYKRTSAMLSEIITEDREHLSLIQRHGWQGTAEGKHSGEVADEPEVKPSI

SEQ ID NO: 26446 - protein, 137 aa, Vibrio campbellii AND4
MVAESQEVAATAFSQVKAIIRSIYSNPPAHGSAVVTHILGDKALREEWETEVAEMRDRIQEMRELFVTTLKEKGVDADFSFIERQNGMFSFSGLSKQQVNRLKEEFGIYIVGSGRISVAGMTKSNMDPLCNGIAAVL

SEQ ID NO: 26447 - protein, 238 aa, Vibrio campbellii AND4
MFEKVVAAPADPILGLTEEFKKDTRAEKINLGVGIYKNEQGETPVLATVKKAEAALIETEKTKSYLTIEGTAEYGLAVQKLLFGDDAEIVASKRAKTAQAPGGTGALRVAGEFIKRQLGDVKVWISNPTWANHNGVFTAAGIETAQYGYYNAETKDKDFDAMLADLQSASEGDVVLLHGCCHNPTGIDPTAEEWETLAKLVADKKLLPLFDFAYQGFAKGVEEDAAGLRTFAKYNNEL

SEQ ID NO: 26448 - protein, 744 aa, Ustilago maydis 521
MSIAPVPRSPSVVAQSTHSTLDANTGKRRALDSQCTTKISSKGESTTALGLLRLEWEILTLSTAVKLLLFPTYHSTDFEVHRNWLAITRTLPIRDWYFEATSQWTLDYPPFFAYFSWLLAQPAPLVDPLIVSLHEGLEYAAWSCKAYMRTTVVVTELVLAAALLAHARLGAQRTVKIGYSDQVSATGVSTSYLLAASLLMHPGLIIIDHIHFQYNGFLFGILAWSLWAAREDKPLWCAFLFSSLLNLKHIYVYVAPPFLIFLLRSYVFPIGSRASDLGRSFERLLTVGVVTLIPFLLSLAPVAIDGLRHEKGSFGVLTQMVQRLFPFSRGLIHAYWAPNVWALWTFADRVLVKLLPRIPALRTLLPASFSARFDGAAGSGFASASRGLVEKISFGVLPEIRASTCFVLTLTLTSVYMLKLWQTPTYRSFLASVSLCGFASFLFGWHVHEKAIMLPLIPYTFLAAVDYAHFRTFVLLSVSGIVSLFPLLFTPQEEPIKIGYSVLWGLLALSMLQRRVLRPVQSNLGILVHQLETLYMWGFVALQVYVSLMHPLVFATAGGQEAVVPTVSPAVALSNLTTADIAASALDAAAAARSYAATVAANMEDGIVNGSVLSTAISDSAKSSDSHASNTMPAEVTLVDPIDAMPVAATLAVNTADFDAPQPAATHSADVLSVAAASQRAQATALTPETARPHLQQDEKPKIAWSSSSSSMEFLPLMMVSVYCSIGVIWAWIRASALYLSSES

SEQ ID NO: 26449 - protein, 506 aa, Legionella pneumophila str. Lens
MDLLQRLNIKSVNPGAFSGHGWHSDNHAHTLESFNPSTGNKLAEIATCTMDDYEQVMQRAEQAAQAWRKVPAPKRGEIIRQIGQALRENKDSLGSLVSLEMGKSKQEGDGEVQEMIDIADFAVGQSRMLYGNSMHSERPNHRMYEQWHPYGIVGVISAFNFPVAVWSWNAFLSAICGNVTIWKPSAKTPLCAVAVQHICNQVLKENNCPEIFGLIIPNSHDVVEAMVDDKRIQLISFTGSTAVGKQVAAKVAARLGKSILELGGNNGIILDESADLNLAIPAIVFGAVGTAGQRCTTTRRLFVHESKYQDVIKRLRHAYEQITIGDPLDTRNLMGPLIDQQAVEQFKKAINRIKAAGGQIVYGGEILKQAGSFVQPTLVCDVKNDWDIVQEETFAPILYVMSYRTLDEAIALHNGVPQGLSSALFTQNLKNAELFLSACGSDCGIANINIGTSGAEIGGAFGGEKETGGGRESGSDSWKAYMRRQTNTINWGDELPLAQGIRFNLS

SEQ ID NO: 26450 - protein, 439 aa, Corynebacterium glutamicum ATCC 13032
MNLTRNDRLDRLPVTSKHKKILGGSGIGWALDAMDVGLISFVMAALATHWGLSPTETSLLGSIGFVGMAIGASLGGLLADKLGRRQVFALSLLVYGVATGASALSVSLAMLMALRFVVGLGLGAELPVASTLISEFSPRKVRGRMVVILEAFWALGWIMAAIVGTFVVAGSDNGWRWALALGCVPAIYAVYVRLGLPESVRFLEKKGRHDEAEAIVVSFEEAAAAEGKAADATTAVVHDNAAEGSVSIWSAALRKRTVALWIVWFCINLSYYGAFIWIPSLLVADGFTLVKSFQFTLIITLAQLPGYAVAAWLIEKWGRRSTLATFLVGSAISAALYGLANVEWQILVAGCLLSFFNLGAWGALYAIGPELYPTNVRGTGTGAAAGFGRIASIIAPLIVPPVIAFGGPIALFALFATAFAIAAIAAFTLPEQKGKSLAD

SEQ ID NO: 26451 - protein, 384 aa, Candida albicans SC5314
MQLINQFSKSPPLLQFNSPNFKFIFKYSLLLFFLIIVIFLFLYPPSIYQIMSILPETQKVVLHRENGDYDVIEYSDFPTPKIESSHDIIVKNSYAGVNFIEAYFRKGIYKASLPYVFGREASGEVVAVGDEVSTLKVGDKIAYLSPNTFAQYTKITDDNYKYIKLPDNASDEELKIYGSLFLQGLTALTFVNEAYKVQKDDYILVWAAAGGVGKILVQLISQLGAHVIAVASTPEKLKIAQDLGAEFLINSTSDDIVEKVKEITNGEGVAASFDSVGKDTFEISLNSIKRKGTFVSYGNASGPVTPFPLSILSPKNIKIARPQLYAYIGNADEWDHYSTELLKLFESGKLKFDIFKTYDLKDYVQAAKDLEGRKTTGKLTLKIS

SEQ ID NO: 26452 - protein, 342 aa, Oryza sativa Japonica Group
MALSSFSMSLPFAKLPSTSKSTRFLPIRASSAAAAASPSFDLRLYWTSLIADVEAELDAAMPIRTPERIHSAMRYAVLPGAGNEGTAKRAPPVLCVAACELLGAPREAPVPAALALQMVQAGWLVNEDLPWFEAGPKRRGGPSNQAAYGTDMAVLAGDALFPLAYTHVIAQNPSPEPVPHAVLLRVLGELARAVGSTGMAAGQFLDLAGATALGEAEVMKVLTKKFGEMAECSAACGAMLGGAGPDEEAALRRYGRTIGVLYQLVDDIRSASGNGKMRSNASVLRALGMDRALGIVEELKAQAKMEADRFGDKYGERVLPLYSFVDYAVERGFELQDAATTP

SEQ ID NO: 26453 - protein, 173 aa, Magnetospirillum magnetotacticum MS-1
MQVTIAQQEINRHTIAVLVDNESGVLARVVGLFSGRGYNIESLTVAEVDASEKLSRITIVTSGTAMIIEQIKNQLRRLVPVYKVHDLTIEGPHVSRELALVKVAATGDKRVESLRIADIFRARAIDSTNESFVFEVVGATDKVDAFIKLMEPLGLADVSRTGVVAIARGPNPI

SEQ ID NO: 26454 - protein, 376 aa, Oryza sativa Japonica Group
MAAAMALQVVAGGGCCCQRPVLGAGRRRLAAARAVASDAAAAKVSEEEGKVRLGGSEVAVSKLGIGAWSWGDTTYWNDSEWDDRRLQEAKAAFDTSIDNGMTLFDTAEVYGTALMGAVNSESLLGGFIKERQEKEQIDVAVATKFAALPWRFGRGSVLSALKKSLDRLGLSSVELYQLHWPGLWGNEGYLDGLADAYEQGLVKAVGVSNYNEKRLRDAYARMKKRGVPLAANQVNYSLIYRTPELNGVKAACDELGITLIAYSPIAQGVLSGKYTPEKPPTGPRANTYTPEFLTKLQPLMNRIKEIGESYGKNPTQVSLNWLTCQGNVVPIPGAKNAGQAQEFAGALGWSLTGDEVEELRSLAREIKGIKMPIEES

SEQ ID NO: 26455 - protein, 246 aa, Triticum aestivum
TSLYKKAGWYRSGIPGISSTHAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHPATLVNTFPEGTDSTDSVESPEKFEEASPEYALPTASPLSDFVDNAKKTMMEMVDNINDFFQDLFHNPAESEGWTGLIL

SEQ ID NO: 26456 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGNYLVDVILDEAANKGTGKWTSQSSLDLGEPLSLITESVFARYISSLKDQRVAASKVLSGPQATPAGDKAEFIEKVRRALYLGKIVSYAQGFSQLRAASDEYNWDLNYGEIAKIFRAGCIIRAQFLQKITDAYSQNAGIANLLLAPYFKQIADDYQQALRDVVAYAVQNGIPVPTFSAAIAYYDSYRSAVLPANLIQAQRDYFGAHTYKRTDKEGVFHTEWLD

SEQ ID NO: 26457 - protein, 235 aa, Leptospira interrogans serovar Lai str. 56601
MFENIKFIRKYDPAAKSYLEIVLCYPGLHALWFHKLAHFLYRMKLPLIPRMINTFSRFITGIDIHPGAKIANGIMIDHGHGVVIGETATIAKGCLIYQGVTLGGTGKESGKRHPSLLENVVVGAGAKILGNITIGKNVRVGAGSVVMRDVPHDSTVVGIPAKVVRSKMPIGEEGEHMLDHNEIPDPVAKVFSILLERIETLQKEVHSIDKSGIHSVKSNDNLEEILDEFIHGGGI

SEQ ID NO: 26458 - protein, 111 aa, Physcomitrella patens subsp. patens
MAAFLWHKVAAISGITAIVAGTFGSHGFKPTDPVYKTVWQTGNLYHLVHTSALLVAPYTKRPHLFGSLLTFGIAAFSGTLYVVALTENRKLNKPAPFGGMSFILAWGSLLF

SEQ ID NO: 26459 - protein, 256 aa, Escherichia coli
AEGFNFIGTGVSGGEEGALKGPSIMPGGQKEAYELVAPILTKIAAVAEDGEPCVTYIGSDGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQ

SEQ ID NO: 26460 - protein, 256 aa, Escherichia coli
AEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELTQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIVSYAQGFSQLRAASEEYNWDLNYGEIAKIFRAGCIIRAQFLQ

SEQ ID NO: 26461 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRAQYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 26462 - protein, 332 aa, Spiroplasma citri
MTKIAINGFGRIGRLAFRRLFDEKNVEIFAINDLTEAKTLATLLELDSAQGGWKRGKISSEEGFIIVDGKKINVYAQKDPTELPWGKLGIDVVVESTGFFADRAGASKHLTAGSKKVLISAPAKGTDVKTIVYNVNHKEIKKEDTIISGASCTTNCLAPMAKVLDEKFGIEKGYMTTVHAVTNDQRLLDLAHDDLRRARAAFSNIVPTKTGAAAAVALVLPQLEGRFDGMALRVPTITGSIVDLAVELKKTTTVEEINNAMKAAASETFGYNTQPIVSSDIIGETHGSIFDATLTKIIERDGKQLVKVYAWYDNEMSYVSQMVRTLLYFATV

SEQ ID NO: 26463 - protein, 468 aa, Escherichia coli
MLKQQIGVVGMAVMGRNLALNIESRGYTVSIYNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 26464 - protein, 183 aa, Gibberella moniliformis
IPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALSHDYLSPYHDPTDEPVAEEKFDWSFNDADLP

SEQ ID NO: 26465 - protein, 364 aa, Escherichia coli O157:H7 EDL933
  misc_feature (75)..(75): Xaa can be any naturally occurring amino acid
MKINRIVNEGFMKTMLAAYLPGNSTVDLREVAVPTPGINQVLIKMKSSGICGSDVHYIYHQHRATAAASDKPLYXGFINGHEPCGQIVAMGQGCRHFKEGDRVLVYHISGCGFCPNCRRGFPISCTGEGKAAYGWQRDGGHAEYLLAEEKDLILLPDALSYEDGAFISCGVGTAYEGILRGEVSGSDNVLVVGLGPVGMMGMMLAKGRGAKRIIGVDMLPERLAMAKQLGVMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYALMASGKCGKVVINFPD

SEQ ID NO: 26466 - protein, 420 aa, Bradyrhizobium japonicum USDA 110
MKIAVFGLGYVGMTTAACLARSGHEVIGVDVSDEKVAIVNAGNSPITEPGLDELVARAVRKGLLSATQNARGHLDNCALAIVCVGTPSAPDGSHNMSFIVEVSHQIAELVRPARSTKLTVVFRSTVRPGTIEELVLPIFENALKGRMDRVELVYNPEFLRESVAIEDFFNPPKIVIGTKDGERCAVLDELNATINAPTFYTTYRAAEITKFVDNTFHAVKVAFANEVGRVCEKLGISATTVHQIFVSDTKLNISPYYLRPGGAFGGSCLPKDVRALQYIASDVGAHTYLVDSLLRSNDAHKNFLFESCLKALPTGGHVLMLGLSFKEDSDDLRESPNIDLARKFLQSHIDLSIYDPQVEPSKLLGQNLGYAFSSLPALRKLLVSRSIAESGSFDLVVDTRGWAKTMALRTRRVINVNTLS

SEQ ID NO: 26467 - protein, 206 aa, Kineococcus radiotolerans SRS30216
MTDTPLATVRTAVDVPLRFADGYGTTARVHTFTGLVDGKEHLALGLGDWRQQSTPLVRPHSECLTGDVFGSERCDCGPQLREAVERIATTGGFLLYLRQEGRGIGLYAKLDAYALQDSGLDTYEANLALGRGEDERDYAVAAQMLDALGVERIALLSNNPDKAEQLVRHGIAVERRVPTGVHLSASNARYLRAKRDHTSHTLDLAG

SEQ ID NO: 26468 - protein, 338 aa, Pseudomonas syringae pv. tomato str. DC3000
MNLSKFKRYPLTFGPSPITPLKRLSEHLGGKVDLYAKREDCNSGLAFGGNKTRKLEYLVPEAIEGGYDTLVSIGGIQSNQTRQVAAVAAHLGMKCVLVQENWVNYSDALYDRVGNIEMSRIMGADVRLDSAGFDIGIRPSWEKAMADVVESGGKPFPIPAGCSEHPYGGLGFVRFADEVRQQEEELGFKFDYIVVCSVTGSTHAGMLVGFAADGRAQRVIGIDASAKPDKTREQVLRIAQNTAKLVDLGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 26469 - protein, 580 aa, Solibacter usitatus Ellin6076
MKLLLLAMAIACVISAQDDGPATPTRTSGGTPAAAPPPAREQARSMIVTQYGIVAASQFLASQAGAKMLEQGGNAIDAAIAANAVLGLTQPYVNGMGGDLFAIVYEAKTGKVYGLNSSGWTPKALTIDYLKSKGIDKIDRTGVHTITVPGCVAGWDALRKRFGTKPFSELLASAIFYAENGFPLPEFGARSWISQPLLKQPGYAQTYLPGGKRPQLGDVFKNPALGESLRQVAAKGRDGYYKGKMAENLVSFLREQGGAHTLQDFSEFEPEWVEPISTTYRGWDVFELPPNGQGVAALSMLNIMENFPLKDYGHNSAAALHVMIEAKKLAYADMARYVGDPRFGPVPVKEMLSKDLAKQRAGLISMEKASCKVLPSEIRQELDAHGHETIYMSAIDKEGNIVSLIQSNYAGYGTGMVAPGAGFSFHNRGAGFDMEPGKPNSLAGRKRPLHTIIPAFMRKGDVTVGFGIMGGWNQSQAHAQFVANVVDFGMNVQMALESARFTKGTFDGCDLQMESRVPEAVRQELARRGHVITPVGAFATAMGNGEAVMRDAKRGVNFGASDPRTDGAAIPQQPNVGTIK

SEQ ID NO: 26470 - protein, 148 aa, Zea mays
AEPRVRKTIEIDDERKTFIFYEKRMAQGVGADSLGDEFKGYVLRITGGNDKQGFPLKQGVLVPHRVKLLLSKGHSCYRPLRTGERKRKSVRGCIVCPDVRALHLVVVKQGENDIPGLTDEVLPKRLGPKRATKIPSFFNLDKSDDLRK

SEQ ID NO: 26471 - protein, 314 aa, Methanopyrus kandleri AV19
MFDPKKFVEEAIEELRREIGDRKAIIAVSGGVDSTTAAVLTHRAIGSHLVCVFVDHGFMRKGEPERIRELLEEELGLNLRFVEAAEEFFEALRGVTDPEEKRKIIGEKFIEVFERIAEEEEAEVLVQGTIAPDIIESERGIKSHHNVGGLPEKLNLDVVEPLRDLYKDEVREVARYLGIPDEIVERMPFPGPGLAVRVLGEVTPEKVEIVREANAIVEEEVEKAVEEGKMSKPWQAFAALLDCKATGVKGDERDYGWVIAVRIVESIDAMIADVPEVPWEVLRNIQDRITSEVPEVTRVLFDITPKPPATIEFE

SEQ ID NO: 26472 - protein, 242 aa, Methanopyrus kandleri AV19
MAFVVIPSVDVVEGKCVQLVEGDPERRTFESDDPVETAHQWSEFFPWIHVVDVDAARGEGDNSDIIGRICEEVDAKVQVGGGIRSAERAEELIELGADRLIVGTVAFTDKDDFSKIVDVCHDHGIEVFVALDVNENHEVLVSGWKEDAGVTLEDAIERFNEVADGYLTTAVHVEGKEMGIDEKVVEKSTGATDLPVLYAGGIASIKDVKRAKEAGAYGVVIGTALYHGDIDPVALLDLMEED

SEQ ID NO: 26473 - protein, 369 aa, Acinetobacter sp. ADP1
MKSRAAVAFGPGQPLQIVEVDVEPPKAGEVLIKVTHSGVCHTDAFTLSGDDPEGVFPAILGHEGAGIVIEVGEGVTSVQPGDHVIPLYTAECGECLFCKSNKTNLCVSVRATQGKGVMPDGTTRFSYNGEPIYHYMGCSTFSEYTVVAEVSLAKINPEANHEQVCLLGCGVTTGIGAVHNTAKVQEGDSVAVFGLGGIGLAVVQGARQAKAGRIIVVDMNPEKFELAKEFGATDFLNPKDYDKPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLDEINHAFDLMHEGKSIRSVIHF

SEQ ID NO: 26474 - protein, 214 aa, Debaryomyces hansenii CBS767
MEDTDRTISRLWRSFKTVKEMVRDRGYYITQEEIDMSLAEFRSRICDSMNVPQRKLMCFQANPTAESLEKFPDLGSLWVEFCDEASVGIKTMRNFCIHISEKNFSTGIFIYQSSITPSANKLIPTVSPASIETFQEGDLVVNITHHDLVPKHIKLARDEKKELLERYRLKESQLPRIQREDPVGRYLGLKRGEVVKIIRRSETSGRYASYRICL

SEQ ID NO: 26475 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 26476 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGKTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 26477 - protein, 584 aa, Candida albicans SC5314
MTTTSSSTNESIRPKNNHTTISTTGVSTTLDQTTTTRFRNNYDDNNNNSVISKDSSTFAYVVNRSKSVLKKYGSFVGPGMLISVAYMDPGNYATGITAGASNEYSLLFIVFLSNVIAIFLQSLCIKLGSVTGYDLARCCREYLPKQLNWVLWFLAECAIIATDVAEVIGSAIALNILLKIPLPAGVVITIIDVLFVLMAYRADTSSMKFVKIFEYAVGALVMVVVVCFAVELSQIHASARDIFRGFVPSKQMFDGNGMTIATSIIGSTVMIHSLFLGSGLVQPRLRDFDVKHGYVNLDDILNKNDQPQFPVIESSTTTPSEKKDDAKNNVKVSMYEKEADYFYHYYKPSYQSIKYSLKYSIVELTITLITLALFVNSAILIVSGSTLYGTEEAIDADLYTIHDLLSRSLAPAVGTIFMVALLASGQSAGIVCTIAGQIVSEGHINWTLKPWLRRLVTRSISIIPCLIISVCIGRNGLGIALNISQVVISILLPPLTAPLIYFTCSKKIMKVELNENDEAIGVTGQEEEVEDEESNDQDTNGSRKKYKYMTNNWITSIVAVIIWFFVSTLNVYAIYEMAKNGVSG

SEQ ID NO: 26478 - protein, 204 aa, Fagus sylvatica
MASSSPSSNYIQEASGGHIIPTDQNVLQKHVAFFDRNQDGIVYPSETFKGFRAIGCGIFFSAISAIFINFGLSQKTRPGKFPSLLFPIEVKNIQKAKHGSDSGVYDTEGRFVPSKFEEIFSKHALSYPSALTSDELMKMLKENRVPKDYRGWLASWAEWKTLYILCKDKKWVTTERNKLKLLMMEAWLKEMEKERSSAKKKAVV

SEQ ID NO: 26479 - protein, 600 aa, Physcomitrella patens subsp. patens
MEATLSCENLTHTVGCVGKARLGSVRGGCKKAAFGAYNVSWKARISVTRDLGVGSVSSRGVVGKVANGELRVRAASGNGVAPKEFDYDVVIIGAGVGGHGAALHAVEKGLKTAIIEGDVVGGTCVNRGCVPSKALLAVSGRMRELQDEHHLKALGIQVGAANYDRQSVADHANNLATKIRGNLTNSMKALGVDILTGFGSVAAPQIVKYGRIGFSDKTITARNIIIATGSVPFVPPGIEVDGKTVFTSDHALKLEWIPDWIAIVGSGYIGLEFSDVYTALGSEVTFVEALDGLMPGFDPEIGKLAQRILINPRKIDYHVGVLAKKVTPMFYTGLTILTLGAPITPAKDGKPVQIELVDPKTKETKDILEVDAALIATGRSPFTKGLGLEKINVITQRGFVPVDERMQVLDSEGKPVPHLYCIGDANGKMMLAHAASAQGISVIEQIAGRDNILNHNSVPAACFTHPEISMVGLTEPQARALGEKEGFKVSVAKTSFKANTKALAENEGDGLAKLIYRPDSGEILGVHILGLHAADLIHEASNAIAMGNTIKDIKFAVHAHPTLSEVLDELFKSAKLDEHHAAVETPNQRQKWHTIASVRL

SEQ ID NO: 26480 - protein, 283 aa, Physcomitrella patens subsp. patens
MAEHLASIFGTEKDRVNCPFYFKIGVCRHGDRCSRLHNRPTASQTLLLANMYQSPDAGFHGGVDQHGNIQQSDPRKLQEHFEDFYEDIFEELSKYGEIENLNVCDNLADHMIGNVYVKFREEEHAAAALNALSGRFYAGRPIILDFSPVTDFREATCRQYEENTCNRGGYCNFMHLKKISRELRRKLFGNYRRRSRSRSHSPYGRGEARGPPSPRRYGDRDFYDSRRGGGRGGGGRGRGYGRRRDRSRSRTPTRRGRSPAAREGSAERRAKIDQWNREREERQ

SEQ ID NO: 26481 - protein, 134 aa, Physcomitrella patens subsp. patens
MLLGYVYPAYACFKVVERDRPDLEHLQFWCQYWIIIAALTVFERLGDVLVSWVPMYSEAKLAFIVYLWHPNTLGTKYVYSTFLRPIVARHEAEIDHHLHELTTRGGDLAYFWWQKCSNYAQSRIYELFSYVASQ

SEQ ID NO: 26482 - protein, 346 aa, Burkholderia vietnamiensis G4
MKALVYHGPGRMALEQRPKPELQSPTDAIVRVTRTTICGTDLHILKGDVPTCEPGRVLGHEGVGVVEQVGAAVDALKPGDRVLISCISSCGRCEYCRRGLYSHCTTGGWILGNRIDGTQAEYVRIPHAQTSLYPIPAGADEDALVMLSDILPTGFECGVLNGKVQPGCSVAIVGAGPIGLAALLTAQFYSPGQIIMIDPDSNRLDIARRFGATDCVDGRSGDAAADVMKLTDGIGVDCAIEAVGIPATFELCTSIVAPGGVVANVGVHGVKADLHLEKLWDRNIAITTRLVDTVSTPMLLKTVRAGRLDPAQLITHRFALDDVEGAYDTFGRAAQTHALKVIIEVS

SEQ ID NO: 26483 - protein, 266 aa, Xanthomonas oryzae pv. oryzae KACC10331
MGYSVACLQLRNLRLMRRKIVAGNWKLHGSRAFATELVAKLAAHMPLEGIDVVILPPLPYLGDLIEDFEAHHLSFGAQDVSSNEKGAYTGEVSASMLVDVGAGYGLVGHSERRQYHQESSELVARKFAAAIHAGLTPVLCVGESLEQREAGQTEAILRAQLEPVLALVGSAGFAGAVLAYEPIWAIGTGCTATPEQAQAVHAFLRGEVAKADARIADSLPILYGGSVKPDNAGELFAQPDVDGGLVGGASLVAEDFLAIARAAAAC

SEQ ID NO: 26484 - protein, 841 aa, Bradyrhizobium japonicum USDA 110
MPSTPIRALARCGPGRLNEIETWQRNISSSSAILYRTSREGVQIEGSGNRFAAHGGKMKTAILVGTRPEIIKMAPVIRECRKRKIDYFIIHSKQHYSEKLDAIFFSELDLPAPKYNLNVGSGGHANQTGRILIELEPILVSEQPGILLVQGDTNTVVAGALAAHKLHIKVGHIEAGLRSFDQTMPEESNRIIADHISDYLFAVTDLQVDQLKREGLPDSKIFKVGNTIVDALLSHRSQAEKTSQILRVLNLQEKGYYLLTSHRAANVDDPNALIEIIRLVARIPGKVYWPIHYRTQKVLKEAKIDLPPNLIWTEPVGYSDFVKLLSNCIAVITDSGGVQEEACILGVPCVTIRDRTERPETVDVGANVLVHRNAEAMLEALNRPIASWENPFGDGHTAERILDIVTEQEVLPVLQTLDTVCVVGLGYMGLPTSLLLANAGVKVAGVDLNEKKVNEISSGHCPFEEKDIPELLAATLKTGNFKALTKPVAADVFVVAVPTPHESKKCDLSYVISAVNSLLPVLNDGNLLIIESTIKPNTCQDIVLPILKSKNLNVEVAHCPERALPGNTLHEIVHNDRIIGATSPEAAQRAAKLYSVFAKGTIHRTNLVTAECVKLMENTFRDVNIALANEFSLIADKFGFSISAAIQLANRHPRVNILQPGIGVGGHCIAIDPWFLTEDVDGDLTLIRTARELNDAMPRYTAERIQNKIAPSVRKIGILGVSYKPDVDDARESPALEIARLLSRKYEVRCHDPFVKDRDLKLFPIDKVDGWADVLVILSNHKVYASQRFESPLLSFGKLIDAGAPRWLRAPGLADTDYFPAESRHADHGQYPAAKDVQESS

SEQ ID NO: 26485 - protein, 314 aa, Mycobacterium smegmatis str. MC2 155
MPRKPIDVTLPDLSGRRAVVTGASDGIGLGIAARLAAAGADVILPVRNEIKGKAAIAAVRQTNAAAKVSLRELDLSSLASVAALGKSLLEEAQPIHLLINNAGVMTPPERRTTTDGFESQFGTNHLGHFALVAHLLPLLRAGGARVTSQVSVAANQHAINWDDLNWERSYDGAKAYSQSKIAFGLFGLELDRRSHAHGWGITSNLSHPGLAPTNLLAARPDTGRAQDDWKLRLIRTLSSRGILFGTVHTAQLPALYAAASPHAKRGGFYGPRGPGHLGGPPGEQRLYSRLRNNDEAQRIWEISEKLTDMSFPTA

SEQ ID NO: 26486 - protein, 457 aa, Mycobacterium smegmatis str. MC2 155
MSRNPGMLTQDELVQLVTDGEIDTVIVAFCDMQGRLTGKRVSARLFVEEVAANGCECCNYLLAVDVDMNTVDGYAVSSWETGYGDMVMTPDFSTLRRIPWLPGTAMVMADLSWLDGNPVAVAPRSILNHQIDRLAERGLVPFVGTELEFMVFDDSFRQAWSSGYHNLTPATDYNVDYAIHASTRMEPLLRDIRRGMESAGMYCEGVKGECNLGQQEIAFRYDHARVTCDNHTIYRNGAKEIADQHGKSLTFMAKYDEREGNSCHIHISLRGAGENGDAVFADESDPHGMSPLFRSFIAGILATLRELTLFYAPNINSYKRFVDGSFAPTAVAWGFDNRTCALRVVGHGHGMRVECRAPGGDVNQYLAVSALIAGGLYGIERDLELPEPMAGNAYTSGAERLPTTLAEAADLFAKSEVARAAFGDDVVEHYLNYARVEMAAFNAAVTDWERVRGFERL

SEQ ID NO: 26487 - protein, 909 aa, Arabidopsis thaliana
MMFAYLPPDLESEILSRVPATFLKELQTTCKRWYALFRDPIFVKKNLGKAATHVIFNNLGDYSVTEMNTLVHSINLRGIQNSFDPSIGVERKLYELNDPEHDKILGIISHCDGLLLCATKDKTRLVVWNPCTGQTRWIQIKNVFKNNPQLILLVIKFKIYEFNSDSWRILDDISPVCFIRSNGVNLKGNAYFVASDKESKFILKFDFTTERFLRLSFPSQNDDQIAVLSVVRQEKLALLQQRFDTSSIKMNIWVTKTKIDADKDLSWSNFLVVDFGKVTLTSEPLSFLVDEENKMVVCSSKIRHIERKTIIYFAKEGIQVHQEIAQKPKDMRKKLKLDDSLVVDEEKEAHNAMAKWFIAADVNPKTINTRSFAKFMSFLGDPKYPPSVSKVENEVFEIYEECKEKAKNFFKSFQGQLNLSYEWMLLGNGWGARDHIRGPVLHEDFVCLTAHFVDDNWKMKKRILAYTNTTDQEIPMDDGYVYPFRNAVQDFEIENKVSTLLLPNSEDFDEETLDPFRKWIEEIGNNQFNPRVSLVYCCSDLFRLMVDDVLSELSSSLLEDVRMLVGWGRCSATTWNVSLFHLQQAVVLKSEDAFSKDEIYDDYDKPSDEDWIKIQTFCKLTDCIYKVAKELFEGEYSTSNVYFHLLAELKVMLNQELPSADSDYFLCKAKQILERFDKYWNNMFLVLATASVLDPRFKMNYLEFYCSKKEVNVEGSKAATVLDYLRNLYARYAASDICQKPICSVASIDSEDEEEEEDEEYDEDEYDDDEGGEEEEEEKDGNDEEGKEEEHKVKEEKKPDAYEKFVLFQEYIKFEGSPIELQESELDSYLKEPVMKWNKDFKALEWWKEESQKYPILSRVARDILSIPISRAESYDAYVVDRREPPEFVVSMKSKVANAMMCSKKWLRV

SEQ ID NO: 26488 - protein, 316 aa, Triticum aestivum
  misc_feature (152)..(152): Xaa can be any naturally occurring amino acid
  misc_feature (288)..(288): Xaa can be any naturally occurring amino acid
MDPDSEVAFDFPPYLCQYKSGRVHRPGGDAIAPAGTDPLTGVVSKDIHAGPARARVYLPPDAAAAPGKLPVVVYFHGGGFVVGSPARPSTHAYLNDLVARSAAVGVSVYYRLAPEHPLPAAYDDGWAAVRWVLTGADPWLLDHADLSRVFLXGCSAGANIAHNMAVRAAAPGAVPEGAAVRGLMAVHPYFTGKEPVGAEAAFGPDVRDFMDRTWRFVFPGSLGLDDPNVNPFVTDEARAAVAGIPCERVLVCVAEDDVLLKERGLWYARELRASGYAGEIEMFESKGXVGHAFHFDQLGSGEGVRLQERLVEFIKK

SEQ ID NO: 26489 - protein, 391 aa, Ustilago maydis 521
MSAPVAPPQAAVYPPGVQSPPPSGAERVGPGAPSPFVDEKRTAYPSGLTPPISSQPSTSMFGFFQPIVTPVSNALARIQDIRTRLELSNPGTVEHLQREVKGVHTTNFMFDGARADLTKAISINPIFQVTHAFSMGSQAAPSSYNFGAVYGDNKNFFQAGLDDGLNVTMRANRGWVAGHTTKVQAQLTATPGQSFVQIEHDYQGTDHSANFKALNPSPTDLTGIYIVNYLQSLTRNFAFGVETVYQRPSADMEEASTGYIAKLTGDKKDWIATAQVQPQGVAQCTYYHKLSEQVDVAADLQMITMAQKREAAATLGARYNFRMATLRAQIDSAGKLSSVYETRLSPAFGLTFAGEIDHLQGAAKFGFGVSIESGNEMDPNAPPPTPPSVPM

SEQ ID NO: 26490 - protein, 239 aa, Chlamydia muridarum Nigg
MSKQVAHSFSSEDFSFIKQKLAREAVALVEPGMRVGLGSGSTAREFILALGERVRNERLAITAVASSRISHLLAQALGIPFLDPALSQELDLVVDGADEVDANLRMIKGGGGALFREKILLQSGKRNIILVDERKLVSVLGTFPLPIEISPFGCSSVEKVLNQQGYIGDWRKTSHGERFITDNGNYIYDVSSPDSYPHPEEDLIRLLQIRGIIDVGFVIAKAEVWVGYADGTVVRKEIT

SEQ ID NO: 26491 - protein, 402 aa, Methanopyrus kandleri AV19
MGVQVGIVGKPNVGKSTFFAAATLSPVETADYPFTTVDPNQGVAHVRTECPCKAFGVECQPRNSSCIDGNRFVPVELIDVAGLVPGAHEGRGLGNKFLDDLRQASVLIHVVDVSGSTDEEGRPCDPGTREPAEDVRFLERELDEWIAGILRRDWDRTAKRASLEKIPAAEVLRERLAGIGVSASDVESAMERAEVPSDLTKWSDEDIRRFAREVRRVNKPMVIAANKIDVECAEENLKRLEEEVEYPVVPTCAEAELALRRAADQGLIRYLPGDSDFEILQEEKLSDEQLQALEFIREKVLKRWGSTGVQEALNRAVFDVAKMIVVYPVENENKLSDSEGRVLPDALLLPEGTMVRELAYNIHTEIGESFNRAILVKPDGSREVVGEDHELEHGDVVKIQTS

SEQ ID NO: 26492 - protein, 684 aa, Mycobacterium bovis AF2122/97
MTTTSDQNAAAPPRFDGLRALFINATLKRSPELSHTDGLIERSSGIMREHGVQVDTLRAVDHDIATGVWPDMTEHGWATDEWPALYRRVLDAHILVLCGPIWLGDNSSVMKRVIERLYACSSLLNEDGQYAYYGRAGGCLITGNEDGVKHCAMNVLYSLQHLGYTIPPQADAGWIGEAGPGPSYLDPGSGGPENDFTNRNTTFMTFNLMHIAQMLRAPAASRPTAINAPSGTPAAGRTSPTPTTDSQRRSRVARWLVAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 26493 - protein, 202 aa, Ustilago maydis 521
MGKKKQVRKFGQVKRMLNPKDDRLKANSTVQTAAKKASSSSSTITPDGTVVRHISTPASSMFFEHNTQLGPPYRVLVDTNFINFALQNKIELVQGMMDCLYAKSIPCITSCVISELEKLGPKYRIALRVARDPRFERLECSHKGTYADDCIIERITSHKCYIVATCDRELRRRVRKVPGIPLMYIASRQFRIERLPDQGMAQ

SEQ ID NO: 26494 - protein, 256 aa, Pseudomonas aeruginosa UCBPP-PA14
MHPYFSLAGRVALVTGGSRGIGQMIAQGLLEAGARVFICARDAEACADTATHLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYAYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 26495 - protein, 417 aa, Cochliobolus heterostrophus
MPLLGMPAHAFQVFNQEFIVDERYNVTKELGQGAYGIVCAATNNQTGEGVAIKKVTNVFSKKILAKRALREIKLLQHFRGHRNITCLYDMDIPRPDNFNECYLYEELMECDLAAIIRSGQPLTDAHFQSFIYQILCGLKYIHSANVLHRDLKPGNLLVNADCELKICDFGLARGFSMDPEENAGYMTEYVATRWYRAPEIMLSFQSYTKAIDVWSVGCILAELLGGKPFFKGRDYVDQLNQILHYLGTPNEETLSRIGSPRAQDYVRNLPYMQKMSFQSLFKNANPDALDLLDRMLAFDPSSRISVEEALEHRYLQIWHDASDEPSCPTTFDFQFEVVEEIPEMKKMILDEVSRFRQMVRVQPGAGAGAAQAPQVPIPNNYDRTGYEEPRPQEAFNQGGWNGSDLERDLQGLDGRMR

SEQ ID NO: 26496 - protein, 335 aa, Debaryomyces hansenii CBS767
MTYSTITVIGSLNYDLVTYTKAVPEGGETYQANSFENHIGGKGLNEAIATSRLSGKQSKCHVRMIGNVGNDSFGKELKQALVNSGVDTKYVKTLEKQSSGVAVIIVEEESGENRILITAGANGELCPTKEEYETYFPKDVDGAQFVILQNEYPDTVKSIEWLKANRQKINIAYNPSPFKPEFISQQFWSKIDFLIINEGEALSVASKLLTDEENAKFNKTIKLDKVEGFSDLADKLQEMINPDNVSTVIITMGSKGSIFTSRNAKSTFVKSHKVENVVDTTGAGDTFFGGVVLQLANGSSIEKAVEFATKASSLVIQKKGAAESIPTLEEINKYI

SEQ ID NO: 26497 - protein, 570 aa, Oryza sativa Japonica Group
MAASSRHGPFINWSDGLFLFLSSSSSRNRFLRVFLPFPDPSTMMAGLEVATTAVTGGDASLVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFELVLNVMLRAVTARRHAGDETRRFQEIVEETFAASGSPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 26498 - protein, 267 aa, Methanopyrus kandleri AV19
MDLDLLARIKRHEVLAAIRAGERIDGRDFEEFRPIEVRAGVISKANGSALVRLGNTQLVVGVKLEVGRPYPDSPNEGALAVNAELVPLADPSFEPGPPDENAIELSRVVDRGIRESEMIDLEELCIEEGEHCWVTFVDIHVLDHDGNLFDASMIGSVSALSITEVPKAEVVDDEVEVMEEDTEPLAINDFPISVTIAKVGEYLLVDPCLEEEVIMDTRLTVTVTESGEVCAVQKGELGDFPEHLLEDAIDLATKKAEEVRRTVKAQL

SEQ ID NO: 26499 - protein, 239 aa, Methanopyrus kandleri AV19
MEERPERLISEDGLRLDGRKPDEMRPLKIQAGVLKRADGSAYLELGANKIVAAVYGPRELHPRHKQKPDRAVVRFRYNMAPFSVDERKRPGPDRRSIEISKLSKEALEPAIFTEYYPRTAIDIFVEVLQADAGTRCAGISAASVALADAGIEMRDLVAACAAGKVEGKVVLDPMYYEDGYGEADVPLAMMPKEGKITLLQMDGDMTPGEFKQAVKLAKKGCKIVYKEQRRALKEKYGGD

SEQ ID NO: 26500 - protein, 174 aa, Candida albicans SC5314
MSAIIRQAIRPALRSVSSKRIAVTALRYNSTAAEPAKAPVDAKITTIVDQISTLTLLETSQLINELKERLNISDISLPVGGAQAAPVAQAAPAEEEVKEEVEEKTIFSIKLESFDAKSKPKIIKEVKGMLGLSLVESKKFVESAPKVLKENVAKEDAEKIKATLEGLGAKVSLE

SEQ ID NO: 26501 - protein, 334 aa, Acinetobacter sp. ADP1
MILVTGGLGFLGSHIALSLLAQGQEVILVDNLANASLQTLERLEYISGMYIPFVKVDVRNTPALNKVFEQYSIDAVIHTASFKALEESKLKPLEYYNDNVSCIMSLLRSMQRTGVRKLVHLSSLMVYGKSSSKLTEDEPFDTVYPNPYIKSQQMIEEIIRDTFKTDHEWKIAILRLSNIAGAFEHGVLGEMITQLPKNIIPLAMQVAAMQRDYLELQRQADTTDQTVERSFLHVLDVCEAVFASLYWLNQQDHCCESFNIAHNEVTSIQQLLEVISQVTQTQINTHDAMYPTEELAQVGANIDKAKQVLNWQPKRTLQQMIEHQWQFYQNTLKG

SEQ ID NO: 26502 - protein, 555 aa, Bacteroides fragilis NCTC 9343
MGLFIKKPFEALLAEANVSGSKSLKRVLGPWSLVALGVGVIIGAGLFSITGTVAAGYTGPAITLSFAIAALGCCFAGLCYAEFASMIPVAGSAYTYSYATMGELIAWIIGWDLVLEYTVAATTVSISWSRYLVVFLEGLDIHLPQALTACPWDGGIVNIPAFLIVVLMSIFLIRGTEGSSIFNGIVVFLKVSVIAIFVVLGWKYINADNYTPYIPANTGTLGEYGLSGVLRGAAIVFFAFLGFDAVSTAAQETKNPKRNMPIGILVSLLVCTVLYMLFAHVMTGVAHYTEFSGQQGIAPVAIAIEHMGHADATGIIHPDYPWLNRAIVLAILFGYCSVIMVTLLGQSRVFLSMSHDGLLPPFFSHINEKFRTPARSNLLFMLIVGLLAAFVPARLAGEMTSIGTLMAFTLVCAAVLVVRKTMPNIPRSFKTPFVPLVPILGILTCLCMMLFLPADTWIRLVLWMLIGLDIYVGYGMKHSKLEHGVKNRRGQSALNMIGIALSLLCVITGLWHQQTVGWNESKALLIISFVFAFTHCAYYMMRIWKGTTKQTNDNG

SEQ ID NO: 26503 - protein, 182 aa, Vibrio sp. Ex25
MSSIRSYKGIKPELGERVYVDPTSVLVGDIRIGDDSSIWPLVAARGDVNHIHIGDRTNIQDGSVLHVTHKNAENPNGYPLIIGNDVTIGHKVMLHGCEIHDRVLVGMGAIVLDAVVIESEVMIGAGSLVPPGKVLESGYLYVGSPVKQARPLSEKERAFLQKSANNYVQNKNDYLHEVEDLN

SEQ ID NO: 26504 - protein, 606 aa, Physcomitrella patens subsp. patens
MNSTLRLVDVSAPLGCRQCAYFHRNVGAGEASCRSDGSISASFCGLSWRQQRGLNAWTLRSSCARVVKRRWRDRQTCGIHCELKNVAEQECLLDNESILANRKVLLHGGQNGSSDGAVAESNLEREAWDLLRDAVVTYCGEPVGTIAANDPTDPHPLNYDQVFIRDFIPSAIAFLLKGETEIVRNFLLHTLQLQSWEKTVDCYCPGQGLMPASFKVRTVYLDGDETKGTEEILDPDFGEAAIGRVAPVDSGLWWIILLRAYGKCTGDISLQERVDVQTGIKMILKVCLADGFDMFPTLLVTDGSCMIDRRMGIHGHPLEIQALFYQALRCAREILVPEDGAGDLIRQINARLAALSFHIQEYYWLDISKVNEIYRYKTEEYSTEAVNKFNIYPEQVSQWLLDWMPETGGYFIGNLQPAHMDFRWFALGNMWSICSGLATENQAEDILKLVESKWDDLIATMPMKICFPALTEDEWRIITGADPKNTAWSYHNGGSWPTLLWQFTTACIKMNRPDLAERAIEIAEKRLSRDRWPEYYDTKKGRFIGKQARLYQTWSIAGYLTSKLLSKNPDAANWLTCEEDDHYAILLEANPNLKRKFKASPNIFVV

SEQ ID NO: 26505 - protein, 355 aa, Bradyrhizobium japonicum USDA 110
MSEMILVTGGAGYIGSHVCIALLDAGFDVVVVDNLSNSNKASLERVQSICGRSLVFRHADIRNEELIYDMLRTCGVTAVIHLAGLKAVGDSNVRPMMYYENNVLGTMRLLSAMERANVTTLVFSSSATVYGMPQYLPLDEKHPLGPTNPYGRTKLVIEEMLKDLCRSHDGWRIGNLRYFNPVGAHESGLVGEDPLGVPSNLVPFVAQVAIGRREKLRIWGNDYDTPDGTGIRDFIHVVDLASGHLSALRQLRQPGLITVNLGTGNGSSVLDIVRTFESVSGRSIPYEIGERRAGDVAACYADPTVAKDALGWASTRSLEQMCADHWRWQLQNPNGYQGGELPRARERSRHLRRHA

SEQ ID NO: 26506 - protein, 366 aa, Spiroplasma citri
MALKMGIVGLPNVGKSTLFNSITNSQVEAANYPFATINPNVGTVAVPDERMDTLIALCAPDKAIHSTFEFYDIAGLIAGASKGEGLGNAFLQNIRETDAISMVIRCFDNKDITHVEGTIDPIRDIEIINLELIISDQEQIKKRIDKIGKKAQTFKQKEDVFEYELLLKLATALEENKLLKDLTLSDDELRVVKNFNLLTIKPFIYVANVAESDLNQPDNFYVKTVKEYAQQKEIEVVVICAKTEEELSALEPDDRKLLMTDYGIKEAGLSQLIKKSYALLGLQTFFTAGKQEVRAWTFKKGATAPMCAGIIHSDFERGFIRAEVYSYDDLVKYGSEKSVKENGRLRSEGKTYVMQDGDICFFKFNV

SEQ ID NO: 26507 - protein, 152 aa, Spiroplasma citri
MRVGNSYDLHNLKMGTGFYLGGILIPCQYQVEAVSDGDILLHTISEAIIGALGLGDLGEWFDETNKKINSQLILKKALTLMAEQNYQISNIDTTIIIDEPRLQKHKKAIKTNLQKLLQISAEKINLKATTTEQNFPNIIQSYTTLLLLKEND

SEQ ID NO: 26508 - protein, 254 aa, Brassica napus
STHASADAWADAWADAWAESMIDLLMEIYKDQPFASKFTIENVKGVILNIVVAGTDTAAAAVVWGMTYLMKYPQVMKKAQAEVREYAREKGSTFITEDDVKNLPYFRALVKETLRIEPVIPLLIPRACIQDTKIAGYDIPAGTTVNVNAWAVSRDEKEWGPNPDEFKPERFLEKDVDFKGTDYEFIPFGSGRRMCPGMRLGAAMLEVPFANLLLNFNFKLPNGIKPEEINMDVMTGLAMHKSDHLKLVPEKVSK

SEQ ID NO: 26509 - protein, 364 aa, Candida tropicalis
MTANPSLVLNKVDDISFEEYEAPKLESPRDVIVEVKKTGICGSDIHYYAHGSIGPFILRKPMVLGHESAGVVSAVGSEVTNLKVGDRVAIEPGVPSRFSDETKSGHYHLCPHMSFAATPPVNPDEPNPQGTLCKYYRVPCDFLFKLPDHVSLELGAMVEPLTVGVHGCKLADLKFGEDVVVFGAGPVGLLTAAVARTIGAKRVMVVDIFDNKLKMAKDMGAATHIFNSKTGGDYQDLIKSFDGVQPSVVLECSGAQPCIYMGVKILKAGGRFVQIGNAGGDVNFPIADFSTRELALYGSFRYGYGDYQTSIDILDRNYVNGKDKAPINFELLITHRFKFKDAIKAYDLVRAGNGAVKCLIDGPE

SEQ ID NO: 26510 - protein, 395 aa, Arabidopsis thaliana
MTTMGDLPGDLVEEILSRVPLTSLRAIRSTCQKWNSLSKSQICGRKATAAENKFLGFMMKDSRVCSMKFDLQGIRNDDGELVEPSIKQVSKLDQIEVSQVFHCDGLVLCIIKDNTGLLVWNPYLGQTRWIHPRNNYQIEDRYALGYDNNRNHKILRIFDLYPSSNRVFGYEVYDFSSNSWKVLDVIPEWDIQSHFRGASLKGNAYFPAQKKETVGGIKTINIEDVLLCFDFTRERFGPPLPLPFHSYNADFFVSLACVREEQLAVLYQRWGAFETIEICVTNKIDPNTVSWSKFLITSTGFPVDTFSGSFFIDEEKKVAVVFDLDRYKPTETCRYQIVYIIGQDEYFKSVNMGVAPNIAKNSYQAYCVPLVCSSSYVPSLVQLQINKPGKRKESN

SEQ ID NO: 26511 - protein, 64 aa, Populus tomentosa
MITAADFYHVMTAMVPLYVAMILAYGSVKWWKIFTPDQCSGINRFVALFAVPLLSFHFIAANNP

SEQ ID NO: 26512 - protein, 425 aa, Cryptococcus neoformans var. neoformans JEC21
MCLRVFRAMHIIHIIQHVALFYPSSNTMTIATPELYNHKAIPQPWRETPLVQSAALSRLAGCRIFLKLDNLQPSGSFKSRGIGNLVRRSIQRSPPNAPLHFYSSSGGNAGLACVTAASSLGYPSTVVVPMTTTPMMISKLFTAGASKVIQEGASLYQADAYLKEHILPQDQWGVYIPPFDHEDIWQGAESVAEEVVRQMGGERPDGIVCSVGGGGLMIGICQGLEKVGGAKREGAVNGKGGEEVYQTEVIAVETLGADSLNQAIKAQQLITLPSITSIATSLGCARVASRALDIALGLSPSLPPPISLPPSPLPSPSSSPAETSSSLPDPTITSDKSRIPMKNSKVVPTLVTDKEAIQACVQFLDDERILVEPACGATLALVYTGRLREVMKGRLTEDSKVVLVVCGGSNISLEVLQRYKMEYGL

SEQ ID NO: 26513 - protein, 462 aa, Legionella pneumophila str. Lens
MELMAEFLTLHQQHKNNPYPSLSERKKLLIAIKKILQTEAYTLAEAINKDFTHRPVEETLFLEVFPTIKAINFCLKNMKKWMRKRRRNVSWLFMPAQAYVIPQPLGVVGILVPWNYPVYLALVPAIYALASGNRVMIKMSELSPHTGDTLQKLVHASGINHSISVINGDIELSKHFASLPFGHLMFTGSTNVGKLVMKAASNNLTPVTLELGGKSPAIISPTMNPAYFKRLFMGKLLNAAQTCIAPDYVLIPEGWEERVETEFKKFINTFYPDLMSNEQYSSIISESHKKRLIDLVEDARSKGARVVEFGHLIPNSSKLPVFLLFDITNDMLVMKEEIFGPVLPVLTYNSIIDAVDFINSFPNPLALYYFGEDKNEIKIIQTTTLSGALTINETLMHIAIDDLPFGGVGHSGMGHYHGKEGFDTFSKLKPVLVQRFISTVSWLYPPYGAFMRMFLAWVGGIK

SEQ ID NO: 26514 - protein, 263 aa, Streptococcus suis
MQVAYLGPRGSFTHQVAQQVFPTADLQAFETITEVIKAYETGEVTYSVIPVENSIEGSVHETIDYLFHQAEIHAVAEIVQPIAQQLLATSADKAVEVIYSHPQAIAQGKKYIQEHFPQARIEITVSTAYAARFVAEHPEQPFAAIAPQAAAVEYGLEVIAQDIQEISENFTRFWILGDKAPSIALEQVAKKVSLALTLPDNLPGALYKAMSVFSWRGISLTKIESRPLKPALGEYFFILDLDNQCVELLTYSPKEFTSSRYNL

SEQ ID NO: 26515 - protein, 215 aa, Xanthomonas oryzae pv. oryzae KACC10331
MSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 26516 - protein, 355 aa, Bacillus licheniformis ATCC 14580
MELMWKGLIHQYKEYLPVTDKTPELTLNEGNTPLIYLQNLSKKLGIELYVKTEGVNPTGSFKDRGMVMAVAKAKEEGNDTIMCASTGNTSAAAAAYAARANMKCIVIIPDGKIAFGKLAQAVMYGAEIIAIDGNFDDALKMVRSICEKEPIALVNSVNPYRIEGQKTASFEICEQLGEAPDILAIPVGNAGNITAYWKGFKEYHEKNGTGLPVMKGFQAEGAAPIVKNKVIEKPETVATAIRIGNPASWDKAVNAAKESNGKIDAVSDEEILHAYQLLAREEGVFAEPGSCASIAGVLKQLQTKEIQPGAKVVAVLTGNGLKDPNTAVDVSQIKPVTLPTDEEAILEHLKGAARV

SEQ ID NO: 26517 - protein, 297 aa, Mycoplasma genitalium G37
MVCEHFADGETYIRFDESVRNKDIYIFQSTCPNVNDSLMELLIAIDALKRGSAKSITAILPYYGYARQDRKTKGREPITSKLIADMLTKAGANRVVLTDIHSDQTQGFFDIPVDSLRTYHIFLFRVIELLGKKDLVVVSPDYGGVKRARLIANTLELPLAIIDKRRPSHNVAESINVLGEVKNKNCLIVDDMIDTGGTVIAAAKLLQKEQAKKVCVMATHGLFNNDAEQKFMEAFDQKLIDFLFVSNSIPQYKFKAVKQFEVVDLASLYEEVVLCYANSLSVSAIYERHIEWIKKHV

SEQ ID NO: 26518 - protein, 595 aa, Aspergillus oryzae
MLSSWQKKFLEKSDGPTEANPNPPEYGTNEDIHPGSKRPEEVVNDDVSREDVPDDTAQDGVAQAEAITLTWNKWSLGSAYILMWLLYFVNAFQSSITGNLSAYVTSGFESHSLIPTISVVSSVMSAATYMPLAKILNLWDRSIGFLVMVLFSILGLVLSATCSNIATYCAAQVFYSIGFAGLIFSIDVITADTSSLRHRGLAYAFTSSPYIITAYAGSAASEHFYESNWRWAYGCFAIVLPVVAFPMFCLLRYNRHLAKKNGLLKPREKSGRTLMQSIIHYIIEFDLLGTFLLAAGLVLFLLPFTIAGSAEDDWASAHIIVMLVVGFVVLIAFGLSERYLAPVPFLPYEILLSRTVLGACLIDVTYQVAYYCWFDYFTSYLQVVYGTSIATAGYISSIFDVVSGVWLFVVGFLIMKTGRFRWLIQGAVPLYLLGVGLMIYFRNPSWSVGYTIMCQVFLAFAGGTMIICQQVAVQAAADHNHVSSALAFLNCFGNIGGAIGGSISGAIWTHTLPDALKRLLPDSIKSDWESIYDDLDVQLSYERGTPERQAIALAYASSQKNMLIAGTAIMALSLIWMFVLRDIKLTKQQSKGILF

SEQ ID NO: 26519 - protein, 355 aa, Prochlorococcus marinus str. MIT 9211
MRTILITGGAGFIGSHTCLTLLDHGYDLLVLDSYVNSSPIAIKKVIILHKRNNQISNNQLMQISGDIRDYKFLKKLFFESKLNGKPIEAVIHFAGLKAVEESVENPLLYWDVNVGGSINLLRVMDEFRCRTIVFSSSATIYAPKTDELLKEDSDIAPLNPYGQTKAAIEQILSDLFQHTDQQWRIANLRYFNPIGAHQSGEIGESPLGKPNNLFPYISQVAVGARDILNIFGNDWPTPDGTGIRDYIHVMDLAEAHHAALEYLLDNESILTNLNIGTGKGTSVLELINTFINVNDCKVPYTFCNRRLGDVPVSVANNELAIKTLNWHPKRSLEDICRDGWKWQMLNPQGYLNKAI

SEQ ID NO: 26520 - protein, 196 aa, Debaryomyces hansenii CBS767
MVAQVQKPAPSFKKTAVVDGVFEDVSLEQYKGKWVLLAFFPLAFTFVCPTEIIAYSEAVKKFAEKDTEVLFASTDSEYSLLAWTNVARKDGGLGPINLPLIADTNHSLAKDYGVLLEDDGVALRGIFLIDPKGVLRQITVNDLPVGRSVEESLRLVEAFQFTEKYGEVCPANWQPGSETIKPEVSSSKEYFGKVNK

SEQ ID NO: 26521 - protein, 345 aa, Prochlorococcus marinus str. MIT 9211
MPSFSRPFLVTGAAGFIGAALVKKLLKNGEKVIGIDDLNSYYDPGLKQARLDEIQKILKPSSSEWAFYKIGLEDMDSLRELFLEKSPSVVVNLAAQAGVRYSIENPSAYLNSNLVGFFNILELCRHHSVENLIYASSSSVYGGNRNLPFVETQPVNHPVSFYAATKKSNELMAHSYSHLYKIPATGLRFFTVYGPWGRPDMAPMIFAKAIFSGKPINIYNQGEMLRDFTYIDDIAESLLRCCYKPATPNSNFDSLNPDPSSSLASHRIFNIGNSEPIELLRFIELLEDSLGIRAIKNMLPMQLGDVVATAADTNLLEKWIDFRPRTSIEEGVKMFTKWYRDFYKC

SEQ ID NO: 26522 - protein, 585 aa, Burkholderia vietnamiensis G4
MNRPWSARVARMLPGIALLTHYQRAWLSRDLYAGLALSAVLLPVGMSYAQAAGLPAITGLYASIAALLAYALFGPSRILVLGPDSALAALIASAITPLAAHDPQRAIALAGALALSAGTICILLGALGLGFVTDLLSRPIQYGYLNGIAIALAIGRLPELLGMQTSGGDVFAGVQHIAHALVDGRFSVAAGLLGAGVLAAIFLMKRALPRWPGVLLAVIGATIATRLWPLPGVATIGALPAGIPAPRLPAVSLADLGALASGAFAVALVSFADISMLSRALSARAGDTPDRNQELIALGAANLLTGVTQGCAVSSSASRTPVAIAAGAQSQLTNVVAAACIAILLLAAPTLLAYVPRTALAAVVIYAACGIADFRSVVRLYRMRRGECLISVLCFAGVIAIGVVPGILLASGLSLLSFVWRAWHPYDAVLGRLTGVRGYHDVGRHPDAAQTPGLVLFRWDAPLFYANVEIFCEHLHAAITRSASPVTRIVVAAEPVTDIDVSAADRLVALHAELAEQRIELDFAEMKGPVKDRLRAYGLFDVFGAASFFPTVTDAVARHVQRTEGHARACKKKRAMRKRAARKAR

SEQ ID NO: 26523 - protein, 359 aa, Bradyrhizobium japonicum USDA 110
MKDTYTIAVVHGDGIGPEVARAAVAVLQAGVQAGTLRFVDYPAGADHFLKTGDSFPAASFEGCRTADAILHGAAGIPGVVHPDGTEAGLDFTLTLRFKLDLFANVRPIKLYKGVPSPLGRPGPIDYVIVRENSEGLYAARGAGALLREEVAVDTLVQTRKGVERIVRFAFELARTRNGSPKDGRRRVTCCDKANVLRTYAFFRAVFDEVAKEYPDIEAEHVLVDAMTVHLVNKPTHFDVIVTENMFGDIISDLGAATVGGMGMAPSEEVGDGIGFFQASHGSAPDIAGKGLANPYGTILASILMLRRLDQRHRDSRLKLGADRIEAAVCAGLEDPALRTRDIGGVAPTNQVVDALLKRL

SEQ ID NO: 26524 - protein, 493 aa, Bradyrhizobium japonicum USDA 110
MTKAEIRFPLDGRARKMFVDGAWVEARSGKVFETRNPATGEVIGRVPRGEAADISVAVAAARRAFVGPWSRFKPFERQALLLRIADLFEKHWEEISQSDTADMGMPIARTRANKLRVIGMLRYYAGMATALHGQTVDNSLPGDIVSFTRKEPIGVVGAIIPWNAPTAASVWKIGPALATGCTIVLKPSEEAPLTPLLIADLMNEAGVPPGVVNVVTGTGVEAGAPLAEHPDVDKIVFTGSTATGQAIIRASAGNLKRVSLELGGKSPVIVCADADLDKAVPIAAMAAFANSGQICIAGSRLFVERKIHDELVERLGKFASALKIGDGADPTTEIGPLVSQRQLDKVEGFLQSGREEGAKVVAGGRRVREGNLAKGNFVEPTVFAGVSDDMQIARDEIFGPVISALPFDTLDEAVERANATPYGLAAGVFTRDVSKAHVISRSLRAGSVWVNTYHALDPAMPFGGYKMSGYGREGGTEHLDEYLHTKGVWIKLD

SEQ ID NO: 26525 - protein, 65 aa, Physcomitrella patens subsp. patens
PPQLDYAQNWDAAMDLTLRRFVYGSLSGAASALLLFRSPTTRWAAVAFGAGAGIGSACTDSFKLF

SEQ ID NO: 26526 - protein, 518 aa, Triticum aestivum
MGNRTSRHRRAAADQPATAPPPTAQPKPQPPPKPQTAPAPAPTPEAGQVAMGRVLGRPMEDVRATYTFGRELGRGQFGVTYLVTHKATGQRFACKSIATRKLVHRDDIEDVQREVQIMHHLTGHRNIVELRGAYEDRHSVNLIMELCEGGELFDRIIARGHYSERAAALLCREMVSVVHSCHSMGVFHRDLKPENFLFLNNKEDSPLKATDFGLSVFFKHGEQFKDLVGSAYYVAPEVLKRHYGAEADIWSAGIILYILLSGVPPFWADNEDGIFEAVLLGHIDFSSDPWPSISNGAKDLVKKMLRQDPKERLTAAEILNHPWIREDGEAPDKPLDITVISRMKQFRAMNKLKKVALKIVAENLSEEEITGLKEMFRSLDTDNSGTITLEELRSGLPKLGTKISESEITQLMEAADVDGNGTIDYSEFVSATMHMNRLEKEDHILKAFEYFDKDHSGYITVDELEEALKKYDMGDDKTIKDIIAEVDTDHDGRINYQEFVAMMRNNSPEIVPNRRRMF

SEQ ID NO: 26527 - protein, 601 aa, Bradyrhizobium japonicum USDA 110
MSEMSFSTDIVRWRYKLLPDHVIGEVLTKKWVDSAIPFLALALLVFGLGPFVPHFFEWTTLGNLARQFAEFGLIVLGLTIVMMSGGIDLSVGSVFALSVLMSLIGMNVEGWSAGTGLIATLAVGASCGALNGLLVGYVRMRAFLTTLVTLIIFRSLFEIVFPEFSTAIVTNMSDSAAFEYLGTANIGLAPVSFLITAAIAIGVHVVLSRTRYGWHLLAVGGARRSAYNAGINVRWTIFSAYVCCSTLVALSGFLFASRIGSAASDVGAGLELQALTATVLGGISLGGGRGTVSKAIMGAVFVLLLSNSFLALAISGPGADLVLGLILVAAVFLDVRWVKNRHKLLRSVYISPAYARMPDPIPTDLGAGAMAPNDRLRDVGVIGLGILEGAEDVIFDRHDNLYTGSRHGDIARWLPPDYQRWEVLAHIGGSPLGMALDRQGHLNICVAGMGLYQVEMNGTVRRLTAETNRSLLSIIDDSNMKLADDLDIAPDGTIYFSEATTRFEMHDWYSDALESRGNGRIIRYDPKTRRTRTVLKNLVFPNGICMSYDNESLLFAESWACRISRYYFDGPKKGEVEVVIPNLPGYPDNINRASDGCSGWP

SEQ ID NO: 26528 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 26529 - protein, 55 aa, Chorispora bungeana
YRGVRRRNSGKWVCEVREPNKKTRIWLGTFPTVEMAARAHDVAAIALRGRSACLN

SEQ ID NO: 26530 - protein, 570 aa, Shewanella sp. MR-7
MIKTIKSICTLVTVATAMSSSGVLAMDRITGKAFATRSEVYATHGMAATSQPLATQVAIDVLKQGGSAVDAAIAANAMLGLVEPTGAGVGGDLFAIVWSAKDKKLYGLNASGRSPKSLTLEKLKSLGLDYLPPFGPLPVSVPGAVDGWFELHDKFGKLPMADNLAPAIRYAREGFPVSELIAYYLNGSGKKLGQFPGFKETYMPNGKMPAVGEIFKNPALANTYEKIAKGGRDAFYKGDIAKSIDKYIKAQGGYLSYEDLASHTSDWVEPVSANYRGYDVWELPPNGQGIAALQILKTMEPFDVAAMGFNSPEYVHLFVEAKKLAFADRAKFYADMAFNKVPVKELISQQYNYDRAKLIDLNKAAKSVDAGNPALQHGDTVYLTTADKDGNMVSLIQSNYRGMGSGMTPPDLGFVLQDRGQMFDLTEGRFNTYAPGKRPFHTIIPAFVTKDGKPWLSFGVMGGATQPQMHAQIIVNLIDFKMNLQEAGDAPRILHTGSTEPTGEVMNDGGYVSLESGFPVETRRELIKKGHVLRDGLGDFGGYQAIGFNAETGVYRGASESRKDGYAAGY

SEQ ID NO: 26531 - protein, 415 aa, Arabidopsis thaliana
MTIPDLCNDLVDEILCRVPARNLKRLRSTSKRWNRLFKDDRRFAREHMHKAPKEYLPLMLTSEYRICPVSINLQGDVPSVVLKRELSLPDPDYSHQFDIGRVFHCDGLLVCNHVGKNPRYGSKIVVWNPLTGQTRWIEAGYRWKEYEVRFVLGYCYQQDENNSCSKKIYKILCFYPNGQDTEIYELNYSDRWTRTIPDGDLTPGWTLIYSEQTVSMNGNLYLFASEKSKPHLGVSLLRFDFSTEKSSLCVTLPYQRPRYEILSISAVRGGENLSLLLQLDFESKTEIWVTNKIDDTTTKGAAVSWTKVLAFDLSPDLQLFSEEVNFLLDEDKKVAVCCERWLEPQEHHRYQCRREYKITDKIYILGEDNKVDEVGSGEGEATDSLEGISQVILNYAPSLVQIEQAGGGKTKRGDD

SEQ ID NO: 26532 - protein, 232 aa, Glycine max
  misc_feature (113)..(113): Xaa can be any naturally occurring amino acid
NPFRRKTHRNLCGSQLRFRLHRAPLTRSIYICMYMGKTRWLIILVTCLCLLSFSDGRELKVRHKKQHYQYNHTVATILVEYASAVYLSDLTELFTWTCSRCNGLTKVVELSSXKTIPKFCANAFVGVADDPHAIIIAFRGTNEHSLQNWIEDLYWKQHDINYPGMDDAMVHRGFYTAYHNTTIRPAILDAVERAKKFYGDIEIIATGHSMGGAMASFCGLDLTVIIVLAVLA

SEQ ID NO: 26533 - protein, 248 aa, Chlamydia muridarum Nigg
MNSLLVNKAAIVTGGSRGIGFGIAKLFAEHGANVQIWGINEEAGKSAAQDLSDKTGSKVSFALVDVSKNDMVSAQVQKFLAEYGTIDVVVNNAGITRDSLLMRMSEEEWSSVIDTNLGSIYNVCSAVIRPMIKARSGAIVNISSIVGLRGSPGQTNYAAAKAGIIGFSKALSKEVGSKNIRVNCIAPGFIDTDMTKGLSDNLKNEWLKGVPLGRVGTPEEIAMAALFLASNQSSYITGQVLSVDGGMA

SEQ ID NO: 26534 - protein, 251 aa, Brassica napus
RPTRPELEDWETEFTKNRVKFKDLYSATEGFKEKDVLGSGGFGSVYKGVMPNTKKEIAVKRVSNESKQGLKEFVSEIVTIGRMSHRNLVPLLGYCRREKELLLVYDYMPNGSLDKYLHNSPEVTLDWKQRIKVIKGVASALFYLHEDWEQVVIHRDIKSSNVLLDAEYNGRLGDFGLARLCGHGTDPQTSHVAGTWGYLAPDHMRTGKTTTATDVFSFGVLLLEVACGRRPIEVHKKSGETVLLVDWVFGF

SEQ ID NO: 26535 - protein, 448 aa, Acinetobacter sp. ADP1
MSSNLDLTAKKATKINLFNFSVPAMRAFHMSWLAFFVCFFAWFACAPLMPVIAGEFHLTKDQIANINIAAVAITIVVRLIVGPLCDKYGPRKTYTALLLIGSLPVFGVAAANSYESFLFFRLLIGAIGASFVITQYHTSIMFAPNVVGTANAASAGWGNAGGGATQALMPLLLSALVMFGVEQAMGWRVALLVPGAMMVIVGLLYWKYTQDCPQGNFKELRAQGIQVGSDKKGGMAILMHAARNYRVWILFGAYAACFGIEIFIHNIVAMYYVNHFNFGLKEAGLAAGIFGLLALFARALGGIISDKVAIKKGLDGRTKVLFAMIVGEGLFLIIFSQMNSAMLAIMIMTLFALFTHMACGATYALVPFIDRDALGGVAGIIGAGGNVGAVAAGFLLKGMMDIQTCLMVLGGLVIIAGGFVMLIRFSAEHKVKEQRLFEQAVLERNNLA

SEQ ID NO: 26536 - protein, 434 aa, Oryza sativa
MQVLNTMVNKHFLSLSVLIVLLGLSSNLTAGQVLFQGFNWESWKENGGWYNFLMGKVDDIAAAGITHVWLPPPSHSVGEQGYMPGRLYDLDASKYGNEAQLKSLIEAFHGKGVQVIADIVINHRTAEHKDGRGIYCLFEGGTPDSRLDWGPHMICRDDPYGDGTGNPDTGADFAAAPDIDHLNKRVQRELIGWLDWLKMDIGFDAWRLDFAKGYSADMAKIYIDATEPSFAVAEIWTSMANGGDGKPNYDQNAHRQELVNWVDRVGGANSNGTAFDFTTKGILNVAVEGELWRLRGEDGKAPGMIGWWPAKATTFVDNHDTGSTQHLWPFPSDKVMQGYAYILTHPGNPCIFYDHFFDWGLKEEIERLVSIRNRQGIHPASELRIMEADSDLYLAEIDGKVITKIGPRYDVEHLIPEGFQVVAHGDGYAIWEKI

SEQ ID NO: 26537 - protein, 592 aa, Oryza sativa Japonica Group
MSEAIPSTRPALRHCVALLRLHLAAPSLAAAKQIHARALRAGVPTSHPLLAKHLLFHLAALRAPPLRYAVAVLSRLLPHGPLDPFPLNTVLRIAAGSPRPRVALELHRRRLALPDTHTYPPLIQACARLLALREGECLHAEAAKNGFVTLVFVQNSLVHLYGACGLFESAHKVFDEMPVRGRNLVSWNSMLNSFAANGRPNEVLTVFWEMLGVDFAPDGFTIVSVLTACAEFGALALGRRVHVYVEKVGLVENSHVSNALIDLYAKCGSVNDARRIFEEMGLGRTVVSWTSLIVGLAANGFGKEALELFSLMEREKLVPTEITMVGVLYACSHCGLVDDGFRYFDRMKEDYGISPRIEHLGCMVDLLGRAGRVEEAYDYIITMPLEPNAVVWRTLLGSCAMHKKLELGKVAWERLVELDPGHSGDYVLLSNLYAAVGMWADVHVLRKTMVKDRVRKNPGHSLVELRNSVYEFVMGDRSHPESEQIYEMLAEIAERLRREGYIPRTSNVLADIEEEEKETALNYHSERLAIAFALLKSLPGIPIRIIKNLRMCGDCHVAFNLISKVYDREIIVRDRSRFHHFQGGACSCKDYW

SEQ ID NO: 26538 - protein, 471 aa, Bacillus cereus G9241
MRGDVLSGIVVALALIPEAIAFSVIAGVDPTVGLYAAFCIAVTISFVGGRTGMISAATGAMALLMVTLVKDHGLQYLFATTILTGIVQIIFGVFKLSSFMKFVPKSVMSGFLNSLGILVFTAQLPHFKNATWQMYALVALGLVIIYVFPRITTAIPSTLISIIIVTSIAIMSGLQLKTVGDMGSLPKELPFFSIPDVPFTLETLGIILPYAIMLAIIGLLESLLTASVLDDMTNTESNKHKEARGQGIANIVAGFFGGMAGCAMIGQSVINIKSGGRGRLSTFVAGGFLIVLLFVLRDYVVHIPMAALVAVMIMVSIGTFDWNSVTTIHKVPKGNAFVMIVTVVVVLITHNLALGVIIGTVISAVLFAFNMAKIHVKHLYIENKKIYEIHGQLFFASTADFIKHFSFEEDVKEIELNFTHAHIWDDSAVASIDKVIMRYEQSGVKVSITGLNERSAKLVTNLATYNKRIAS

SEQ ID NO: 26539 - protein, 309 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFIRHLPEPNIAEIPDLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPSDAVIYPAPILVEKETEEKKTAYPKFVFEDYMKLYAGLKFQAKEPRFDAMKAAAKA

SEQ ID NO: 26540 - protein, 427 aa, Bradyrhizobium japonicum USDA 110
MGERSVKLPDIGEGIAEAELVEWHVKEGDLVREDDLLATVMTDKASVEIPSPLAGEVSWIGARIGDAVAIGSTLVKLKVAGDDTSEPADEAPTEDVATPSAVTNAKTPDAVPTPPARIRPAAIEARPATTSAVRRTPGEKPLASPAIRLKAREAGLDLRQVHGTGPAGRITHEDIDAFLSRGPAPTHGRGMAPKTAVTDVKVVGLRRRIAEKMALSKSRIPHITIIEEVNVSPLEDLRATLNRKPAPEHPKLTLLPFLMRAMVKALTEQPALNALYDDEAGIVHEHAGIHIGIATQTPSGLVVPVVKHAEARDLRDCSIELNRLAQRAREGTATREELTGSTITITSLGALGGLATTPVINHPEVAIVGVNKIAIRPVWDGTQFVPCKMMNLSCSFDHRVIDGWDAAVFVQRVKELLENPATIFVDP

SEQ ID NO: 26541 - protein, 99 aa, Thermosynechococcus elongatus BP-1
MEAWPTMSVQTIEKPATVRKLAPRYRVLLHNDNVNSMEYVVEVLLKTVPSLTQPQAVDIMMEAHLTGVALVITCALEHAEFYCEGLKMAGLTSTIEPTE

SEQ ID NO: 26542 - protein, 465 aa, Bradyrhizobium japonicum USDA 110
MTEITCQLLVVGAGPGGYVCAIRAGQLGLDTVLVERGKLGGSCLNVGCIPSKAMIHVAEEFEKLVEAADGKTPFGLTAAQPALDFKQAIAWKDGIVHRLNNGVAALLRKAKVKIVQGHGRFRDGKTIVVETETGPKTIKAETVVIATGSAPVELPTLPFGGRVISSTGALSLAEVPKSLVVVGGGYIGLELGTAFAKLGSKVAVVEAQDNILPLYDVELTAPIARRLTALGVEVLTGARALGLTAQGDGLRVETPDGQERSLTADKILVTVGRTPVTEALGLEQLVLDMDGRFIRIGQHCETSMRGIYAIGDVTGEPMLAHRAMAQGEMVAEIAAGMPRAWDKCCIPAICFTDPEIVSAGLSPDEARRAGINIKVGQFPFAANGRAMTRHGEPGFVRVVARADNQRVLGIQALGQGVSELSAAFGLAIEMGAVLQDIAGTIHAHPTLGEAIQEAAFKALGHAIHV

SEQ ID NO: 26543 - protein, 348 aa, Prochlorococcus marinus str. NATL1A
MNSKASNETILVTGAAGFIGAALVKALLNLDFKVIGIDNLNDYYSTSLKRSRLTEIEKVSTVNGEWFFYEIPIEDNKVLQDIINRYNPQVFVHLAAQAGVRYSITNPAAYIQSNLVGFANVLEGCRQNQIPHLIYASSSSVYGGNKNLPFYEEQAVNHPVSLYAATKKSNELMAHTYSHLYDLPTTGLRFFTVYGPWGRPDMAPMIFARSILNNEPIQVFNYGKMQRDFTYIDDVVEGIIRCCFKKASIDDEFNPLVPNPSTSSAPYRIFNIGNSRPTQLTYFIELLEKNLGKKAIKNFQPMQPGDVVSTAARMDLLNSWVDYKPITSIENGIKLFSEWYLDYFKNTF

SEQ ID NO: 26544 - protein, 266 aa, Cicer arietinum
AEEKGLITPGQSVLIEPTSGNTGIGLAFMAAAKGYKLIITMPASMSLERRIILLAFGAELVLTDPAKGMKGAVQKAEEILAKTPNAYILQQFENPANPKVHYETTGPEIWKGTEGKVDAFVSGIGTGGTITGAGKYLKEQNPNIKLVGVEPVESPVLSGGKPGPHKIQGIGAGFVPGVLEVNLIDEVIQISSDEAIETAKLLALKEGLFVGISSGAAAAAAIKIAKRPENAGKLIVVVFPSFGERYLSSVLFESVRRQAETMTFEP

SEQ ID NO: 26545 - protein, 478 aa, Salmonella enterica subsp. enterica
MTNMRLCPVVMAGGIGSRLWPLSRELYPKQFLCLQAKTTMLQATINRLDGLRCQEPIVICNEQHRFIVAEQLREINKLAGNIILEPFGRNTAPAIALATIAMRNNSVDHDPLLLILAADHIIQNEEAFRDAVRGAMSYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 26546 - protein, 532 aa, Cryptococcus neoformans var. neoformans JEC21
MSTRPPTSPDAVDANKKQKTVQVNKKVCLIVHDGWGLSTEEKGNAIFHGDTTHMDAIRDKHNFVELEAHGLAVGLKEGLMGNSEVGHLNIGAGRIVWQDIVKIDQSIKKDEFKDQPAIVDAMKHAKETSGRLHLLGLISDGGVHSHIQHLFALLRVAKSYGIANVYIHFFGDGRDTAPKSATKYIKQLQDYIKEVGVGEISTVIGRYYAMDRDKRWDRIKIAVDGLVKGEGEKTDQEGLIKTVEDGYEKDVTDEFIKPIISGSEDSRIKKGDSLYLFNYRSDRMRELAQVLGLPDKPMEVDVPEDLHITTMSRYNIEFPFPVAFPPQAMTNVLAEWLAKQGVKQCHIAETEKYAHVTFFFNGGVEKQFENEKREMIPSPKVATYDKQPEMSVQGVADKVAETVKSDKYEFVMCNFAPPDMVGHTGDYDAAVKAITATDAAVKTVYDACEEAGYVLCVTADHGNAEQMLDPETGNPHTAHTTNHVPFIVTGDKGSLEVSEEPGALADVAPTILDILGLPKPEEMSGRSLLSKK

SEQ ID NO: 26547 - protein, 387 aa, Mycobacterium bovis AF2122/97
MDLFEYQAKELFAKHNVPSTPGRVTDTAEGAKAIATEIGRPVMVKAQVKIGGRGKAGGVKYAATPQDAYEHAKNILGLDIKGHIVKKLLVAEASDIAEEYYLSFLLDRANRTYLAMCSVEGGMEIEEVAATKPERLAKVPVNAVKGVDLDFARSIAEQGHLPAEVLDTAAVTIAKLWELFVAEDATLVEVNPLVRTPDHKILALDAKITLDGNADFRQPGHAEFEDRAATDPLELKAKEHDLNYVKLDGQVGIIGNGAGLAMSTLDVVAYAGEKHGGVKPANFLDIGGGASAEVMAAGLDVVLGDQQVKSVFVNVFGGITSCDAVATGIVKALGMLGDEANKPLVVRLDGNNVEEGRRILTEANHPLVTLVATMDEAADKAAELASA

SEQ ID NO: 26548 - protein, 370 aa, Pseudomonas aeruginosa UCBPP-PA14
MKHFKLPDLGEGLQEAEIVEWHVKAGDSVRADQRLVSVETAKALVDIPAPYDGVVGKLFGAEGDILHVGEPLVGFEGEEADAGTVVGRLEGGGSALEDRFFIGAAPSTREHLAPRATPAVRQFARQQGVELAGLSGSGPDGLITRADVEAAAQGARERFGGERLRGVRRSMALNMARSHAEVVPVTIYGDADLHRWKTARDPLIRLAQALAEACRAEPTLNAWFDGASLSLKLHERLDLGIAVDTPDGLFVPVLRDVGARSAEDLRAGMRRLREDVQARSIPPAEMLGATLTLSNFGTLFGRYANPVVVPPQVAILGAGGIRDEVVAWRGEMAIHPILPLSLSFDHRAATGGEAARFLKVLVNALEQPDG

SEQ ID NO: 26549 - protein, 428 aa, Chlamydia muridarum Nigg
MVSLLKMPKLSPTMETGTLVKWHKQAGDEVHFGDVLLEISTDKAVLEHTASEDGWLLQILVKEGTKIPIGTPIAVFSTEQNAEYDLKQLLPLEEASGANEPTEILPQTSPQNDSHYSGPSMAIVGFRPEPPLTTPLSVKYSGDKVAASPLAKKLAKEQNLDLSGVAGSGPGGRIVKKDLEKAPPLRIAGFGYPEAPDVNPGSYVEESLSPIRESISKRLQAAKTFIPHFYVRQRIYASPLLALLKELQVQNIKLSINDCIVRACALALKEFPEINSGFNSVDNTIIRFSTIDISIAVAIPDGVITPIIRCADRKNVGTISAEIKGLAARARQFSLKEEEYKGGSFCISNLGMTGISDFTAILNPPQAAILAVGSVEEQPVVLNGELAVGSTCMLTLSVDHRVIDGYPAAMFMKRLQKLLEAPSVLLLN

SEQ ID NO: 26550 - protein, 306 aa, Campylobacter jejuni RM1221
MKHFLTLRDFSKEEILSLVNHASELKKEPKKLLQDKTLAMIFEKNSTRTRMAFELAITELGGKALFLSSNDLQLSRGEPVKDTARVIGAMVDFVMMRVNKHETLLEFARYSKAPVINALSELYHPTQVLGDLLTIKEWNKMQNGIAKVAFIGDSNNMCNSWLIAAAILGFEFSIAIPKNYKISPEIWEFAMKQALISGAKISLSHDRFEALKDKDVVITDTWVSMGEENEKERKIKEFEGFMIDEKAMSVANKDAILLHCLPAYRGYEVSEEIFEKHADVIFEEARNRLYVVKALLCFLDNQRGRE

SEQ ID NO: 26551 - protein, 379 aa, Thiobacillus denitrificans ATCC 25259
MKFEVRVPTLSDSVASGTLLPWRKAVGDTVARDETLVDLETDKVILEIPAPASGTLVEVRAVGGAEVRADEVIALIETGEAAAAGARENATPAAPAPAPPAATAPARAAAPAESPSVAAPPPRVATATAPQPRVAPPPARAAAQPGESRREPMSRLRQRVAERLVAAQHTAAMLTTFNEVNMQPVNELRQRFKADFEVRHGVKLGYMSFFVRAVCRALEAFPIVNARIDGNDIVWHGDADIGIAISSPRGLVVPILRRAQQLSSDEIERAIADFARRARDSKLALEELAGGTFSITNGGVFGSLLSTPILNPPQSAILGMHTIQERPVAEHGQVVIRPMMYLALTYDHRLIDGRDAVQFLVAVKAALEAPDAPLPEYRA

SEQ ID NO: 26552 - protein, 318 aa, Prochlorococcus marinus str. MIT 9211
MDASSQGVARELSLLKGKDLISSADFQMEQINALFNLSIQLKKEERRIDLGNRVLGLIFSKASTRTRVSFQVAMARLGGQVVDLSLQATQIGRGEPVKDTARVLSRYCDALAIRTYSHEELIEYANWASIPVINALTDLEHPCQALADFLTIKETFGKLKGLTLAYIGDGNNVSNSLILLGAILGVHLRVACPSGFEPSAWVVEKARSLASFDSTLQILNEPVEAVRGANAIYTDVWASMGQEKEQQERKEIFKKFTVDENLFCEASQEAIVLHCLPAHRGEEITDELIESKASKIFHQAENRLHIQQALLASLLGGL

SEQ ID NO: 26553 - protein, 395 aa, Acinetobacter sp. ADP1
MNFKRMTDLDLSEKRVLIREDLNVPVKNGQITSDARLRAALPTIQAALAQGAAVMVCSHLGRPVEGEPKPEQSLAPVAAYLSDALGQEVKLLTDYLEGVEIAPGQVVLLENVRFNLGEKKNNAELAQKYAALCDVFVMDAFGTAHRAEASTEGAARYAKVAAAGPLLATELDALGRALQTPEKPMVAIVAGSKVSTKLDVLTSLSDICGQLIVGGGIANTFLAAAGFNVGKSLCENDLIDTAKAIAAKVSVPLPTDVVVADATEIDFADFLGSLAKAQAIVKKVEDIADNDMILDVGPDTAKAFAEILKTAKTILWNGPVGVFEVDQFGEGTKTLSLAIAESKGFSIAGGGDTLAAIDKYKVADKIGYISTGGGAFLEFVEGKTLPAVAVLLERA

SEQ ID NO: 26554 - protein, 573 aa, Saccharomyces bayanus
MLSKSEKHIDLLAGNMSNLSFDGPGTPSSTGLFNVNQNNTNRRMRPTGFNDSPSPIKSSLFPHEDSSNMDIDEVSQSDMDITNSPKKLPPKFYERATSNKTQRVVSVCKMYFLEYYCDMFDYVISRRQRTKQVLEYLQQQSQLPTADQAKLNEEWSSYLQKEHQVLRKRRLKPKNRDFEVITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEVNYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGSEHSDPFATFY

SEQ ID NO: 26555 - protein, 175 aa, Triticum aestivum
MAPTVMASSATSVAPFQGLKSTAGLPVSRRSNGASLGSVSNGGRIRCMQVWPIEGIKKCETLSYLPPLSTEALLKQVDYLIRSKWVPCLEFSKVGFIFREHKASPGYYDGRYWTMCKLPMFGCTDATQVINEVEDVKKEYPDAYVRIIGFDNMRQVQCVSFIGFKPPGCEESGKA

SEQ ID NO: 26556 - protein, 159 aa, Triticum aestivum
  misc_feature (79)..(79): Xaa can be any naturally occurring amino acid
  misc_feature (100)..(100): Xaa can be any naturally occurring amino acid
  misc_feature (114)..(114): Xaa can be any naturally occurring amino acid
  misc_feature (127)..(127): Xaa can be any naturally occurring amino acid
  misc_feature (133)..(134): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDXLIRSKVVPFLEVQQRVGFNLXREHNASPGYYDGRXYWDMLELPKFRVXTDATRXXTKVEEVQERIPDPISAHRKSVMLNL

SEQ ID NO: 26557 - protein, 346 aa, Prochlorococcus marinus str. MIT 9313
MTGTNPVHSNEPEVICLGEALVDRLGPLGGDPAVDQPVEDCLGGAPANVACGLARLGSKVAFLGRLGDDAIGARFRELFNTRGVNLAGLQIDQRRPSRIVLVRRDLDGERVFQGFAGDRGDGFADPALSLDELAASWPLLVGKASWLLIGSIPLATPASAQALLWCVEQAQTAGLEIALDVNWRPTFWDPGHSPDSGPDEKALQAIAPLLERASLLKLAREEAVWFFDTDDPAVIARSLPQQPDVVVTDGARPVRWWIGGCVGELAALSPPSVVDTTGAGDAFTAGLLHQFLMDASSQRDLIKAREMVRFAAACGALVCGGAGGIDPQPSQMQVEEFLGSFEGEVN

SEQ ID NO: 26558 - protein, 298 aa, Bacillus cereus G9241
MPNIAVVGSISMDLVAVSKKRPKAGETVIGEAFHTIPGGKGANQAVAAARLGANVAMIGAVGNDNYGTVVRKNLENERVFIDYVVPVTDAVTGIAHIVLAEEDNSIVVVQGANALVNEPVVDRSKDLLTKADMVVLQLEIPLETVKYVLAICEEHKIPVMLNPAPAQVLSEDILEKATYITPNEHECRIVLDDFTSPIEELLAKYPNKLLMTEGSNGVRFHNGTEIVHVPSIAVDVVDTTGAGDTFNGALAVALSEGETLQKAIRFANIAGGLSVTKLGAQGGMPTRDKVREVQVIVG

SEQ ID NO: 26559 - protein, 135 aa, Triticum aestivum
  misc_feature (66)..(66): Xaa can be any naturally occurring amino acid
  misc_feature (79)..(79): Xaa can be any naturally occurring amino acid
  misc_feature (87)..(87): Xaa can be any naturally occurring amino acid
  misc_feature (113)..(113): Xaa can be any naturally occurring amino acid
  misc_feature (128)..(128): Xaa can be any naturally occurring amino acid
MGRKFFVGGNWKCNGTTDQVEKIVKTLNEGNVPSSDVVEVVVSPPYVFLPVVKSQLRQEFQVAAQXNCWVKKGGAFTGXKLSAEMLXVNLGVPWVIPWALLKGELLLGESNDXLGDKVAFAPSQGTKXIACVGRL

SEQ ID NO: 26560 - protein, 475 aa, Vibrio parahaemolyticus
MSKEIKAQVVVLGSGPAGYSAAFRCADLGLETVLVERYSTLGGVCLNVGCIPSKALLHVSKVIEEAKAMADHGVVFGEPQTDINKIRIWKEKVVNQLTGGLSGMAKMRNVTVVNGYGKFTGPNSILVEGEGESTVVNFDNAIVAAGSRPIKLPFIPHEDSRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGIKYEVATFPWAASGRAIASDCSDGMTKLIFDKETHRVIGGAIVGTNGGELLGEIGLAIEMGCDAEDIALTIHAHPTLHESVGLAAEVFEGSITDLPNKKAVKKK

SEQ ID NO: 26561 - protein, 116 aa, Zea mays
MSTTVSRASLDQKLALAKRCSREATLAGAKAAAVATIASAIPTLASVRMLPWAKANINPTGQALIVSTVAGMAYFIAADKKILSLARRHSFEQAPEHLKNTSFQGTGRPHPAFFRP

SEQ ID NO: 26562 - protein, 216 aa, Pseudomonas syringae pv. tomato str. DC3000
MQDMSRNSYIQQNSDIQAAGGLVPMVIEQSARGERAYDIYSRLLKERVIFMVGPVEDYMANLIAAQLLFLEAENPDKDIHLYINSPGGSVTAGMSIYDTMQFIKPDVSTICIGQACSMGAFLLAGGAEGKRHCLPNSRMMIHQPLGGFQGQASDIDIHAKEILHIRHRLNSLLAHHTGQSLETIERDTERDNFMSAERAAEYGLIDSVINKRQMPA

SEQ ID NO: 26563 - protein, 211 aa, Triticum aestivum
PRVRRPVYAVALICFYLLLVHTFGASGVGDKLEKGQNLTDGDTLVSAGGSFTLGFFSPGASTKRYLGIWFSVSNGTAVCWVANRDQPLVDKSGMLVLNDLGSLVLLDGSRRTVWSSDFSAGASAVVAQLLVSGSLVVHNGSSDASLWQSFDHPSDTLLPDMKLGKNRWSGAEWQLTSWRSADEPAPGDYRRTLESKGLPELVVWRGNVKTY

SEQ ID NO: 26564 - protein, 270 aa, Glycine max
  misc_feature (241)..(241): Xaa can be any naturally occurring amino acid
MVTKLVQPPMTDSHVSPLIYRTMNVMKLQNFVPARNHPRINTSRFGERPLWFRPITIIKVAEHNSGSGLVELEALAQKKRELYQAVEGINRGIFGIPATKKSEIERLVKQIESLNPTPCPTLELEKVAGCWRLVYSTISILGSKRTKLGLRDFISLDDFFQTIDISKSKAVNVIKFSAMGLSLLSGQLNIEASFRIASSTRVDINFENSTITPDRLMNVFRKNYDLLLGIFNPEGWLEITXRYVDDTLRIGRDDKSNIFVLERFDDSNNT

SEQ ID NO: 26565 - protein, 160 aa, Glycine max
MSETASLHAPTRTPISSLDAMAHHHPHYRSPFGDTTFTKLFVGGLAWETPTEEMRKYFEQFGDILEAVIITDKNTGKSKGYGFVTFCGQESARRACADPNPIIDGRRANCNIASLGRTRPSPPSGRNTVQGGVGTAQGVPGAGPAPSLPPPPPVLYPPYG

SEQ ID NO: 26566 - protein, 360 aa, Arabidopsis thaliana
MATMITNLRRDLIEEIISRVPLRSMKAVRLTCKSWNNISKSEIFTKMQIDKATTREGKTMMISVMPHNLSLMSVAVDDVDPSVEFKDHTRVVVWNPYSGQTRWVKLRYPHPPSPSKWDWFRYALGYEDKGSCRSVKFLRFLDYLPEEPENQNVCYEIYDFDSDLWTTLDVTSHSWICYSSCGVFLKGNAYWPVVKSSSEANIDHIIYFDFTRESFGPPLPLPFGATDRGYSYVNLSCVKEEKLAAFFQHYISYKYEFEIWVTTKIEAEMVSWSKFLRMDLGPNIDIPITFFIDEEKKVFMGFEHREYPKRFINIIGEAKYLRKLDLQVPQGQYCCPPLCSYVPSSIQIKKPALRQKDRAK

SEQ ID NO: 26567 - protein, 186 aa, Campylobacter jejuni RM1221
MEIKISEIANLPSKWGNFQMQSFKENDKEHLCIFKNTPKDTLNLRIHSECLTGDALGSLKCDCGEQLEFSLKYIEKNGGMVIYLRQEGRGIGLFNKVNAYALQDKGFDTIKANHQLGFKADERTYEIVEFILKHYEISKVNLLTNNPEKLDSIKEKIIIRIPILIEPNRFNVEYLNIKQTQMGHLK

SEQ ID NO: 26568 - protein, 506 aa, Legionella pneumophila str. Lens
MDQVFDVAIIGGGINGCGCAADAALRGLSVILFEQDDLASKTSSSSTKLIHGGLRYLEHYEFGLVKKALQERQTLLNLAPHLVHSQSFVLPYLKHMRPSWLLRLGLFFYDHLSRKNHLPKSRSIHRNNKNNYFTPLKEELNRGFLFYDATTDDARLTILNAIQAKNHGASIRPHAKVTHAEVINNIWHLTIQPTKGQSYKAYAKSIINATGPWVQSIAQLTHTPIQKDITLVKGSHIIVPKLFEGNHAYFLQHNDQRVIFVIPYHGFSMIGTTDIHYTGDLSHIEIGEEEIDYLIELVNAYFKFKITKEDVVHSWSGIRPLLADDSKEVKSLSRDYSYEFNHSPAPIITIFGGKITTYRQLAEEVVDQLTPVFPQMKPSRTQHTPLPGATLADMSFTQYVNYAKTKYHWLDDELLNRYLNTYGCYTEIFLSQCNNMEAMGKKYGPSLYQVEVDYLILEEWANYCDDILNRRTKLGLTMDNASKKELADYLASISTYPSAQAELVFH

SEQ ID NO: 26569 - protein, 329 aa, Brassica napus
MLRLLGRRAASAYAELTTIHQWRIRPGNDPKPVPLRILRGLQKGFCVGVLPDGVERNSEAFSSNSVAMEGILSDLRSHIKKVLVGGGEEAVKRNTSRNKLLPRERIDRLLDPGSSFLELSQLAGHELYEEPLPSGGIITGIGPVHGHLCMFMANDPTVKGGTYYPITIKKHLRAQEIAARCRLPCIYLVDSGGAYLPKQSEVFPDKENFGRVFYNESVMSSEGIPQVAIVLGSCTAGGAYIPAMADESVMVKGNGTIFLAGPPLVKAATGEEVSAEDLGGASVHCNVSGVSDYFAQDELHGLAIGRNIVKNLHMAAKRETKGAFGSEKL

SEQ ID NO: 26570 - protein, 233 aa, Kluyveromyces lactis NRRL Y-1140
MSEENRMKQFQEENKIVFDPSTRSVWETQEKQEHESLPGTDANAEDADKGSATSGIIPTLQNIVATVNLDCRLDLKTVALHARNAEYNPKRFAAVIMRIREPKTTALIFASGKMVVTGAKSEDDSKLASRKYARIIQKIGFSAKFTDFKIQNIVGSCDVKFPIRLEGLAFSHGTFSSYEPELFPGLIYRMVKPKIVLLIFVSGKIVLTGAKQREEIYQAFEAIYPVLSEFRKL

SEQ ID NO: 26571 - protein, 226 aa, Physcomitrella patens subsp. patens
MDGEFWTARMSTSKRHHTLQPSQSLIDRHLNLDDVDGDEDLRAEFSCPFCYEEFDTTALCPHLEEEHCFESRPAMCPVCAVKVPKDMVGHISLQHGHLFKMQRRRRFRRAGVPSNATLSLLGKELREAHLQALLGGTSRSSGLSSATDPLLSSMVYNVPISETEDPPKPTVVVEEQPAKLSSLSQQSKASAESSLTAEELEEKRKHANMRAKFVQQLVLSTLLGDD

SEQ ID NO: 26572 - protein, 698 aa, Yarrowia lipolytica CLIB122
MHTVSIVRKDPKSSNANYPLRGTDTPDYLSQFHFDVNGNELQFVELGGEQTSTSASLENGTLGAASDNATSRATELSKKRQASCSLPRQKKVPRNDLEIEQTDEQQTSASNVAMPSPPPAREEEEEQQHLTIPHANLRDEIPQLLDNFDDLPAPVKNYVMFQLLRRCNRRNLSMVADIVVPALRCDLLSIFPLELATKVLSHLDYKTLCAASQVSKSWNSIVESLGAIWKGLSESHQAPVTDADVARATEQKWDYTTWGSEDTDPSIVESTPLYSKINLYKSIYRRRHLIRRNWMDPNSTPDSTCIRTGREAVITCLQFDDDIIVTASEDPWINVYDTKTGRQRSRLEGHTGGVWALQYVGDTLVSGSIDRTVRIWNIKEARCTHIFTGHVSTVRSLSILTPVPMSHAMCATARTESTDPDEMYPSRPLIVTGSRDKTLRVWKLPLPGEPEWLDQSTQDPYFMKSLQGHSNSVRAVNGYGDTLVSGSYDTTVRVWSINTGKCKFVLSGHHKRVYAAVLDHQRNRCISGSLDWNVRVWCLESGSCLYTLEGHTSLVGLLDLNRSWLVSAAVDWTLRVWDPETGGNIHKLEGHAEAISCFQHDEYKVVSGSAKCLKLWDIRTGKLVKDLFTECESIWQVRFSGSKLVAAVQKDNEAYLRILDFDYEPGTKTEKTVYVGNEDDIKVEDELDTAAAPDVAQS

SEQ ID NO: 26573 - protein, 316 aa, Bradyrhizobium japonicum USDA 110
MSTSANIGDLANVSSGAKPVHVICLGLSALDQVWRVDRPFSGGSEKIKAVAYGTLGGGMAANASVAVAKLGASVAFWGRAGNDAAGHEMKSAFTAEGVDVENFRLFADGRSSVSGIIVDSSGERQIVNFRGLFPEAANWLPLDAVARASAVLADPRWVEGAATLFCEARSRGIPTVLDGDMADAEVFERLLPLTDHAIFSEPALTAFAGSADDKSLAALARFGCRVIAVTRGEGGVSWYEDSELHRQAAFSVDVVDTTGAGDVFHGAYTLAIAAGLDVRAAMMFSAATAAMKCRHAGGRNGIPTINECLVFMRTKP

SEQ ID NO: 26574 - protein, 408 aa, Burkholderia vietnamiensis G4
MNDRNSTKRNAAIVGGSLGGLFAANLLLRNGWDVDVFERVPDELSGRGAGIVTHPELFDVLRAAGVRIDASIGVNVEARITLARDGSLASERPLPQTLTAWSKMYHVLRAALPDQHYHAGAVVADVADGPDRASVTLADGSVVHADLVIAADGLRSAIRETFLPDARLQYAGYVAWRGLVDERELSDTTHATLFGKFAFGLPPREQILGYPVAGRHNSTQPGERRYNFVWYRATREDTDLPNLLTDATGKQWAGGIPPTLIRPDVLAAMEDAAHALLAPQFAEVVSRAAQPLFQPIYDLEVPHMTFDRIALLGDAAFVARPHCGMGVTKAAGDAMALVQALGAHADTLDALHAYSDTRTAFGAAIVQHARHLGAYMQAQLQNDTEREMAERYRTPEIVMRDTAVPPQL

SEQ ID NO: 26575 - protein, 417 aa, Kluyveromyces lactis NRRL Y-1140
MSELIIEEPPELGSGISNEVQQRYTNWKKNTKLLYDYLNTNTSKWPSLSCQFFPDRTLTNDKQRILLSSFTSQQLPQDESIYIGSISTMNHMKWSSINNFDMDEMEFKLDNSLKLNDKTLEEEVRITYPDGDCNRCRYMPQNPDIIGTASSNGSVYIFDRTKHGNKISTGRKFEIECRNNGDDEQDESLSLAWNYQLEGTLATCQSNGKVKVWDLTKFDKSKQRMEIPERESVMDANGVNDVSWMVNHTSILASCGESNVIGLIDIRQDTKMDTLHRTTHTDGINAIEFNYKNDMILCTGDSQGQLKIWDIRDFKEPIKEWEHGDQDPISAIQWNPQIPQILATADQQSGLVKIWDASGEQEDSNAENNMLLFVHGGHMLGVNDISWSQHDPWTMCSVSNDNSIHIWKPAANLVEQL

SEQ ID NO: 26576 - protein, 181 aa, Oryza sativa
MTDVPDAETSLRCLSVQSWDGGRGLIVGLDCEWKPNHVSWKTSKVAVLQLCAGERFCLVLQLFYANRVPPAVADLLGDPSVRLVGIGVGEDAAKLEADYGVWCAAPVDLEDACNRRLGLVGTGRRLGLKGYAREVLGMAMEKPRRVTMSNWEKRELDPAQVEYACIDAYVSYKLGERVLAN

SEQ ID NO: 26577 - protein, 1170 aa, Botryotinia fuckeliana
MNSNDEEALNSVYKKIQRERALLNAANQMRQQTQNEQVRASIDIQMRDGRRNISYLEERMRELQLRTEGRTGSAGSSAGRPPSSGLRDDRAAPPPTPPPKDARGNPIETGDQAGYGDQEYSQIGGHGDMMPPRNPFAPPAPGSGMPRSRPNYTKLDLIKYDTPYLGPRIQLMLSQLEFKLNVEKQYLKGIEKMVQLYQMEGDRKSKADAAARRVESNQKIQILKQALKGYEDLHIDMESSADAPDDDSINTPNMRKPLTGQLVLRIQAVKDVDHATTSRFTRGPETLIAVKVEDNVVARTKNSRTDKWENEIHNIYVDKANEIELTVYDKAGDQALPIGLLWVRISDIVEEMRRKRIEAEINNSGWVSADRMASGGAPPAQFPMSGTSQFGPPPGSAGAGAQPAGANEFGGPGNTVVAPQPIDAWFALEPSGAVKLNISFTKQTKDRRPFDLALGRKGAIRQRKEEVHEMYGHKFISQQFYNIMRCALCGDFLTYTAGMQCEDCKYTCHTKCFSQVVTKCISKSNAETDPDEEKINHRIPHRFEKFNNMSANWCCHCGYVLPFGKKNCRKCTECFLTCHAHCVHLVPDFCGMSMAVANAILDGIRTQKRRQTTPVPLSAKTLREKKPETEGAQIDRNSYGSPEHTRPPRAESYGAPSSSEATQAAQAMYQQSTTSPQQRPAGPDRTSTSSSATAAAAAATAAMGGRQPIPPKDQYSRASTDYTNQVGAQRGSAGHAQPLDKHSEDSPYGATPSAQMPTQPTYNPALYANVDSGYSQPVPQLQNSPLPPPPPTATMYAPPSQGPPPEVPLPAQPGSQQVVPQGQQRKQVPAANDAGTGRRIGLDHFNFLAVLGKGNFGKVMLAETKQTKKLYAIKVLKKEFIIENDEVESTRSEKRVFLIANKERHPFLLTLHACFQTETRVYFVMEYISGGDLMLHIQRGQFGTKRAQFYAAEVCLALKYFHENGVIYRDLKLDNILLTLDGHIKIADYGLCKEDMWYGSTTGTFCGTPEFMAPEILLDKKYGRAVDWWAFGVLIYQMLLQQSPFRGEDEDEIYDAILADEPLYPIHMPRDSVSILQKLLTREPEQRLGSGPTDAQEIMSQPFFRSINWDDVYHKRIAPPFQPSITNATDTSNFDSEFTSVTPVLTPVQSVLSQAMQEEFRGFSYSADFV

SEQ ID NO: 26578 - protein, 90 aa, Zea mays
MRKRERENPCGICGHYHKYEEGEVCGVCGHRWKPSDGEGAPSRHESAFPTEVLKDFLFLGSYDNASRSEVLRTLSISHILNVRIQALFSR

SEQ ID NO: 26579 - protein, 338 aa, Coccidioides immitis RS
MAADVGSLFNAGPKVVEGATFEEGLDFQELGGPMMHCTNGTIDNLAANEAECFEQIRTILAYLPSSGAEAPPVIPCDDPENREDISLRSIIPRRQQRMYNPWTIIKSVVDKDSWFEIGPLWGRTSITGLARLGGRPVGIISLNCEVNSGALDAAGSQKLTRLLKLCDVMNIPVIQFIDVPGYAIGTVAERTATMRWGVELTKAYYSTTMPIFNVITRKAFGVAGAVMVGCRDPKMQVAWPSGQWGSLPLDGGIEVGHRHELREAEKLGKKAERYKELEDEYLRLMNPVRTANAFGVEEIIDPKDTRAVVCAWAKRVYQVLMPERLANRANGKIQPSFA

SEQ ID NO: 26580 - protein, 502 aa, Ralstonia solanacearum GMI1000
MAQLLTVSEYAAMAGKLALPTQAFIDGAFVPAVSGKTFQTTNPATGNVLAEIAACDTRDVDIAVAKAKAAFEDGRWHRRSPAQRKATLLRLADLLEQHAHELAVMESLDSGKPIRECQATDVPETIHTIRWHAELIDKIYDSTAPVGSNALSLVVREPIGVVGLVLPWNFPLLMLAWKIGPSLAAGCSIIVKPAKETSLTALRVAELAHEAGVPAGVFNVLPGGGKEVGEPLGRHMDVSMVSFTGSTDTGRLFLKYAADSNLKRIVLECGGKNPAVVMNDVDDLDAVAQHVVNGAFWNMGENCSASSRLIVHADVKDALLARIGVHMREWKMGNPLDPEHRVGSLVSESHFRKVRSYLEHAGAEQLRVAFGGGTEGGIFVEPTVVDGVGQGSLLFREEIFGPILSVTTFTRMEDAIALANDSVYGLAASVYTDSLNNAIRLSREIRAGVVTVNCFGEGDVTTPFGGYKESGFGGRDKSIWAHDQYTEIKTIWIDVPDCTAAK

SEQ ID NO: 26581 - protein, 586 aa, Zea mays
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEAWRCQFPAASLVAVAMAMVTATISCSYPQLRYRPSPRCRRHGPAAATVAALATPRSEQDIVIVGAGVAGLATAVALRRLGVGAAVLEQGDALRAGGTSLTLFKNGWRVLDAIGVADELRPKYLRIQGMRMRSPGRDLREFSFDEEAPGQEVRAVERRALLETLASKLPPGAISFSSKLKSISEQGRAGTLLELEDGRQILAKIVVGCDGVNSPIARWMGFSEPRYVGHMAFRGLAEYADGQPFEPKVNYIYGRGVRAGFVPVSATKVYWFICFNRQDPGPKITDPTALKTEALELVRGWPSDLLAVMRSTPEGAVVRTPLVDRWLWPGLAPAASRGGRVVLAGDAWHPMTPNLGQGACCALEDAIVLARRLADAGADGAQAAAAMRAYEAERWARVFPLTARAGLVGALVQWENAAVCAARDGVVIPRLVRLGPFLEHTNFECDLLEPAPESP

SEQ ID NO: 26582 - protein, 371 aa, Bifidobacterium longum NCC2705
MSDARQIEADIYERLSKVIDPELGRSVTDLGMIAAIEAAPASSDAGTYDVTVHVELTVPGCPLSETITSQINGAVSSYPGAQLLPHIEVGSMSRDKLADLVADLKAERKQNPFSKPGVKTRIFAIASGKGGVGKSSVTANLAATFAALGFDTAAIDADIYGFSLPRLFGVHTQPTNLNGMLMPVTAWGVKLISIGMFAGADRAILWRGPRLQRSLEQFLSDVWWGEPDVLLLDLAPGTGDMAISVAQALPNAELVVVTTPQPSASDIAVRSGLVALQVPMKVRGVVENMSYYEHKGEKLEIFGAGGGQRVSEQLTQALGYDVPLMAQLPLEPEVRETGEAGRPAVLDADGALRTDGIGQTFRGLAERLLAV

SEQ ID NO: 26583 - protein, 529 aa, Mycobacterium bovis AF2122/97
MLQSTLDPNASAYDEAAATMSGKLDEINAELAKALAGGGPKYVDRHHARGKLTPRERIELLVDPDSPFLELSPLAAYGSNFQIGASLVTGIGAVCGVECMIVANDPTVKGGTSNPWTLRKILRANQIAFENRLPVISLVESGGADLPTQKEIFIPGGQMFRDLTRLSAAGIPTIALVFGNSTAGGAYVPGMSDHVVMIKERSKVFLAGPPLVKMATGEESDDESLGGAEMHARISGLADYFALDELDAIRIGRRIVARLNWIKQGPAPAPVTEPLFDAEELIGIVPPDLRIPFDPREVIARIVDGSEFDEFKPLYGSSLVTGWARLHGYPLGILANARGVLFSEESQKATQFIQLANRADTPLLFLHNTTGYMVGKDYEEGGMIKHGSMMINAVSNSTVPHISLLIGASYGAGHYGMCGRAYDPRFLFAWPSAKSAVMGGAQLSGVLSIVARAAAEARGQQVDEAADAAMRAAVEGQIEAESLPLVLSGMLYDDGVIDPRDTRTVLGMCLSAIANGPIKGTSNFGVFRM

SEQ ID NO: 26584 - protein, 305 aa, Brassica napus
  misc_feature (283)..(283): Xaa can be any naturally occurring amino acid
  misc_feature (290)..(290): Xaa can be any naturally occurring amino acid
  misc_feature (298)..(298): Xaa can be any naturally occurring amino acid
MASSMLSLGSTSLLPREINKDKLKLGPSGSNPFLRTKSLSRVTMSVSVKPSRFEGITMAPPDPILGVSEAFKADTNELKLNLGVGAYRTEELQPYVLNVVKKAENLMLERGDNKEYLPIEGLAAFNKATAELLFGAGHPVIKEQKVATIQGLSGTGSLRLAAALIERYFPGAKVLISAPTWGNHKNIFNDAKVPGSEYRYYDPKTMGWDLEGMIQDIKEAPEGSFILLHGGAHNPTGIDPTPEQWVKIADVIQEKNHIPFFDVAYQGFASGSLDEDAASVRLXAERGMEXFVAQSYSXNLGLYAE

SEQ ID NO: 26585 - protein, 331 aa, Corynebacterium diphtheriae NCTC 13129
MKIGVMGAGSWGTTLAKVFSDAGCDVTLWARREEVAREINTEHTNSTYLRGIALPHTLTATTQPTQALCDADVVVLAVPSQTLRGNLAEWCADIPQDALLLSLAKGIEKETFLRMSEVIAEVTGAQPDKVAVLSGPNLAREIAEEQPAATVIACTNEKNAQRIQHALAAPYFRPYTNTDVIGCEIGGACKNVIALACGMASGRGLGENTLATLMTRGLAEISRLGVAMGADPRTLSGLAGLGDLVATCSSPLSRNRTFGARLGEGKTLDEARAATNGQVAEGVISSQSIARLADSLGVDMPITRAVFGVCHRDQNVADMVAALMGRTKKSE

SEQ ID NO: 26586 - protein, 319 aa, Bifidobacterium longum NCC2705
MIETADDIKTIANVGTGTMGHAITLQFALAGYPVHLVGRSEASLEKAMKAIRSDAEDFAEAGLLKAGDTVDTVLARITGYADYASGVADVDFVIESVAENLDVKKSVWTEVEHAAPKDAILSTNTSGLSPTALQSVMGHPERFVVAHFWNPAQLMPLVEVVPGEKTDPKVVDITFDLMAKIGKKPAKIKKESLGFVGNRLQLAVLREAFYIVQQGIADAATVDDVMKYSLGRRWNLVGPIASIDLGGLDVFYNISTYLFDDMDNGTGPSPLLAEKVKEGNLGAKTGQGFFSWQGEDGKRIIETRNKALLRALKDDAAEA

SEQ ID NO: 26587 - protein, 286 aa, Prochlorococcus marinus str. MIT 9211
MVLPQNVNAANGGRIGGGSFSSPSISRSGGYGGNYQSNYGGFNRGGIGFPFIIPLFGLGGGGLFSFLILFAITGAIINSLRKGVIPSTNNEKIINEGNSGTAKIIQAQIALLSNAKSIQSELRLLAETADTTTSKGLQKVLQETILALLRLPDLWAYANLESGEVPINAAEATFNRLSITERSKLTVEIVSNVSGEIKTNQESLVSNQTPELGNEFIVVTVLLASKANISLGETITSDSLQEGLRIIGGTSANDLLAFEILWQPENEGELLSSEELLTSYPHLKHL

SEQ ID NO: 26588 - protein, 242 aa, Glycine max
MEYVNPLTGFRVDGRRPNEMRQLKGEVGVVSRADGSALFEMGNTRVIAAVYGPREIQNRSQQQNSKEALVRCEYRMAEFSTGDRRRKPKGDRRSTEISLVIRQTMEASILTHLMPHSQIDIFVQVLQADGGTRSACINAATLALADAGIPMRDIVTSCSAGYLCSTPLLDLNYIEDSAGGADVTVGILAKMDKVTLLQMDAKLPMDTFETVMDLATEGCKAIATYIREVLLENTKQLECQRG

SEQ ID NO: 26589 - protein, 521 aa, Yarrowia lipolytica CLIB122
MSEFDWESILPATPLGEIEKDIQTLRQGFRSGKTLDLNFRLDQIRKLFYALYDNVDAIKEAIHKDLGRPVFETELCEISFQWGEFNNVVSNLKKWAADETVKGTTIQYTLTRPKIRKRPLGTVLIISPWNYPFVLTISPLLAALAAGNTVALKFSEMCPHTSLLLGKLCTEALDKEIFKAFQGGVPVVSEILKYKFDKIMYTGNHRVGKIILDAANKYLTPVILELGGKSPVFVTKNCQNVSLAAKRALWGKLVNAGQTCVAPDYIIVEPEVEQEFIKACQYWVEKFYRGGVDSDHKDFTHIATPGHWRRLTSMLAQTEGNIITGGNSDEKSRFLAPTVVAKVPDGDSLMNDEIFGPILPILTARSVDEGIRYVHENHDTPLAMYVFTDNASEGEYIQSQINSGGLIFNDSLVHVGCVQAPFGGVGQSGYGSYHGEDSFLAFSHRQTFMKQPHFIERPMAIRYAPYTSRKQKAVQGSLAAPSFPRTGKVDRSLLERIFGKLWFWVIVLGLGAASLKSGIFL

SEQ ID NO: 26590 - protein, 509 aa, Vibrio vulnificus CMCP6
MGFTSLGLSAPILKAIQEKGYDTPSPIQLQAIPAILEGKDVMAAAQTGTGKTAGFTLPILERLAKGPRVRANHIRALILTPTRELAAQVQENVFMYSRHLDLNSAVVFGGVKINPQMLRLRKGADVLVATPGRLMDLYSQNAVKFDQLEVLILDEADRMLDMGFIRDIRKILALLPAKRQNLLFSATFSDEIRELAKGLVNNPIEISVNPANSTARTVEQCIYPADVKKKPAMLAKLIKDGDWQQVLVFTRTKHGANRLAAFLTDQGLTAAAIHGNKSQGARTKALADFKSGEVRVLVATDIAARGIDIPQLPQVVNFELPKVAEDYVHRIGRTGRAGETGKAISLVCALEAPELFAIERLIQELLPRKALEGYAPTNAVPESKLDTRPIKPKKPKKPKKPKAPNAEAAGSDASSKGNQKAKAADKPQGQNRGNGKAKRQFSAPKEGNNDSTNKGKRPNTKGSKPANNANGKTNGKPSHAKPNSAKTGNSKPANGKPSAQRRKPRPQSA

SEQ ID NO: 26591 - protein, 219 aa, Idiomarina loihiensis L2TR
MNARILIVEDEVVTRQTLTRLFQQEGYEVFDAADGLQMENIMRQERVDVVIMDVNLPGKNGLELAESLRESDNIGLIFLTGRDSEDDRLLALELGADDYLIKPYNPKELTIRVRNLCRRIEASRSGSPVENNSVEFQFHGWRLNSDSRCLYSPENQMFRLPKSEYRALEYFYLTRAAFLTVKHWLNVCWIANCVRMTVPLTLPFVAFVGILSLTRKHRT

SEQ ID NO: 26592 - protein, 175 aa, Prochlorococcus marinus str. MIT 9211
MQYSYTFKPTRNINMQIRIGNGYDIHRLVVGRRLILGGVLLEHPEGLGLDGHSDADVLVHAIMDALLGALGLGDIGKFFPPDNPQWKNADSLVLLENIEKLISEKNWKIVNVDSVIIAERPKLKNHIDLMRNNIAKRLRIEIDFVGIKATTNERLGPEGREEGISSHAVVLLEKE

SEQ ID NO: 26593 - protein, 483 aa, Prochlorococcus marinus str. NATL1A
MPARFSQQNQRVRPNSNEDKVVARAKEHFEKTLIQISGDIAGSVAALEHPTKNDALNYGEIFLRDNVPVMIYLLTQKRYDIVKKFLTVSLDLQSTTYQTRGVFPTSFVEEKGKLIADYGQRSIGRITSADASLWWPVLCWLYVRKSGDQSFGTSQQVQRGVQLLLDLVLHPTFEGNPVLFVPDCSFMIDRPMDVWGAPLEVEVLLHASLKSCIQLMELSRKHQKSRLLDQRLVLTRQWVHDLRQFLLKHYWVTSKTMQVLRRRPTEQYGEDQHQNEFNVQPQVVPSWLQDWLENRGGYLIGNIRTGRPDFRFYSLGNSLACMFGVLTAPQQRALFRLVLHNREHLMAQMPMRICHPPMDVEEWQNKTGSDPKNWPWSYHNGGHWPSLLWFFGASILLHEKRYPKADVLLMGQMRALIEECYWSQLNQLPRQKWAEYFDGPTGTWVGQQSRTYQTWTIVGFLLMHHLLRAEPDDVLMLDLEEEF

SEQ ID NO: 26594 - protein, 279 aa, Gibberella zeae PH-1
MSSIAEIEGEKKAYQEQFEIVLGQLRDDPDNVELKALKDELNSFIDLLSEQIAELKPAQASKPAPKQPSPPPEPEKWSRENHPAFKKAAPTEEKEQAAPANYQVNDTVLAKWVSGDKGFYQARITSITGSSTNPIYVVKFKTYDNTETLQARDIRPISNKRKADGTPTTSAPATPSAPGLVTSAGATVYPDAKKEADKDGDVKPPKPKKIKAKKELEKNKNKWQEFSAKSKGGKSTKKDSMFRTPDGVHGRVGFTGSGQAMRKDPTRSRHIYQVNDELD

SEQ ID NO: 26595 - protein, 525 aa, Deinococcus radiodurans R1
MKELLLPELAESVVEGEILKWLVEEGDAIALEQPLCEVMTDKVTVELPSPFEGTLHKRMANEGDVVAVHAVIALIDDGAGAGAGAIPSATQAIQDSAENPTTTEVTLPAQAEEEREAMGGSIVEAGHIAKADDDSTSLFKTFANDEEVKVQGLGARSGSGAPGSSTAGTGTLDRAPETAPASPTPATANGGRVLAVPAARQAARELGIDLAAVRGSGPNGRIRVADVLAHQQSGQAQPQQTQPQQAAASQAVAPQPQAAAPAAPAPAGKLAAPSAHLPAPVQYRTPKGYEDRETRVPLRGMRRAIANQMQASHLYTVRTLTVDEVNLTKLVEFRQRVKDEAKAADVKLSYLPFIFKAITVALKKYPSLNTSFDEATQEIVQKSYYNLGMAVATEAGLTVPVIRDVDRKSIFDLARDVVDLAGRANAGKLSPDELTGSSFSVTNIGSIGALFSFPIINVPDAAIMGVHSIVKRPIVDEHDNITVAHMMYLSLSFDHRLIDGAEAARFCKEVIRLLENPDRLMLEGF

SEQ ID NO: 26596 - protein, 459 aa, Prochlorococcus marinus str. NATL1A
MSLENFVLNQLQDLVLSGKTRNEKWRRAQLKSLSNLLENHQQEILKALSQDLGKPATEAFFEIIAVKQEIKLAQKSLSNWMKTRQINVPVSLKPAQALVQPDPLGCILIIGPWNYPFSLTLQPLVGALAAGNTAVLKPSEHAPNVSNLIKKLIEEYFPPEIVQVFEGDGNIAADLMTRQFDHVFFTGGENIGKKVMEAASKNLTPVTLELGGKSPAVVIDGANLEVTAKRVIWGKSLNAGQTCIAPDHLLVENKLFDSLISNLINSINDFYGNTPLDSKHLGSIINEKQFNRLNNLLTQAKKNNQIIYGGDSNEKEKRISPTLIKIDNRNDPLMKEELFGPLLPILSIKNLDQAISDFKLLPKPLALYLFGGGEKEQGKVLSMTSSGGVCFNDVVLQAGIPELPFGGVGTSGMGKYHGKAGFDNFTHYKSVLKRPFWLDLNFRYPPYKLDLSLLNKLIG

SEQ ID NO: 26597 - protein, 318 aa, Shewanella sp. MR-7
MSRPIILDCDPGHDDAIALILALAHPELNPLAVTTSAGNQTPDKTLKNALRILTLLNRSDIPVAGGAVKPLSRELMIADNVHGETGLDGPALPAPSFQPQAVNAVELMAEKIRQSDKPVTLVPTGPLTNIALLLASHGELHAKIERIVLMGGAAGVGNWTPAAEFNIFVDPEAADIVFKSGIPITMCGLDVTHQAQIMDEDIERIRAIPNPVAKCVAELLDFFMIYHRAPKWGFVGAPLHDPCTIAWLLNPALFDAQDCWVGIETQSELTLGMTVVDRYQLTGKPTNATVLFGIDRQGFVDLLVDSLAVYTPTYLNRR

SEQ ID NO: 26598 - protein, 195 aa, Oryza sativa Japonica Group
MAEEKKTPCLNERILSSLSKRSVAAHSWHDLEIADADAFSLSKCCIGPGAPQVFNVVVGITKGSKVKYELDKKTGMIKVDRVLYSSVVYPHNYGFIPRTLCEDGDPMDVLVLMQGEKDDKIIAVCVDDPEFRHFNDLKELSPHRLAEIRRFFEDYKKNENKEVAVNDFLPPATAQEAIKYSMDLYAEYILHSLRR

SEQ ID NO: 26599 - protein, 904 aa, Aspergillus nidulans FGSC A4
MAASWLRLVALMLLLVPSLARNIPRAGNCTSLNRRKSWNALTRVEKTGKRAFNRDQEARLTNSEYIQAERCLMNHAPIVGNVKDAKNLWDELHDLHISQGNYVHYVGHFLPWHRYLVRAHEVLLQTLCGYKGAHPYWDEVTDYEAGPLQRSPVFDPVVGFGGNGFGRNRCIQNGPFKDTTLRIRSNERNGEYCLSRAFNQTAFTWANRRNIEECFALQKYTDAWQCYNQYPHAAGHIAVGGVMEDPTESNGDPLFYLHHAYLDRLWWRWQQADLPGRLSDMGGPNVVPPDLMRLMGMPPVSAALLDYNGDPGGETTLAHVLWMNGLVPNATVAEVMDIGGQVYSWIGCVVLSVMPSCGSCNFSKAERPDTSLMRLVQETIVGHWLICSISPSNAASQAHATTLSPSLPASPQHRASQHSISTTPGTRDMASSTEISDAESKKVTMPSGAEKFEAPPKYLPAEDGDLVAEMSERERNIYEHGTAKFNRLGWKRLTIVLIVEAIALGSLSLPSTFATLGMVAGVICTVGLGFLAIYTSYVVGQVKLKFPLVHHYPDAGKLLFGRFGYELVNFMLIFQLLFLTGSHTLTGAIAWIDITQSDVCSVVFAVVSAIILFLLAVPPSFTEMAILGYIDFASIILAIGITMIATGVESTNAPGGLSAVNWSAWPKEDITFTDAFIAMTNIIFAYSFAMCQFSFMDEMHTPSDYVKSIWALGLTEIVIYTLTGAIVYAFVGQDVQSPALLSAGHLMSRVAFGIALPVIFISGSINTVVAARVVHGRIFKDSPIRFINTKMGWITWLAMIAVGTVIAFIIAEVIPFFNDLLSISSSLFISGFTFYFPALMWFMLIREGSIFSSRKNMALAALNALCFCIGVVTLVAGTYSSIKDIIDKYNANAVRGVFSCSKPN

SEQ ID NO: 26600 - protein, 307 aa, Aspergillus oryzae
MPGLAFNPDNDIPDLSGKVIFITGGTAGLGAQSVAQMAKHSPARIYISGRNATSAEKIIKEIAETGSNTPVSFVECDLTSLDSVKRAADEIIAKESRLDVLMCNAGIMALPPGLTKDGYEVQFGTNHLGHALLIQKLLPLLQRTAERGADVRVIILTSKGYQLHPYGGIIFDDLKTTQDYGFLGSWRRYGQSKLANILYTRELARRYPAITVVSVHPGVITTGLVENLGWAHRWFIYATTYNQMVTLEEGAYNQLWAATTSKDGLETGQYYIPVGVASNDKLTKTGRDDVLAGQLWEWTDKALEDYL

SEQ ID NO: 26601 - protein, 245 aa, Methanopyrus kandleri AV19
MRPLSELDPEELIRYISESPKRTIAKFYVKTDDPEGLAERLEERLEDAKVFTGVDHVIVIGEHDDVVEVLESEDSVEYYHKELDHRNRAVPLADYSEFEDVRIEPGAIIREKVKLGKGVVVMMGAVINIGAKIGDGTMVDMNAVVGSRAEVGKNVHIGAGAVIAGVLEPPSAKPVVIEDDVVIGANAVILEGVRVGKGAVVAAGAVVTEDVPPSKVVAGVPARVVKDVDKKTEAKTQIVDALRCL

SEQ ID NO: 26602 - protein, 407 aa, Bifidobacterium longum NCC2705
MSQNESGTIAIPMYDKDDAVLVLEDGQVYVGKPYGALGETTGEIVFATGMTGYQETLTDPSYDRQIVVQTFPHIGDTGVNSEDPESSRIWVAGYIVRDPSPNVSNWRAEGSLDDDLAKNGIVGLSHIDTRKLVRHLRSAGVMRAGIFSGDALTDQATGALKTIEQLLEDVKNTPQMQGLSLYDEVSTKETYTIEPCGEYEGKEPLYTVAAVDLGIKGMTPHRMAERGCRVHVVPSTITFAEIENLNPDGVFFSNGPGDPEQAGPEIELLRQVLDAGYPFFGICFGNQLLGRALGFGTYKLKFGHRGINQPVKDLTTGKVEVTAHNHGFAVDAPIGKQVDAPFENGKYGKVFVSHIDLNDDVVEGLQCVDIPAFSVQYHPEAAAGPHDAAYLFDRFCELMKNNSKEGK

SEQ ID NO: 26603 - protein, 1154 aa, Oryza sativa
MDLSRFTAPRPGLQIGAAGNGFRACSLRRLRYRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLTVGDLAVEGIEQLESSREMSDDESTDKLLVEPQKEAEPDIDKSKQGKKQEIERKESQPSNAPKASLKRSSRFFPASFFSSKADGEFTPTSVLSGLMKSTRKHAPKLVVGIVLLGAGAFFLNRAEKSSQLFQQQEITTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLELSVERLSSMKKYVFGLGSAQVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAEDRNAEIFSANTLLVIFGTSLLTARAGLSMALGAFLAGLLLAETEFSLQVESDIAPYRGLLLGLFFMTVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 26604 - protein, 244 aa, Triticum aestivum
AWLQQLLDVAEPLLSDWHKGSPMETPKSTYTGGDFRYKAESDMTHVALAFEVPGGWLKEREATIMTVIQTLMGGGGSFSSGGPGKGMHSRLYLRVLTKYHGVQSFSAFSNVYDNTGLFGIYLTTPPDFVSKAVVIAVQELIAIATPGQVTEVELTRAKNSTISSVLMNLESRVIVAADAGGQLLTYGSRKPIDHFLQCMEELTLDDITAFAKMLLSSQPTMASYGDVDKVPPYEFVSKRFQRFR

SEQ ID NO: 26605 - protein, 442 aa, Xanthomonas campestris pv. campestris str. ATCC 33913
MLAEMPLLQTTLERELAALAFGRRYGKVVEVIGTMLKVAGVQVSLGEVCELRQRDGTLLQRAEVVGFSRTLALLAPFGELVGLSRQTRVIGLGRPLAVPVGSALLGRVLDGLGEPADGQGPLAGDDWVQIQAQAPDPMRRRLIEQPLPTGVRIVDGLMTLGEGQRMGIFAAAGVGKSTLIGMFARGTQCDVNVIVLIGERGREVREFIEMILGPDGLARSVVVCATSDRSSIERAKAAYVGTAIAEYFRDRGMRVLLMMDSLTRFARAQREIGLAAGEPPTRRGFPPSVFAELPRLLERAGMGETGSITAFYTVLAEDDTGSDPIAEEVRGILDGHLILSREIAARNQYPAIDVLGSLSRVMSQIVSAEQRQYAGQLRRLLAKHNEVETLLQVGEYRHGSDAVADEAIARIDAIRDFLSQPTDQLSDYDTILEQLAGVIDDA

SEQ ID NO: 26606 - protein, 141 aa, Brassica napus
MASSLSFVSSSHLTLRTPSLTLRKLSPPRTSVSFSVKAQSVALSQDDLKKLAAEKAVEAIKPGMVLGLGTGSTAAFAVDQIGKLLSSGELHDIVGIPTSKRTEEQARSLGIPLVALDTHPRIDLAIDGADEVDPNLDLVKG

SEQ ID NO: 26607 - protein, 421 aa, Bradyrhizobium sp. BTAi1
MAPAARTEPLSRHALAFVLAGGRGSRLLELTDRRAKPAVYFGGKSRIIDFALSNAVNSGIRRIAVATQYKAHSLIRHLQMGWNFFRPERNESFDILPASQRVSETMWYVGTADAVYQNIDILETYNTKYIVVLAGDHIYKMDYELMLQQHVDQRADVTVGCLEMPREESSGFGVMHINEDDTIRDFIEKPADPPPMPGKPDKSLASMGIYVFDAKFLFEELKRDAGDPNSNHDFGRDIIPYIVKNGRAVAHQFSRSCVRAGHDQTSYWRDVGTVDAYWAANLDLTDVVPELDLYDRSWPLWTYSEITPPAKFVHDTDGRRGEATCSLVSGGCIVSGAQVQRSLLFTGSHLHSYAKVHNAVLLPYVNVARHARLTNVVVDRGVQIPEGLVVGEDPEFDAKRFRTTENGVTLITQPMIDGLNS

SEQ ID NO: 26608 - protein, 913 aa, Yarrowia lipolytica CLIB122
MVSNSRRSASPLSVALLRFIRALIMIEARIPRCAPSSLNNLPSKHTANSISPRNLHHQHHIEHRTLRRNSTCRPRHSTNIDKKAGMTTPAHHGSSFAPAPGVSRHSQSSHSSTASSKSHSGFQSSSSMQASQAKGLPPTPTTTTPPTSFPTVNGNRRVWVCRPGATPTTVLVPAELIVDDLKSVVLAKFPTSLQRTTDPADLAIRLPQSAQPPPSRLSNSHLAPPASPALAAAAAATEEYRSATSPHLTSFTQALRKKQPAKPSPLTIKTPSQSASTAAVPQPHPLGDPLSPDINVWQLLDTHFPHGMRMDDALIIDGETVEAAQPVHAPLHHHAASPHPHHQPSHIVKQVITPHAIPQQPHLQTPGQDAFPGPPSATDEETIYDEDTKPARKRRDIGSAGSSQHSVAGAAGASSGSPSQSPAAAGTAQGGVLLLPRQFRGGTRNSDKEPSAARKKGSSPAPDDKRRQAPPQPQHQQQSQQQPPQQPAAQPPQPKPVPQQAVAASQAHQSKQPAQQAASDPPPKPTISITARPNGATITESPSNTNLHMLGKQKKEEPTVPAPPTPATATAATVAGPTGKTLRKEDTKVPAPQKTPQPGVQAQAKPELRRTRTPLSAKVQKGPTTMETIVPRVNVLIVEDNEINQKILEAFMRKRKIRSSVAKNGREALEKWRQGGYHLILMDIQLPVMSGILVTKEIRRLEHQNKIGVFSGGAGAGQSTMAPVDPEDVLDSNLFRSPVIIVALTASSLKEDKSEALAAGCNDFLTKPVNMVWLERKIMEWGCMQALIDFEGWKMWRGRDFDGAHAPAIGRALANTHLTQPVSATRSRSRSNSRLVRQNSTGTGSRSKLSMTPVASPSTAAPPSSSVSAPPAVTAATHSPAVPSKNGERPPVSNKPAPEQFRLDPPKVEVPAK

SEQ ID NO: 26609 - protein, 369 aa, Oceanobacter sp. RED65
MKKLFILSSLIIVAVYLLAWPVEIEPVAWKAPDNPGYTGSFTKNQALSQIHRLELNGEIGPEDVAIDASGMPVFGVLGGDIMRLNSNGEYESLVNTGGRPLGIEYDTQGNLWIADAYIGLLKLTPEGNLETVLTHVGDSPIRYADDLDITASGKVYLSDASTKFHAKHYGTYAASLLDINEHGGHGRVIEYDTNTKQAMVILDGLNFANGVAVSHDEEWVLVNETAKYRVLKIGIAEHNRQHQQVVIDNLPSFPDNINPGSNSLYWVGLVSPRSAPLDALSEYPYLRKVVQRLPAFMRPKAKHYGHLIAINDQGKVVHDLQDPLGMYGHVTGAAEAGEVLYVSSLHETALGKTVNLNQSKQTLIEPQTP

SEQ ID NO: 26610 - protein, 181 aa, Triticum aestivum
  misc_feature (17)..(17): Xaa can be any naturally occurring amino acid
  misc_feature (70)..(70): Xaa can be any naturally occurring amino acid
  misc_feature (85)..(85): Xaa can be any naturally occurring amino acid
  misc_feature (88)..(88): Xaa can be any naturally occurring amino acid
  misc_feature (97)..(97): Xaa can be any naturally occurring amino acid
  misc_feature (136)..(136): Xaa can be any naturally occurring amino acid
  misc_feature (140)..(140): Xaa can be any naturally occurring amino acid
DELSKVYANEFLGQRIXSVIFMLVMCEVCAINVLEVSYFIGKYSRIGIKFISISVGFGGSKFQKDILTTXEYFCESIVLLEVATXWKXRVIKHQRYXQKIRFVKRVVSCMSFTVFVKKMAVFGFTFKKFTGVSREXPAIXVCKGLVVDKSQVTISGSQATEDQIQRDLSMNKLGWEADGGT

SEQ ID NO: 26611 - protein, 345 aa, Bradyrhizobium sp. BTAi1
MKALVYHGPGQKSVDERPKPTILEPGDAVVKILKTTICGTDLHILKGDVPTCTPGRILGHEGVGVVEAVGSAVRAFKPGDHVIISCISACGTCDYCRRGMYSHCRHGGWILGNKIDGTQAEYVRTPHADTSLYHVPPGTEEEALVMLSDILPTGFECGVLNGKVEPGSTVAIVGAGPIGLAALLTAQFYSPAEIIMIDLDDNRLEVAARFGATSTINNADGKAVEKVMALTHGRGVDTAIEAVGVPATFVTCEDIIAPGGTIANVGVHGVKADLHLEKLWDRNIAITTRLVDTVTTPMLLKTVQSKKLEPKLLITHRFRLDQILDAYETFGAAARTHALKVLIEA

SEQ ID NO: 26612 - protein, 398 aa, Thiobacillus denitrificans ATCC 25259
MNPRLDQLHPYPFQKLRELLAGTEPNPELAAINLSIGEPKHPTPGFIRDALVGGLDGLANYPITQGSDALRAAIAGWAARRYGVTLDPASEVLPVNGSREALFAFAQAAVDSTRHGRRTVVSPNPFYQIYEGATLLAGARPFFLNTLPENGFTMDWSRVPEDLWDSISLVYVCSPGNPTGKVMTLDEWRTLFALADRHGFVIAADECYSEIYFDEAHPPLGALTASHQLGRGCRNLVVFNSLSKRSNVPGLRSGMVAGDAEVLKKFLLYRTYHGSAMSPAVQAASIAAWNDEAHVLDNRRQYAAKFAAVIPLLRDVLSFDAPDAAFYLWARVPGGDDAAFARGLYAQQHVTVLPGSFLARDAAGANPGKGFVRIALVDTLDACVEAAERIAAFVTEAA

SEQ ID NO: 26613 - protein, 489 aa, Saccharomyces bayanus
MSADFGLIGLAVMGQNLILNAADHGFTVCAYNRTQSKVDHFLANEAKGKSIIGATSIQDFISKLKRPRKVMLLVKAGAPVDALIKEIVPLLEKGDIIIDGGNSHFPDSNRRYEELKKHGILFVGSGVSGGEDGARYGPSLMPGGSEEAWPHIKNIFQSISAKSDGEPCCEWVGPAGAGHYVKMVHNGIEYGDMQLICEAYDIMKRLGGFTDKEISEVFTTWNKGVLDSFLIEITRDILKFDDVDGKPLVEKIMDTAGQKGTGKWTAINALDLGMPVTLIGEAVFARCLSALKNERVRASKVLPGPQVPKDAVKDRKQFVDDLEQALYASKIISYAQGFMLIREAAATYGWKLNNPAIALMWRGGCIIRSVFLAEITKAYRQEPDLENLLFNKFFADAVTKAQSGWRKSIALATTYGIPTPAFSTALTFYDGYRSERLPANLLQAQRDYFGAHTFRVLPECASENLPEDKDIHINWTGHGGNVSSSTYQA

SEQ ID NO: 26614 - protein, 380 aa, Burkholderia vietnamiensis G4
MERASGRKAVIVGGSVGGLFAATALRARGWHVRVFEQSARELDSRGGGIVLQPPIERAFAFGGVALPANAGVDSIERIYVDAQDRVVQRLTMPQTQTGWNVIYTALKHALPDDVIHAGDAFERFQQDGERVVAQFASGRVETADLLIGADGARSTVRAQLLPDVRPAYAGYVAWRGLVDEHALPEQVLYLLRERFTFQQGGAHLFLTYLVPGADGAIEPGKRRVNWVWYRRLASERLPSLFLTRDGTQRDGSLPPGAMRDDNRAELVDAADRMLAPTLATLVDTTPAPFAQAIYDLAVERMAFGRTVLLGDAACVVRPHTAAGVAKAADNAVALAAALHDVAPGAAFDAALATWDADQRAASALVSARGIALGARLMGAA

SEQ ID NO: 26615 - protein, 757 aa, Idiomarina loihiensis L2TR
MMLVTLQRIVQGVNKAPDFNMALTTMVSQVREALETDSCSVFLADNDQRQFVMAASDGLRAEDGKPVRVDFGEGIISLAAQREEPLNIADASMHPANKKLSDTNENIYKGLLAAPIIHRRKVLGIVVVHQSVARSFSREEEAFIVTLAAQLAAVIAHADAKGLLVSEHSPWIHSLRGLPGSPGVAVGEAYVSRPEARIDEVTPRRSDKPIHEIRKFRQAVARTRADLKELSRRMAGQVPDDTLAIFDVYQGMLDAASMGDAVENMIKEGWRAQTALKYVVEQFVAQFEALEDSYLQERATDVRDIGQRVLLHLQNRQRKRKPLPDNFILIADEVTASMLAELPREQIAGIISLNGSSNSHAAIMARSMNIPAVLGVDDIELHFFSDRLLAVDGYTGEIYVDPPAQVLTQFHQLAEEEQELRDIVTEHSHLPAETQDGQRISLHLNLGLDVTHDYLKTLNIDGVGLYRSEIPFMMRDQLPTEDEQTEMYQEVLDQFPDQPVVMRTLDVGGDKPLPYFPLKEDNPFLGWRGIRLTLDHPEIFLIQIRAMLRASIGKSNLRILLPMITSTSEVDEASRLIKQAYFEVAEEQGCEVGVNLFQPQLGVMIEVPAAIYQLPAMASKVDFFSVGSNDLTQYLLAVDRNNRRVASLYDAYHPAVLASLDEIARRCEEIGKPVSVCGELAGDPGGALLLVAMGYRQLSMNSYNVDRVRWILRNVRSSTLNVMLAKALQARNPDQIRKMIAEKMESIGLGGFVRAGK

SEQ ID NO: 26616 - protein, 261 aa, Saccharomyces bayanus
MSKAVGDLGLVGLAVMGQNLILNAADHGFTVVAYNRTQSKVDRFLANEAKGKSIIGATSIEDLVAKLKRPRKIMLLIKAGAPVDILIKELVPHLDKGDIIIDGGNSHFPDSNRRYEELTKQGILFVGSGVSGGEEGARFGPSLMPGGSKEAWPHIKNIFQSIAAKSDGEPCCEWVGPAGSGHYVKMVHNGIEYGDMQLICEAYDIMKRLGGFTDKEISEVFTKWNTGVLDSFLIEITRDILKFDDVDGKPLVEKIMDTAGQ

SEQ ID NO: 26617 - protein, 209 aa, Coccidioides immitis RS
MANYLASIFGTEQDKVNCSFYYKIGACRHGDRCSRKHVKPSYSQTILLPNMYQNPAFDPKNKMNPSQLQNHFDAFYEDFWCEMCKYGELEEVVVCDNNNDHLIGNVYARFKYEDSAQKACDALNSRWYAARPIYCELSPVTDFREACCRLNSGEGCVRGGFCNFIHRKEPSAELERDLELSTKKWLKLRGRDERSVSRSPSPEPSKRRH

SEQ ID NO: 26618 - protein, 390 aa, Enterococcus faecalis
MLEEVLAIHQKNIGVLSLEATEAVLNHHDLAKMYTPGVAELSLMIAQNHELAREWTISGKLIAVITDGSAVLGLGNMGTQAGLPIVEGKALLYKNLAGVDAIPLALEQKSVDEMVQTIENLQNSFAGIHLEDISAPKCFEIEEKLQQRLNIPVYHDDQEGTAIVVLAGLINAAKIKGKPLNELRVVINGVGASGVATAKLCIQAGITHLTLVDRQGVLREEDPTLNPYQRALLRQVIKPSVENKDLATAVVNQDVFLGLSEADVLTPALIKSMNQDPIIFALANPKPEIEPDLAQANGVRLLATGSSKYPNQVNNILAFPGLFKGLLAAKGRKVDVGLQMTVARSLAAMISEPTAEKFIPNVFDGGVVDTVFNAVLDYIKQEKTTAEEGT

SEQ ID NO: 26619 - protein, 165 aa, Saccharomyces bayanus
SLYASKIISYAQRFMLIREAAATYGWKLNNPAIALMWRGGCIIRSVFLAEITKAYRDDADLENLLFNDFFASAATKAQSGWRRSIALDATYGIPTPAFSTALAFYDGYRSERLPANLLQAQRDYFGAHTFRVLPECASANLPVDRDIHINWTGHGGNISSSTYQA

SEQ ID NO: 26620 - protein, 378 aa, Thermosynechococcus elongatus BP-1
MLIALILAAAIALCNGLSSAQLAASHPVSGGTYEYGYHYLSPPFGFTAGWMFLVAKSASAATAALGSVAYLYQWLGLEDSSGRWQVMAALGLLAVLTGVVLLGIRRSTQVNLGILLVTFTSLLLFVGIGHLQQRGGSPWLATSQPLSLKHLLQATALLFVAYAGYARIAVLAEEVKTPRQTIPRAIVLTIVIALLLYLSVAWVVLGSHHSGNLTTAASLAVVASRFGVPWLPPLMALGAIAALVGILLNLLLGLSRVVLAMARRRDLPPTLAQIPPQGKQPVAAILAVSGGIALLILLGNVQTTWSFSAFSVLIYYAITNLAALQLQEPQFPRWLAVAGLIGCLGLAFWVEVQVWVSGCGLLLLGLAWHYWMRRAKAL

SEQ ID NO: 26621 - protein, 773 aa, Ralstonia solanacearum GMI1000
MNDKLHDASPDTLDKGAEAELRRAALEYHRSPTRGKIEVRSTKTLINQRDLSLAYSPGVAYACTEIERDPSLAAEYTSRANLVGVITNGTAVLGLGDIGPLAGKPVMEGKGCLFKKFAGVDVFDIELAERDPDKLVDIIASLEPTLGGINLEDIKAPECFYIEQKLRERLNIPVFHDDQHGTAIISSAALLNGMKVVGKQIGEVKVAVSGAGAAAIACLDLMVSLGVKRENVFVVDSKGVIYAGRDAKMEPNKARYAQDTAARTLADIVRDADVFLGCSAAGVLTADMVKTMAPNPIILALANPEPEIRPEIAKAARPDCIIATGRSDYPNQVNNVLCFPYIFRGALDCGATKITEAMKLACVKAIAELAEAETNDAVAQAYAGQELNFGPDYIIPKPFDSRLIEKIAPAVAKAAMESGVATRPIADLDAYRHQLNDFVYHTGMTMRPVFSAAKAAPKRVVYAEGEEERVLRAVQTVIDEGLAKPILVGRPHVIEMRIQKAGLRLKPGVDFELVNPEDDPRYHQYHTAYHELMGRNGVTPDMAKSALRRSNTLIGALLVRLGDADAMLCGTVGRFDAHLEHVRDVIGLAPNAKVFAAMNGLMLEKHTLFIADTFVNEDPTAEELAAITELAAEEVRRFGLEPKVAMLSHSMFGSSKSKSARKMRAAYDLLKTQAPSLQVEGEIQGDAALVEDIRHHFLPKSAFAGSANLLVMPTLDAANIAFNLLKITGGHGVTVGPILLGAAKPVHILNPAATSRRIVNMTALAVADVSATR

SEQ ID NO: 26622 - protein, 338 aa, Ralstonia solanacearum GMI1000
MKRINLTRYLIEEQREHNTIPAELRLLLEVVARACKAISHSVNKGALAGVLGSAGTGNVQGETQQKLDVIANEVLLEANEYGGNLAAMASEEMESFYEIPHRYPKGEYLLLFDPLDGSSNIDVNVSIGTIFSVLHMPKPGQTVTEADFMQPGVRQVAAGYAVYGPQTTLVLTVGNGVHMFTLDREVGSFILTNRDVKIPADTKEFAINMSNMRHWAPPVRRYIDECLAGTEGPRGKDFNMRWIASMVADVHRILTRGGIFMYPWDKREPGKAGKLRLMYEANPMAFLVEQAGGAATNGHQRILEIQPEKLHQRVAVILGSKNEVDRVTQYHREAQQTA

SEQ ID NO: 26623 - protein, 592 aa, Cryptococcus neoformans var. neoformans B-3501A
MAPIDYSRLHPSHDPQFSPFPSRRSTVFSTKGAVATSQPLAAQVGLEILNKGGNAADAAVATAAALNVCEPSMTGIGGDVFCLFYDAASRTVKGVNGSGRSPKALTLEYLRSQGITGDAIPLTNLNAVTVPGAAAGWLKTIEEFGSGKLSMREILEPAIRLAREGVPQYELSSNQWQIAEQLIKQASSNWREMMMPDGNPPRPSYVMTHNTLADTLEEVADHGHDGFYKGRIAQAIVDLVKSGGGVMTLEDLAECTADVIQPISYTFKPHHPPNHEEPSDPGLTLWECPPNGQGITALMALGIIEAVEEVHGIDVLEIEHNGKLYLHILIESLRLAFADTRYYVTDPDVEHVPMKELLSKEYLRKRASLIDLNKSSTIRHGTPVQSSDTVYLATADKEGNSCSFIASNYAGFGTGAIPKGCGFTLQNRGTGFTLIEGHPNCIKGGKRPYHTIIPGMVTHGDDLMMSFGVMGGFMQPQGHIQVLLNKLRGFSNQSTLDAPRFCISAGLPDNGVKNAEQGAGDIDSEIWFEDGIDTKVIEELRAMGHQCEIAEGYERKIAGKGQIIQRVVDPNGRRVWACGSDLRGDGCAVGQI

SEQ ID NO: 26624 - protein, 386 aa, Arabidopsis thaliana
MKKIFATKLLRPQVLENSRGVRAEELKRFYRRILDKARKNENIEISKESAMLMNNILCRMSMGRSFSEENGEAERVRGLVGESYALVKKIFFAATLRRLLEKLRIPLFRKEIMGVSDRFDELLERIIVEHKDKLEKEHQVMDMMDVLLAAYRDKNAEYKITRNHIKSFFVDLFVGGTDTSVQTTQWTMAEIINNPNILQTLRKEIDSVVGKSRLIHETDIPNLPYLQAVVKEGLRLHPPGPLLIRTFQERCEMKGFYIPEKTTLVINAYAVMRDPDSWEDPDEFKPERFLSYSRSGQEDEKEQTLKYLSFGGGRRGCPGVNLGYIFVGTAIGMMVQCFDWKIEGDKVNMEETYGGMNLTMVNPLKCTPVPRTQPFSFTSNLEILSS

SEQ ID NO: 26625 - protein, 362 aa, Pseudomonas fluorescens bv. A
MKSALKTFVPGALALLLLFPVAAQAKEVETKTKLANVVILATGGTIAGAGASAANSATYQAAKVGIEQLIAGVPELSQIANVRGEQVMQIASESINNENLLQLGRRVAELADSKDVDGIVITHGTDTLEETAYFLNLVEKTDKPIIVVGSMRPGTAMSADGMLNLYNAVAVAGSKDARGKGVLVTMNDEIQSGRDVSKMINIKTEAFKSPWGPLGMVVEGKSYWFRLPAKRHTMDSEFDIKTIKSLPDVEIAYGYGNVSDTAVKALAQAGAKAIIHAGTGNGSVSSKVVPALQELRKQGVQIIRSSHVNAGGFVLRNAEQPDDKYDWVVAHDLNPQKARILAMVALTKTQDSKELQRMFWEY

SEQ ID NO: 26626 - protein, 370 aa, Shewanella sp. MR-7
MTNANVDATQLTTKPSQDGFYMPAEWAAQQAVWMIWPYRPDNWRSAGAYAQATFAKVADAIGGATPVYMGVPQAFLAEAQKVMPSHVTLVEIDSNDCWARDTGPTVVVNAEGECRGVDWGFNAWGGHNGGLYFPWDKDEQVAAQMLKQHGFARYSAPLILEGGSIHVDGEGTCMTTAECLLNANRNPDLTKEQIEALLRDYLNVKQFIWLEEGVYMDETDGHIDNMCCFARPGEVVLHWTDDETDPQYPRSKAALDVLQNTVDAQGRKLKIHLLPQPGPLYCTEEESKGVTEGTGVPRTAGERLAGSYVNFLITNDRIVFPLLDPATDDIAAQKLQDIFPEHKIVGVPAREILLGGGNIHCITQQIPSGK

SEQ ID NO: 26627 - protein, 454 aa, Desulfitobacterium hafniense Y51
MKNFSISEVMDSFGVNKFTWSIFFFLGLAMVFDGYDYMIVSYTMPQISAEWGLSAVEKGSLSSWSLFGLIIGGAISGIVSDKIGRKKTLVYSIAIYSLLNIPIFFAPSFGFYALFRVLAGLGLGACIPVVTTIFSESTPTNRRALFITFGMAWMIVGWVLAGLVATYLVPRVGWRWCYLVGGFPFIYSIFLHFKMKESVYWLANKGRKEDAVKRLQEIEKVATGKVTHWDPNALVVPPKSKVVGPKALFSKTYRMTTAGVWITYFCGCFTVYGINAWLPSLMLEKGLQLSSAYGLSIAQNAAAVIANCSTGFVAEIIGRRKNLIGSYGLGIVAILIMAFVGSSFWAILAANIFLGFAINYSITAVQPLMAEGYPTDIRNTGVSWCQAFGRLGGALAPIVAGLIIGLNLGYSSAFLFYIVPLICGLLAAFLLIRNETKGKSIDQIQEENVLKAGS

SEQ ID NO: 26628 - protein, 255 aa, Oceanobacter sp. RED65
MSTELFNLSGKVALVTGASRGIGESIAKLLAEQGAHVIVSSRKIEGCQAVVDQITEAGFSAEAIPCHIGELEQIASLFAEIKEKHGKLDVLVNNAATNPFFGHILDTDLMAYQKTVDVNIRGYFFMCVEGGKLMKANGGGSIINVASVNGVIPGSLQGIYSITKGSVITMTKSFAKECAQLGIRVNALLPGATDTKFAATLVKNPQILEKALEHIPMNRVAEPDEMAGTVLYLASDASSYTTGACINVDGGYLIG

SEQ ID NO: 26629 - protein, 619 aa, Clostridium acetobutylicum ATCC 824
MYNILDNYEDVDDIKNMSSDELKEFASEIRKFLIDKISKTGGHLASNLGVVELTLSLHKVFNLKKDKIIWDVGHQAYVHKILTGRKDKFDSLKQFNGLSGFPKRNESIYDAFETGHSSTSISAASGIARARDLSKDNYDVIAVIGDGALTGGMALEALNDIGYKKTNVIIILNDNQMSIAKNVGSISKYLNKIRLDPKYNKLKKDVKTKLQRTNIGSEVANSIERIKGGIKQMVVSGMFFEDIGIKYLGPIDGHNIEELTSVISKAKEIKGPVILHVKTQKGKGYSYAEENPNKFHSIGKFNSKTGEALSKPKDTYSKAFGKAMVQMAENNDKIVAITAAMTDGTGLCEFSKKFPQRFFDVGISEQHAVTMAAGLAATGYKPVFAVYSTFLQRAYDQVLHDVCIQKLPVVFAIDRAGIVGEDGETHQGVFDISYLSSIPNMTIMAPKCVEELNYIMNWAVKQNYPIAVRYPKGGNDISDVLAPLKEFRHGKWEILKDGKDVAIVAVGKMVQRAMVVRDELLKYGIDCAIINATFIKPIDKDTLNRFARDNYKFVVIEDNVLHGGIGSLILEHLNDMKFKNDVLNLGFKDEFITHGNIEILYKLYDLDIEGICKRIISFK

SEQ ID NO: 26630 - protein, 3562 aa, Micromonospora megalomicea subsp. nigra
MTDNDKVAEYLRRATLDLRAARKRLRELQSDPIAVVGMACRLPGGVHLPQHLWDLLRQGHETVSTFPTGRGWDLAGLFHPDPDHPGTSYVDRGGFLDDVAGFDAEFFGISPREATAMDPQQRLLLETSWELVESAGIDPHSLRGTPTGVFLGVARLGYGENGTEAGDAEGYSVTGVAPAVASGRISYALGLEGPSISVDTACSSSLVALHLAVESLRLGESSLAVVGGAAVMATPGVFVDFSRQRALAADGRSKAFGAAADGFGFSEGVSLVLLERLSEAESNGHEVLAVIRGSALNQDGASNGLAAPNGTAQRKVIRQALRNCGLTPADVDAVEAHGTGTTLGDPIEANALLDTYGRDRDPDHPLWLGSVKSNIGHTQAAAGVTGLLKMVLALRHEELPATLHVDEPTPHVDWSSGAVRLATRGRPWRRGDRPRRAGVSAFGISGTNAHVIVEEAPERTTERTVGGDVGPVPLVVSARSAAALRAQAAQVAELVEGSDVGLAEVGRSLAVTRARHEHRAAVVASTRAEAVRGLREVAAVEPRGEDTVTGVAETSGRTVVFLFPGQGSQWVGMGAELLDSAPAFADTIRACDEAMAPLQDWSVSDVLRQEPGAPGLDRVDVVQPVLFAVMVSLARLWQSYGVTPAAVVGHSQGEIAAAHVAGALSLADAARLVVGRSRLLRSLSGGGGMSAVALGEAEVRRRLRSWEDRISVAAVNGPRSVVVAGEPEALREWGREREAEGVRVREIDVDYASHSPQIDRVRDELLTVTGEIEPRSAEITFYSTVDVRAVDGTDLDAGYWYRNLRETVRFADAMTRLADSGYDAFVEVSPHPVVVSAVAEAVEEAGVEDAVVVGTLSRGDGGPGAFLRSAATAHCAGVDVDWTPALPGAATIPLPTYPFQRKPYWLRSSAPAPASHDLAYRVSWTPITPPGDGVLDGDWLVVHPGGSTGWVDGLAAAITAGGGRVVAHPVDSVTSRTGLAEALARRDGTFRGVLSWVATDERHVEAGAVALLTLAQALGDAGIDAPLWCLTQEAVRTPVDGDLARPAQAALHGFAQVARLELARRFGGVLDLPATVDAAGTRLVAAVLAGGGEDVVAVRGDRLYGRRLVRATLPPPGGGFTPHGTVLVTGAAGPVGGRLARWLAERGATRLVLPGAHPGEELLTAIRAAGATAVVCEPEAEALRTAIGGELPTALVHAETLTNFAGVADADPEDFAATVAAKTALPTVLAEVLGDHRLEREVYCSSVAGVWGGVGMAAYAAGSAYLDALVEHRRARGHASASVAWTPWALPGAVDDGRLRERGLRSLDVADALGTWERLLRAGAVSVAVADVDWSVFTEGFAAIRPTPLFDELLDRRGDPDGAPVDRPGEPAGEWGRRIAALSPQEQRETLLTLVGETVAEVLGHETGTEINTRRAFSELGLDSLGSMALRQRLAARTGLRMPASLVFDHPTVTALARYLRRLVVGDSDPTPVRVFGPTDEAEPVAVVGIGCRFPGGIATPEDLWRVVSEGTSITTGFPTDRGWDLRRLYHPDPDHPGTSYVDRGGFLDGAPDFDPGFFGITPREALAMDPQQRLTLEIAWEAVERAGIDPETLLGSDTGVFVGMNGQSYLQLLTGEGDRLNGYQGLGNSASVLSGRVAYTFGWEGPALTVDTACSSSLVAIHLAMQSLRRGECSLALAGGVTVMADPYTFVDFSAQRGLAADGRCKAFSAQADGFALAEGVAALVLEPLSKARRNGHQVLAVLRGSAVNQDGASNGLAAPNGPSQERVIRQALTASGLRPADVDMVEAHGTGTELGDPIEAGALIAAYGRDRDRPLWLGSVKTNIGHTQAAAGAAGVIKAVLAMRHGVLPRSLHADELSPHIDWADGKVEVLREARQWPPGERPRRAGVSSFGVSGTNAHVIVEEAPAEPDPEPVPAAPGGPLPFVLHGRSVQTVRSQARTLAEHLRTTGHRDLADTARTLATGRARFDVRAAVLGTDREGVCAALDALAQDRPSPDVVAPAVFAARTPVLVFPGQGSQWVGMARDLLDSSEVFAESMGRCAEALSPYTDWDLLDVVRGVGDPDPYDRVDVLQPVLFAVMVSLARLWQSYGVTPGAVVGHSQGEIAAAHVAGALSLADAARVVALRSRVLRELDDQGGMVSVGTSRAELDSVLRRWDGRVAVAAVNGPGTLVVAGPTAELDEFLAVAEAREMRPRRIAVRYASHSPEVARVEQRLAAELGTVTAVGGTVPLYSTATGDLLDTTAMDAGYWYRNLRQPVLFEHAVRSLLERGFETFIEVSPHPVLLMAVEETAEDAERPVTGVPTLRRDHDGPSEFLRNLLGAHVHGVDVDLRPAVAHGRLVDLPTYPFDRQRLWPKPHRRADTSSLGVRDSTHPLLHAAVDVPGHGGAVFTGRLSPDEQQWLTQHVVGGRNLVPGSVLVDLALTAGADVGVPVLEELVLQQPLVLTAAGALLRLSVGAADEDGRRPVEIHAAEDVSDPAEARWSAYATGTLAVGVAGGGRDGTQWPPPGATALTLTDHYDTLAELGYEYGPAFQALRAAWQHGDVVYAEVSLDAVEEGYAFDPVLLDAVAQTFGLTSRAPGKLPFAWRGVTLHATGATAVRVVATPAGPDAVALRVTDPTGQLVATVDALVVRDAGADRDQPRGRDGDLHRLEWVRLATPDPTPAAVVHVAADGLDDLLRAGGPAPQAVVVRYRPDGDDPTAEARHGVLWAATLVRRWLDDDRWPATTLVVATSAGVEVSPGDDVPRPGAAAVWGVLRCAQAESPDRFVLVDGDPETPPAVPDNPQLAVRDGAVFVPRLTPLAGPVPAVADRAYRLVPGNGGSIEAVAFAPVPDADRPLAPEEVRVAVRATGVNFRDVLLALGMYPEPAEMGTEASGVVTEVGSGVRRFTPGQAVTGLFQGAFGPVAVADHRLLTPVPDGWRAVDAAAVPIAFTTAHYALHDLAGLQAGQSVLVHAAAGGVGMAAVALARRAGAEVFATASPAKHPTLRALGLDDDHIASSRESGFGERFAARTGGRGVDVVLNSLTGDLLDESARLLADGGVFVEMGKTDLRPAEQFRGRYVPFDLAEAGPDRLGEILEEVVGLLAAGALDRLPVSVWELSAAPAALTHMSRGRHVGKLVLTQPAPVHPDGTVLVTGGTGTLGRLVARHLVTGHGVPHLLVASRRGPAAPGAAELRADVEGLGATIEIVACDTADREALAALLDSIPADRPLTGVVHTAGVLADGLVTSIDGTATDQVLRAKVDAAWHLHDLTRDADLSFFVLFSSAASVLAGPGQGVYAAANGVLNALAGQRRALGLPAKALGWGLWAQASEMTSGLGDRIARTGVAALPTERALALFDAALRSGGEVLFPLSVDRSALRRAEYVPEVLRGAVRSTPRAANRAETPGRGLLDRLVGAPETDQVAALAELVRSHAAAVAGYDSADQLPERKAFKDLGFDSLAAVELRNRLGVTTGVRLPSTLVFDHPTPLAVAEHLRSELFADSAPDVGVGARLDDLERALDALPDAQGHADVGARLEALLRRWQSRRPPETEPVTISDDASDDELFSMLDRRLGGGGDV

SEQ ID NO: 26631 - protein, 158 aa, Aeropyrum pernix K1
MGLEEGYDDVLVRDIMSSPPITTLPMTSVKEAAKIMLENRVGSLIVVNERNTLLGILTKTDIIREVVAKGLDPESVRVGDIMTRNPYYVYTDDSVERAASLMGEHNIGHLPVLDPETEKPVGIVTKTDIVKLAPNYINVIYSLKQEIDRRERLKRIRK

SEQ ID NO: 26632 - protein, 481 aa, Prochlorococcus marinus str. MIT 9211
MSEANFEFDLIVIGAGYGGFDAAKHAAEHGLSVAIIESREMGGTCVNRGCVPSKALLAASGKVRELADAEHLSSFGIHAAPVRFERRKIAEHANQLVKNIRNNLTKALERSGVKILRGYGRIEGTQKVGLRESNGVDRLISAKDIVIATGSDPFVPPGIETDGRTVFTSDEAINLEWLPRWIAIIGSGYIGLEFADVYTALGCEVTMIEALERVMPTFDTDIAKIAGRNLIQGRDIDARAGVLASKVSPGCPVKIELSDVKNRELLEELEVDAVLVATGRVPTSAGLNLESVGVKTNRGYIPIDDSMRVLVDGKPLKNLWAVGDVTGKLMLAHTAAAQGTVAVDNILGKNREIDYRSIPAATFTHPEISSVGMAESEAKEFAEKNNFELGIVRSYFKANSKALAELESDGLMKLLFRKDNGEVLGAHIYGLHAADLIQEVANAVARRQKVNELAIEVHTHPTLSEVIEVAYKQAVAQLKQS

SEQ ID NO: 26633 - protein, 262 aa, Bacillus cereus G9241
MPMIGLGVYKAKEGDEVKRAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKVKPMVNQVELHPMLTQFELRNFCQGEQIQMEAWSPLMRGGEVFQHPIIQAIATKYEKTSAQVILRWDIQSGVVTIPKSVTPSRIQENFSIFDFSLTEEEMTQINTLNRNLHVGTNPDKYDTL

SEQ ID NO: 26634 - protein, 263 aa, Idiomarina loihiensis L2TR
MSEEVPDQRFGGVSRVYGQASLTQFQQLHIVVAGLGGVGSWAVEALARTGIGKLTLIDLDDVCVTNINRQLPATDDTIGQLKSEVLAQRVKSINPNCEVRVIDDYLLPENFEEYLTGADAVLDAIDSVNTKSALVAWCKRRKLRIVVCGGAGGQIDPGMIRVGDLAKAKQDPLLAKVRSQLRRDYGFSKNPKRKWGVDCVYSEEQLRYPIISGEQEGEVTLQKPGSGSMRMDCSSGFGAAMVVTCSFAMQATAILLKRLSHLT

SEQ ID NO: 26635 - protein, 219 aa, unidentified eubacterium SCB49
MSNIIIAPSMLAADFANLQRDVEMVNASEADWFHIDVMDGHFVPNISYGMPVIQAIKKHATKPLDVHLMIEKPERYIEEFAKVGADIITVHYESTVHLHRTLTQIEDAGCKAGVVLNLTTPVSVLEDILPKCYMVLIMSINPGFGGQKFEEITYNKVKKLRKMIDEQGLDTHIEIDGGVTDKNAKKLMDAGATALVAGSYIFKSENPTETIKGMKKLLS

SEQ ID NO: 26636 - protein, 408 aa, Deinococcus radiodurans R1
MSAPASSAPRLRLRVSKAAELHIRDGHPWVYESSVREQNREGEPGELAVVYDRRDRFLAIGLYDPFSPLRLRVLHTGMPTQLDDAWWAARLDAALARRAALFGPLTAFGDTDGYRVLNGESDGFPGLVVDRYAGVLVMKLYTAAWFPHLRRMLELFAARAPDFAVVLRLSRNIAERAADLGLHDGQVIYGELAGDSVVFRESGLRFEAEVRQGQKTGFFLDQRENRRRVEGLSEGRRVLNAFSFSGGFSLYAARGGASEVTSLDISAHALRSAERNFALNPELSAVHKTVQADVFEWLPAGKGSGADYDLVILDPPSLARREAEREGAIRAYGKLAEGGLTRLAPGGILVSASCSAHVSAEEFEEAVMSAVRRSGRRWRKLLSSRHAPDHHASFAEAEYLKAVFLQMD

SEQ ID NO: 26637 - protein, 489 aa, Burkholderia vietnamiensis G4
MTSYDQSPVRHLLEAGRLERFFIDGDWVAPDGGGRFAVVCPSTEDTLCEIPLGSARDADRAVQAARHAFAGWAATSPQERAALLDRVHRLLLERAERFATALALEMGAPLGYARSAHVPLAAEHIRVARDNLTDYPFRKQRGTTAIVREPIGVCALITPWNWPIYQITAKVGPALAAGCTVVLKPSELSPLSALLFAEVLADAGVPAGVFNLVSGTGAEVGAALSSHPLVDMVSITGSTRAGVLVAQAAAPTVKRVAQELGGKSPNVVLPDADLERAIAPGVAAAFRNMGQSCSAPTRMIVPRAALGAVEALAVAAAQRCVVGDPFADATTHGPLANRAQFERVAQMIDVGVAEGAKLIAGGPGRPAGCERGFYARPTIFSDVRTGMAIAQQEIFGPVLAILPYDSIDEAVSIANDTVYGLGAHVQGTDRERTRAVAARIRAGQVHLNYPAWDPQAPFGGYKQSGNGREYGVEGMEEYMEVKSILGYYD

SEQ ID NO: 26638 - protein, 164 aa, Zea mays
KLLHEDPYTAGEIEKITGEGLTSVFQGSQTSLDVIKAAKHYKLFQRATHVYSEARRVYAFRDTVSSKLSEEGKLKKLGDLMNESHYSCSVLYECSCPELEELVKVCRDNGALGARLTGAGWGGCAVALEMYYKSRIDRGVIKQGDVGLYVFASKPSSGAAILRL

SEQ ID NO: 26639 - protein, 329 aa, Shewanella sp. MR-7
MQVSPRGTASAKLTDFLELANQNIALAKQQNIQYSPQLLRENLNKLAALMSAKPEVSYIADKAWQVKDAQHGDREIGCRVYSPAPNTALPVVLHFHGGGHMCGSVELYDPICRHLASIAQCVVISVEYRLAPEHPYPAGLEDCEYALRHYQSVLTEVQYQQGVSIMGDSAGGALCTSLSQRSLSDSTLNIAKQILVYPSVDYTMASASYQSNGAGFLLETPRVQWYFEQYFQEVAKDAERVKQASPLHGEFNAKLPSTLIFTVGCDPLRDEGIAYANALTAAGVQVQHHQFEDMIHAYMLLQDLVSQECLATYRMIAAFLAEPVTSVTR

SEQ ID NO: 26640 - protein, 441 aa, Oryza sativa Japonica Group
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 26641 - protein, 395 aa, Coccidioides immitis RS
MADTINATMIYCHQCSQRWPRSEHGLSCPHCQSEFVEFIGEDEPLPRDSPSPPQEPINDHYGMPQNPFEQYLGENITRHQYRSGDGRVTYTSTTIRSPMRGMPFQRQPPQGMPGSDPLIPLFANLNALFQGIVASGNQPQPLPANEPPGIRSDFRGQQNHGEEHTTPVATVDDILRMLQQDFMERNARPRDPSGRIGGVPLVAPNPLEIVARIMGLGRHGDAVYSQEELDRVISELIEQTANSNAPGPASEEAIQALPKKQVDKTMLGHDGKAECSICMDSVQIEEEVTELPCKHWFHGNCISAWLVEHDTCPHCRRGIMETYRQNQSSQDSAASQSSSSPPGLGSRSNPYIVSDDPSESNGAHNNQQPPSGGGGNGRFAWWMRTHFGGGGNSGS

SEQ ID NO: 26642 - protein, 299 aa, Desulfitobacterium hafniense Y51
MKIIYDCDNTMGVPGCDIVDGLSLLYLLGKEELDICAITTTYGNSKVDIVYQNTVNMLSEIGRRDIPVYKGCTNRYGLDSEATDYLVKMVNDHPGEISILATGALTNLYAAYIKDQNFFRKLDRLVVMGGLTHDVIPDGKAFDEWNLSVDPAATHWVLKEGKDLFLITRDMDINVSVSTADFIHRLTRNRSPIGRYIVERSISWLEYTMLHLKSNCFYLGDLVAAVYLVNPQFFEDQQQIISLSTKTISKGLLCPTDNRQEGQTIHLPTLRHRDDFVEDIYTTWLKADCGFVKEIGGGW

SEQ ID NO: 26643 - protein, 402 aa, Triticum aestivum
  misc_feature (398)..(398): Xaa can be any naturally occurring amino acid
RSRAAPTYRSSSRPPASAIKAYLGELIEQVCTKKQAGTGPEFPGYRRPLPSRFTRRTSRVRHDPRRRPPDSIVGKPRRIPDRRRCCRHYSSLPPVIRLSASVSTRRSPRRPAADPPPRIPRRASSMGKSEPECVNSSNPAHECNDYCLNKIAEAKRRLLEELPDSWKGPPEDRTVHPDCINASNPYHGCSEYCFKKIADANAAAERGELEKPAGGSGKSGVTPEQADGDDDSERQEDAAAAEDGYPQMTEKQKKLFELQLKMNEARKANQQAMVAEKKRMEPRGESRGVSKEKWLEDRKKKIGKLLDSNGLDMSKSYMLDTQDMAEAKYKKWEKEPAPHGWDVFNQKTLYDAYKKRTKNIEVDMDAYNRAKETDPEFYREASSLQYGRVSRVAEPNIXRMVN

SEQ ID NO: 26644 - protein, 289 aa, Clostridium acetobutylicum ATCC 824
MNNKVIKKEVEEYLSRYFEGKDNYNKRVYESMNYSLNAGGKRVRPLLLLASYAIYNKDYKEVIDIAAAIEMIHTYSLIHDDLPCMDNDDLRRGRPTNHKIFGYSIALLAGDGLLNEAMNIMFKYCIGKGEEALKACLMISKAASSDGMIGGQVVDILSEGKKINEDELRYMHKKKTGELIKAAVVSGAILGGAPLHDVELLSQYGDKLGLAFQIEDDILDIIGDTKIMGKTSKSDLENDKCTYVTLYGIDKCKSICRELTDECLDIIGKIQGNTELLKEITELLLKRNR

SEQ ID NO: 26645 - protein, 461 aa, Desulfitobacterium hafniense Y51
MKKKWLGLGLGILILFTGYFWPETAGLTQPGKMSIAILMAGIVLWVTEVMPLAITALLLMVCMPYFEIFNWSTTWSKFISSVIFFIIATFAISVALIKTSLATRIAGVLIKWSQGNSKRLVLGFMAGTALLSAVCNNVPACSLFMSLALSILITDNAIPGKSNLGKCLMIGIPFGAMIGGTMTPAGTSINIMAMGLLEEATGITISFLDWMLMGIPFAIIIVPVCWLSLIMIFKPEDISQKSIDILQNRVVTTEKLNKEEKKIIIIIAVMLAAWIASTWIPWLDATGIAVMGLIAFFFPGIEVLSWDEFIKGVSWEVVLMIGGVNAVAAGIMSTGAAAWIVDSIMGGASGWSYPMLAGVTATVMAVLHGICPVGPAICGMATVPISGLAELINASPAVLTIIVAFGAGITFLLPLDCVPLITYGKGYYKMVDMVKAGIIPTIAVILVSAFMLPPLGALIGL

SEQ ID NO: 26646 - protein, 211 aa, Brassica napus
CLQAAVASLPSLLNLAVSLLKFARGKKSATKVEAAPAAIKATKPLKKGKRDPEDDLDTKVNLKKQKKDVIAAVQKEKAEKKVPKKVESSDSSDSSDIEEEVKEPAPKKAVASTNGTVAKDDSSSEEESSDEEEVAAAKKPAAVAKNGSVKAKAESSSEDDSSDESDDESEKPAAKKAAPATTKAASSADSSEEDSDEEPAAKKAAPATTKA

SEQ ID NO: 26647 - protein, 123 aa, Boechera holboellii
AVLIQILNVVAFCHLQGVVHRDLKPENFLYTSKEENSQLKVIDFGLSDFVRPDERLNDIVGSAYYVAPEVLHRSYTTEADVWSIGVIAYILLCGSRPFWARTESGIFRAVLEADPSFDEPPWP

SEQ ID NO: 26648 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 26649 - protein, 205 aa, Brassica napus
  misc_feature (187)..(187): Xaa can be any naturally occurring amino acid
MALRLLSRRTLGSRILSYRASLHSHATSFGFQQVKEEEKSKLVGNVFTNVASSYDIMNDVMSAGLHRLWKERLVGKLSPFAGMKHLDVAGGTGDVAFRIFDAVNSVKRRALRKVDEASLEETQIYVCDINPNMLTVGKQRAADRGLSDNRSLVWVEGDAEALSFDDNSMDGYTIAFGIRNVSHIEKXALAEAYRVLKRGGKFLGL

SEQ ID NO: 26650 - protein, 123 aa, Boechera holboellii
AVLIQILNVVAFCHLQGVVHRDLKPENFLYASKEENSQLKVIDFGLSDFVRPDERLNDIVGSAYYVAPEVLHRSYTTEADVWSIGVIAYILLCGSRPFWARTESGVFRAVLKADPSFDEPPWP

SEQ ID NO: 26651 - protein, 886 aa, Zea mays
  misc_feature (548)..(548): Xaa can be any naturally occurring amino acid
  misc_feature (604)..(604): Xaa can be any naturally occurring amino acid
  misc_feature (774)..(774): Xaa can be any naturally occurring amino acid
MAPAPCGRSSQRVFHFGKGKSEGNKNMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGVKNDTDLTATGLKELVSQYKDVYVEAKGEPFPSDPKRQLELAVLAVFDSWESPRAKKYRSINQITGLRGTAVNVQCMVFGNMGNTSGTGVLFTRNPNTGEKKLYGEFLVNAQGEDVVAGIRTPEDLDAMKDVMPQAYQELVDNCRILESHYKEMQDIEFTVQESRLWMLQCRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLXANADTPEDALAARNNGAEGIGLCRTEHMFFASDERIKAVRQMIMAPTVELRQQALXDRLLPYQRSDFEGIFRAMDGLSVTIRLLDPPLHEFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQXAEFFSFGTNDLTQMTFGYSRDDVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 26652 - protein, 514 aa, Candida glabrata CBS 138
MSPPETPKKESLKENEDLAIKENGTSPREIGDKIKVESAGEYETPELTSDEENLVQLQTPRKRRKVNLSKEHDFTSPLKKVIMNNLNEYKKSDLADKLKLSRDFVNTQVPRPADVEKLKANRAVTSFTDTFEGYFEQKRSVRGVKVSKNSITMAPHVTREEFGLISNIFHRNLHKNLRDHLYIIQKKLYPQYWFEVIQGFSLLFYGIGSKKVFLEDFVFKYLSPKLALSQAIEVPTYNGKKSKFEGIPVVVVNGYNPTCNYRDVFKDILSLLTPAELTQSESKFWGNHVIMNIQKLIDYYKDKPLDIKLIVAIHNIDGPNIRRGDSPTILSFLSLIRQVAIVASADHIYAPFLWDNLRAQNYNFVFHDVTNYAPYEAESSFQDVMRLGKSENSTGAEGAKYVLQSLTLNSKKMYKLLIETQLQHMEKVSTTKSTGKVAASKRGTMSMGVEFKQLVHLCAADFIASNEMALRSMLTEFIEHKMASVSKNTVGTEFVWVPYTYAEMKRLQEILYEE

SEQ ID NO: 26653 - protein, 353 aa, Triticum aestivum
  misc_feature (86)..(86): Xaa can be any naturally occurring amino acid
  misc_feature (110)..(110): Xaa can be any naturally occurring amino acid
  misc_feature (140)..(140): Xaa can be any naturally occurring amino acid
  misc_feature (147)..(147): Xaa can be any naturally occurring amino acid
  misc_feature (320)..(320): Xaa can be any naturally occurring amino acid
LRTFRPTSERDGEDGDEADEEQEPVPPSPFSTLQQQEDHPGVLNIRDTAAHLIGRTPLVYLNKVTEGCGARVAAKLEFLQPSFSVXDRPAISMIEDAEKKGLITPGKTTXIEPTSGNMGIGLAFMAALKGYELVLTMPSXTSLERRXVMKAFGAQLVLTDPAKGMGGTVRKATQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKSEDAVTMAQQLALQEGLLVGISSGANTVAAIELAKRPENKGKLIXVTVHPSAGERYLSSALFEGLRKEAEAMQPVPVD

SEQ ID NO: 26654 - protein, 123 aa, Boechera holboellii
AVLIQILNVIAFCHLQGVVHRDLKPENFLYTSKEENSQLKVIDFGLSDFVRPDERLNDIVGSAYYVAPEVLHRSYTTEADVWSIGVIAYILLCGGRPFWARTESGIFRAVLKADPSFDEPPWP

SEQ ID NO: 26655 - protein, 397 aa, Bordetella parapertussis 12822
MLVHIPTIAMIRSKLPDVGTTIFTVMSRLAIEHKAINLGQGFPDFDPDPELCALVGKAMAAGHNQYPYMPGVAPLREAIAAKVKTLYGHAYDPETEITVTSGATEALMATVLAAVGPGDEVVVIEPCYDSYLPAIRLAGGTAVPVPLRAPTRDDPYYRIDWQRVRDAIGARTRLLMLNFPHNPTGAVLDESDLDALESIVRETGVLLLSDEVYEHIVFDGKPHASLSRRPLLAEHAFVIASFGKTYHTTGWKVGYCCAPRQLSAELRKVHQFMVFTVSSPMQFALAEYMANPKPYLDLPAFYQAKRDRLAAGLANTRFRPLPSPGTFFMLADYSEITKHAEADFARHLTIDHGVTVIPVSAFYQNPAAPESNHHLVRFCFAKQDATLDAAIERLAHV

SEQ ID NO: 26656 - protein, 420 aa, Prochlorococcus marinus str. MIT 9211
MELVDAPHSKCGTFGFVGSSPTAPTPLMQTYKRLPISLVKGQGAWVWDDKGKKYIDAVAGIATCTLGHSDRKLRKALINQLRKIQHVSNLYQIPEQEELAKWLIKKSCADSAFFCNSGAEANEAAIKLARKYGHKERQIDRPVILCANGSFHGRTLAALSATGQEKYHEGFKPLVEGFAFFKFNDSASFQELHDQIEANGPRIAAVLIEPIQGEGGIRPGNKKFFKLLRDICTKNKILLIFDEVQSGMGRTGRLWGYQNLEVEPDALTIAKGLGGGHAIGALLVKNNANIFEPGDHASTFGGNPFACRAGLTIAKAIEERNLLEETLSRGKQLREGLQSIVKDHLDHLEEVRGIGLIQGLVIKNQSDLTSQIIVEEAINQGLLIISAGQKVVRMVPPLVITKRQVDFIIDRLSKTLVNII

SEQ ID NO: 26657 - protein, 131 aa, Triticum aestivum
  misc_feature (37)..(37): Xaa can be any naturally occurring amino acid
  misc_feature (66)..(66): Xaa can be any naturally occurring amino acid
  misc_feature (82)..(82): Xaa can be any naturally occurring amino acid
MNIMMLIVVSGFRHQQQLAINQDSYIQIRVEAIQNLXSRIHEMSNILTHLATMVSQQGELAIIIDXENMEDPVSKVEGDQDXLLKYVYSISSKRWLIMKIFFVMKVFFKIFILFVPRSPPLVTHFVCKYIL

SEQ ID NO: 26658 - protein, 371 aa, Kluyveromyces lactis NRRL Y-1140
MGKRIVFNISSEFQLQSLLGEGAYGVVCSAKHKPSGEIVAIKKIEPFEKPLFSIRTLREIKILKHFQHENIISIFDVQKPSSFEQFNEVYIIQELMQTDLHRVIVTQELSEDHVQYFVYQTLRALKVLHGSNVIHRDLKPSNLLLNSNCDLKICDFGLARIVSERATDGDAHVDADDTDDNSPSSAANDGDPAISGMTEYVATRWYRAPEVMLTAAQYSKSMDVWSCGCILAELLGKQPLFPGKDYRDQLILIFQTLGTPTEQELVELVENRRAREYIRSLPKHPKINWRRRFPNASAAALDLLDRMLQFDPRLRITATEALSHPYLVSYHDPDDEPEGTPIPSSFFQFDQWKSRLNTKDLKRLLWNEIVS

SEQ ID NO: 26659 - protein, 472 aa, Thiobacillus denitrificans ATCC 25259
MTIHPVILSGGSGTRLWPLSRAALPKQLLPLASERSLLQDTVLRLADFPDMAAPLMVCNVEHRFMIAEQMRQIGVHPSAIVLEPVGRNTAPAIAVAALRLSREDADALMLVLPADHLIGDIAAFHAAITRAADAAKHGYLATFGIVAATPETGYGYIRKGDALAEAAGAHAVAGFVEKPDLATAQQYVASGDYFWNSGMFLFRASDFLKELETLRPDILSASRAALDAAKPDLDFVRLDPVAFEACPSESVDYAVMEHTRRAAVVPADIGWNDIGAWSALWEVAEKDAAGNAVRGDVMLENAANNFVRAETRMVAMLGVSDLVVVETADVVLVANRDQVQDVKKLVDRLKAAKRCEHLVHKQVYRPWGWYEGIDGGDRFQVKRIMVKPGEKLSLQMHHHRAEHWVVVSGTASVTCGDEVMLLAENQSTYIPLGTTHRLENPGKVDLHMIEVQSGTYLGEDDIVRFEDVYKRD

SEQ ID NO: 26660 - protein, 738 aa, Oceanobacter sp. RED65
MTSQKPIQDSPNQQALTFTCPKGLEGLLEEELTSLGASEVKLGVAFVACRADLQLAYKACIWSRLASRVLWPIAEGQGESAEALYDCIKSINWIEHFSDRQSFKIHFTGKSPDIRNTHFGALKAKDAICDYFRELTGNRPDVSDQPDIHIHVRLHKGVIKTSIDFAGEPLHKRGYRQSQGAAPLKENLAAAIVMRSGWPSMMKQTEAALLDPMCGSGTLLIEAALIAANIAPGLLRSQYAVERWKQHQRDEWRVVKADAQEKKEQALQTETELTLLGYDMDERVIQKAIQNAIRAGVQHYVHFSVQALADWRREKGLPDEGLIVCNPPYGERLSDEVAIGALYAAMGNKAKQFFPGWKMAIFTGNPQQAYQFKMRADKQYQMFNGAIPSKLMVYGISKDSDKHFVESTEARSIESGDSANIKLNDGAQMVANRIKKNLKKIVRYAKKQKTNCYRVYDADMPEYAVAVDVYGDWVHVQEYAPPKSVDPEKAQNRLRDVLDALPVALNVDRERIALKQRQVQKGKKQYQKVDEQASFFEVQEGSCRFYVNMTDYLDTGLFLDHRPIRTDIETLAKGKDFLNLFSYTCTASVHAAVGEARSTTSVDMSQTYLNWGRRNLTLNGIAEKYHHFIQADCMQWLKDVQSESKRFDLIFMDPPSFSNSKRMIGVLDVQRDHVELIELAMGLLKPNGILIFSNNLKRFKLDFDALNKFEVIDVSAKTIPDDFTRNAKIHQCFQISAK

SEQ ID NO: 26661 - protein, 310 aa, Corynebacterium diphtheriae NCTC 13129
MTATIDNLTSRERATVLADALPWLQRYRDKIVVVKYGGNAMVDEELKAAFAADMVFLRTVGVRPVVVHGGGPQISQMLQRLGIEGEFKGGFRVTSPEVLEIVRMVLFGQVGRDLVGLINSHGPYAVGTSGEDAGLFRAEKRLVEIDGELTDIGQVGNITAVNASSLMGIIDAGRIPVVSTIAPGDDGSVYNINADTAAGALAAALSAERLLILTNVEGLYTDWPNKDSLVSVIGAERLREKLSALGSGMIPKMESCVDAVIHGVSAAHVIDGRVAHSVLLELLTSGGVGTMVVPDTEMTNGTVYRKDNHV

SEQ ID NO: 26662 - protein, 280 aa, Prochlorococcus marinus str. NATL1A
MEISLGIIGLGSMAKAIVLPLLERGEYNPQQVLGIVGRSSSIASALNDLPQEVKVVTSKDPLSKEVWKAPIKILAVKPQQLSKIKESVSSFQSNDQFPKPLLISVLAGITLKSLKKAFPRHTCVRAVPNTPSLVGQGLTGLAWPDDMTSDQKKVVRKIFEPISEIYELEEPKLDSFLALTSSGPAYIALVVEAMADGAVAAGLPRQLSNQLAHRTLSGTASLLREKNLHPAELKDMVASPAGTTISALRHLELSGLRSALIEAVVLAAQKSRQLAEEVST

SEQ ID NO: 26663 - protein, 361 aa, Ralstonia eutropha JMP134
MKAAVLHQPKSPLVIEDVAIGKPGPHEVLIRTAAVGVCHSDLHFLDGAYPHPMPAVLGHEAAGVVEQVGELVRTVRPGDHVITCLSAYCGHCEHCLTGHLSLCTEPDTRRGEDEPPRLTAHHGGPMNQFINLSAFAEQMLVHEHALVAIRRDMPLDRAALIGCAVTTGFGAVVHTARVQPGETVAVIGCGGIGLATINGAAIAGAGRIIAIDRVPGKLELARQFGATDVVQAGDDTVDAVRALTGGGVHHAFEAIGLKQTAEQAFAMLRRGGTATIIGMIAPGVKIELKGSDFLGEKKIQGSLMGSNRFPVDMPRMVDFYMAGRLKLDELISRRLPLEEINSAFDELRRGELARSVVVFGD

SEQ ID NO: 26664 - protein, 1053 aa, Saccharomyces bayanus
  misc_feature (609)..(609): Xaa can be any naturally occurring amino acid
PTVFNAPYKLIKNATRIFQNSNEGSTFQILKPMEGCLNPGELLVVLGRPGSGCTTLLKSISSNTHGFDLGKDTEISYSGYSGDDIKKHYRGEVVYNAEADIHLPHLTVFQTLLTVARLKTPQNRIKGVDRESYANHLAEVAMATYGLSHTRNTKVGSDLVRGVSGGERKRVSIAEVSICGSKFQCWDNATRGLDSATALEFIRALKIQANISNTSATVAIYQCSQDAYDLFNKVCVLDDGYQIYYGPGDKAKKYFEDMGYVCPSRQTTADFLTSVTSVSERILNEDMLKKGISIPQTPKDMNDYWVKSQNYKELMEEIDQKINNNDEAAREAIKEAHIAKQSNRARPTSPYTVNYMMQVKYLLARNMWRIRNNIGFTLFMILGNSGMALILGSMFYKIMKNGDTSTFFFRGSAMFFAILFNAFSSLLEIFSLYEARSITEKHRTYSLYHPSADAFASVLSEVPTKLTIAVCFNIIFYFLVDFRRNGGVFFFYLLINIVAVFSMSHLFRCVGSLTKTLSEAMVPASMLLLSLSMYTGFAIPKKKILGWSKWIWYINPLAYLFESLLINEFHDRKFPCAQYIPRGTAYANSTGTETICSVVGAIPGQDYVXGDDFIKESYQYYHSHKWRGFGIGMAYVIFFFFVYLFLCEYNEGAKQKGEILVFPRSVVKKMKKQGALKEKNGNDPENVGERSDFSSDKKMLQESSEEESDTYGDVGLSKSEAIFHWRNLCYEVQIKTETRRILNNVDGWVKPGTLTALMGASGAGKTTLLDCLADRVTMGVITGDIFVNGIPRDESFPRSIGYCQQQDLHLKTATVRESLRFSAYLRQPAEVSIEEKNVYVEEVIKILEMEKYADAVVGIAGEGLNVEQRKRLTIGVELTAKPKLLVFLDEPTSGLDSQTAWSICQLMKKLANHGQAILCTIHQPSAILMQEFDRLLFMQRGGKTVYFGDLGDGCKTMIDYFENHSSHKCPPSANPAEWMLEVVGAAPGTHADQDYHEVWRNSDEYRAVQSELDWMEKELPKKGPITAEADQHEFAQSIVYQTKLVSIRLFQQY

SEQ ID NO: 26665 - protein, 145 aa, Bradyrhizobium sp. BTAi1
MTEEGPQVKTTDDIFKGKKVALFAVPGAYTGTCHKMHLPSIFLNAYALKGKGVDTIAIISVNDAFVMNAWKRDTDQRDEAVFLADGNADFTKAIGMELDASGHGLGIRSKRYSMLVEDGVVTKLNLEAAPGKVEVSGGDTLLGQL

SEQ ID NO: 26666 - protein, 480 aa, Synechococcus sp. RS9917
MSDATFDFDVIVIGAGYGGFDAAKHAAEHGLKVAIIETRDMGGTCVNRGCVPSKALLAASGRVRELADADHLAGFGIHAAPVRFERQKIADHANALVATIRANLTKTLERAGVTIIRGKGRLEGSQRVGVREVSGVDRVLTARDVILATGSDPFVPPGIDTDGRSVFTSDEAVNLEWLPRWIAIIGSGYIGLEFADVYTALGCEVTMIEALDRVMPTFDPDIAKIAARKLIDGRDIEARSGVLAKAIRPGSPVQIELVDMDTREPVETLEVDAVLVATGRVPSSKDLNLESVGVETQRGFVPIDDSMHVLVHGQPLPHLWAVGDVTGKLMLAHTAAAQGTVAVDNILGHGRTIDYRSIPAATFTHPEISSVGLSEADAKQLAADQGFELGVVRSYFKANTKALAELESDGLMKLLFNKTSGEVLGAHLYGLHAADLIQEIANAVARRQSVTQLAQEVHTHPTLSELVEVAYKQAATALGA

SEQ ID NO: 26667 - protein, 481 aa, Chlamydophila caviae GPIC
MIARTKIICTIGPATNTPEMLEKLLDAGMNVARLNFSHGTHESHGETIRLLKELREKKGAPLAIMLDTKGPEIRLGNIPTPIQVSRGQKITLVGKEVEGSAEGGVTLHPQCVFPYVREGVDVLIDDGYIQAVVTSVGEDHLELEFINSGELKSHKSLSIREIDLALPFMTDKDINDLQFGVAQGVDVIAASFVRYAEDIESMRKCLADAGRPDMPIIAKIENRLGVENFSQIAKASDGIMIARGDLGIELSVVEVPNLQKFMAKMSREMGRFCITATQMLESMIRNVLPTRAEVSDVANAIYDGTSAVMLSGETASGSYPVAAVKIMRSVIQETEKNLNYKSFLELSDSECAVKVSPYLKSIGLSGIQIAEKADAKAIIVYTESGGSPIFLSKYRPRFPIIAVTPNLSVYYRLALEWGVYPMLTQESDRAVWRHQACIYGIERGILSNYDKILVLSRGAQMKDTNNLTLTTVNDIITASAK

SEQ ID NO: 26668 - protein, 236 aa, Kluyveromyces lactis NRRL Y-1140
MKLNISYPINGTQKCIEIDDEHRVRVFYDKRIGQEVDGESVGDEFKGYVFKIAGGNDKQGFPMKQGVLLPTRVKLLLAKGHSCYRPRRNGERKRKSVRGAIVGPDLAVLALIITKKGEQEIEGITNDTVPKRLGPKRANNIRKFFGLTKEDDVRDYVIRREVTKGDKSYTKAPKIQRLVTPQRLQRKRQQKSLKIKNAQAQREAAAEYAQLLAKRLSERKAEKAEVRKRRASSLKA

SEQ ID NO: 26669 - protein, 484 aa, Kluyveromyces lactis NRRL Y-1140
MSIRNTINRIIIRRNMSDSIRHYDYLVIGGGSGGVASSRRAASYGAKTLLIEAKAMGGTCVNKGCVPKKVMWYASDLATRIGHAHSYNLFEDLPLTKENLTFNWPEFKKKRDAYIHRLNGIYERNLTKEGVDYVYGWASFTVDGKVQVKKADNCTETYTADHILVATGGKPIYPAKIPGYDYGVSSDEFFELEDQPKKVVVVGAGYIGVEIAGVFNGLGSDSHLVIRGETVLRKFDDCIQETVTDTYIKEGVNIHKSSNVTKVEKDESTGKLNIQLDTGKNIDNVDSLIWTIGRRSLLGLGLENIGVKLDAKEQIVVDEYQNSSVKNVYSLGDVVGKVELTPVAIAAGRKLSNRLFGPEKFKNQKQDYENVPSVVFSHPEAGSIGLSEREAIEKFGKDNVKVYNSKFNAMYYAMMEEKDKTPTRYKLVCTGEEEKVVGLHIIGDSSAEILQGFGVAIKMGATKADFDSCVAIHPTSAEELVTLT

SEQ ID NO: 26670 - protein, 399 aa, Synechococcus sp. RS9917
MATYGRFPLTLVRGKGCWVRDERGRRYLDAVAGIATCTLGHSDPALRRALADQLRKLQHVSNLYRIQEQEDLAHWLVDHSCADSVFFCNSGAEANEAAIKLARKHGHTVRGIEAPVILTAKASFHGRTLAAVSATGQPKYHQGFEPMVAGFDTFPYNDLDGFETTLKRWEAEGPRVAAVLIEPLQGEGGVNPGDRAFFQAVRQHCSQRGILLILDEVQTGMGRTGQLWGYEHLGIEPDAFTLAKGLGGGHAIGALLVQSHADHFAPGDHASTFGGNPFACRAGLTVARELQRRRLLRHVNARAEQLRQGLESLIQRHPDRLEAVRGWGLLQGLVLRDDWDVSAVDVVRAALDQGLLLVAAGARVVRMVPPLVISRREVTLLLQRLDASLASLPARATQA

SEQ ID NO: 26671 - protein, 318 aa, Ralstonia solanacearum GMI1000
MAAIVVAGELLAEFVAAERGQMLAEPGAFIGPFPSGAPAIFADQAARQGASVAYAGCVGHDVFGDAIIARLERDGVDTAQIRRIERPTGTAFVAYRDDGSRSFVYNIAHSASGCFDASDVDTRLFEGCRYFHVMGSSLSSEGAIAAIRRGLMEAARVGAKISFDPNVRAEMLGFQPMRAALNDILAVCHLFLPSEADLPFFCGAQAPERAIEALLATYPLLERVVLKRGAAGSTAFDRGGSVAVPAYPVGEVDPTGAGDCFGGTLLAALVAGLPIDAALRRANAAGALAVMQRGPMEGNSHAADIDRFLAERGVACPA

SEQ ID NO: 26672 - protein, 180 aa, Synechococcus sp. RS9917
MASRLLQPRRWMLAGLLLALMALTSGPAQALDTSTGTGLQDRALFQERVDYTLTNQSGHDFHGQDLRNTSFAGAVGRGADFSDANLHGAIFTQGAFANADFHGADLSDALMDRADFSGTDLRGTLLSGVIASGSSFAGAQIEGADFSDALLDRDDVRRLCRDAEGSHPHTGVSTRESLGC

SEQ ID NO: 26673 - protein, 464 aa, Desulfitobacterium hafniense Y51
MVLMKKKWLGLGLGILIMVIAYFLPETAGLTQAGKMAIAILLTGIVLWVTEVMPLAITALLLMVCLPYFDILNWSTTWSKFISSVIFFVIATFAITVALIKTSLATRIAGVLVRWSKGDPKGLVLGFMVGSALLSSVCNNVPTCSLFMSLALSILITDNAIPGKSNLGKCLMIGIPFGTMIGGAMTPAGTSINIMAIGLLEEATGMTISFLDWMLMGIPFAVIMVPISWLSLIMIFKPEAISQKSEDTINNMVISAGRLTSQEKKIIAIIGVMLVAWIASTWVPWLDATGIAVMGLIAFFFPGIEVLTWDEFVKGVSWEVILMIGGVQAVAAGIMATGAANWLVDGIMAGAANWSTPMLAGAAASVMTILHAICPVGPAICGMATVPISGLALLAGASPAVLTMIVALGAAITFILPLDCVPLITYSKGYYKMGDMVKAGIVPTFAMILVCAFVLPVLGTLIGI

SEQ ID NO: 26674 - protein, 267 aa, Arabidopsis thaliana
MDTNAKTIFFMAMCFIYLSFPNISHAHSEVDDETPFTYEQKTEKGPEGWGKINPHWKVCNTGRYQSPIDLTNERVSLIHDQAWTRQYKPAPAVITNRGHDIMVSWKGDAGKMTIRKTDFNLVQCHWHSPSEHTVNGTRYDLELHMVHTSARGRTAVIGVLYKLGEPNEFLTKLLNGIKAVGNKEINLGMIDPREIRFQTRKFYRYIGSLTVPPCTEGVIWTVVKRVNTISMEQITALRQAVDDGFETNSRPVQDSKGRSVWFYDPNV

SEQ ID NO: 26675 - protein, 501 aa, Oryza sativa Japonica Group
MATWILGWLLWLPVFLISLYLVDILAHSCRRLPPGPRPLPFIGSLHLLGDQPHRSLAGLAKKYGPLMSLRLGAVTTVVVSSPEVAREFVQKHDAVFADRSIPDSIGDHTKNSVIWLNPGPRWRALRRIMATELFSPHQLDALQQLRQEKVAELVDHVARLAREGAAVDVGRVAFATSLNLLSRTIFSRDLTSLDDRGASREFKQVITDIMEAAGSPNLSDFYPAIAAVDLQGWRRRCARLFTQLHRLFDDEMDHRKLHSRHGGPGENGKEKDDFLEVLLRLGARDDDIAGLDGDTLRSLFIDLFAAGSDTSSSTIEWAMVELLKNTLSMGKACDELAQVVGSRRRIEESEIGQLPYLQAVIKETLRLHPPVPLLPHRAKMAMQIMGYTIPNGTKILINVWAIGRDKNIWTEPEKFMPERFLDRTIDFRGGDLELIPFGAGRRICPGMPLAIWMVHVVLASLLIHFKWRLPVEVERNGIDMTEKFGLTLVKAIPLCALATPT

SEQ ID NO: 26676 - protein, 123 aa, Boechera holboellii
AVLIQILNVVAFCHLQGVVHRDLKPENFLYTSKEENSQLKVIDFGLSDFVRPDERLNDIVGSAYYVAPEVLHRSYTTEADVWSLGVIAYILLCGSRPFWARTESGIFRAVLKADPSFDEPPWP

SEQ ID NO: 26677 - protein, 123 aa, Boechera holboellii
AVLIQILNVVAFCHLQGVVHRDLKPENFLYTSKEENSQLKVIDFGLSDFVRPDERLDDIVGSAYYVAPEVLHRSYTTEADVWSLGVIAYILLCGSRPFWARTESGIFRAVLKADPSFDEPPWP

SEQ ID NO: 26678 - protein, 564 aa, Pseudomonas aeruginosa UCBPP-PA14
MTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGISPAYTLPVVLDVGTNNPDLLNDPMYMGWRHERVSGAQYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTRGEGAVLPALGDIREVSKRIAVAVAKQAQAEGKALHTSDEVLNDAIEANFWFPRYRAYRRTSF

SEQ ID NO: 26679 - protein, 215 aa, Mycoplasma gallisepticum
MSDLLFSILPMLNDYDQNKLASYKQLGLNKIHYDVMDEFVNNKAFDERYVDNLKDLGYQINVHLMVNKVANHILVYAKTRCNQISFHVEPLANNKQLINKYLAYIKTNNKKAGLAFKFNTDVNDYLDQIKLVDYVTLMSVEPGAGGQAFNPLVYRNIAKLIKFNPKLEIEIDGGINFEKAIELKGLVSGFVSGSYFYQLSDQSKLEMLEKIRAFS

SEQ ID NO: 26680 - protein, 271 aa, Brassica napus
  misc_feature (225)..(225): Xaa can be any naturally occurring amino acid
MSETGEKSRDISRWSLRGMTALVTGGSKGLGEAVVEELSMLGARVHTCARDETQLQESLLEWQAKGFQVTTSVCDVSSRVQREKLMETVSTLFQGKLNILVNNAGTCITKPTTEFSAEDFSFLMATNLESAFHLSQLAHPFLKASGSGSIVFMSSAAGVVHINVGSIYGATKGAMNQLARNLACEWASDSIRVNSVCPWFIATPLANKYIDHEEYNKEVEKVDPXSGVGEANEVSSLVAFLCFPAASYITGQVICVDGGATINGLSFKSLP

SEQ ID NO: 26681 - protein, 413 aa, Corynebacterium diphtheriae NCTC 13129
MSKNAANTDSQSSETQWADVIMNTYGTPPLTITGGNGATLTDSVGKTYIDLLAGIAVNSLGHAHPAIVEAVTEQISNFAHVSNLFGSRPVIDTAARLIRRFAEETTDSTQTAHDTRVFFCNSGTEANEAAFKLARMTGKNRILAAQHGFHGRTMGALAMTGQPDKQMPFYPLPAGVEFYPYGDIDYLRKLVQINSTDVAAIILEPIQGETGVIPAPDGFLSAVRGLCNEFDILMIVDEVQTGIGRTGDFFAFQHETGVIPDVVTMAKGLGGGLPIGACLATGKAKDLLGPGKHGTTFGGNPVSCAAAGAVLRTIDDDFLENVQRKSHKLVKRMSRLPLVESIRGRGLMLGVLLSEPVAKECVKLALEHGLIVNAPSASVLRLTPPLVISDAEIHESIERLSIVLTKIKKKECH

SEQ ID NO: 26682 - protein, 319 aa, Corynebacterium diphtheriae NCTC 13129
MSTQTRVRHFLADDDLTPAQQREVLELASELKQHPYSRKTYDGPQSVAVLFDKTSTRTRFSFDAGISQLGGHAIVVDSGKSQMGKGETFQDTGAVLSRFVSTIVWRTGSHQNLLDMAETATVPIVNALSDDLHPCQILADLQTCIEHLCPQEGVPGLKGLKAVYLGDGDNNMANSYMIGFATAGLDITIIAPKKFQPKQEFVDRAEKRASETGAIVSVTADISAVSDADVVITDTWVSMGMENDGIDRRTPFLPYQVNDEVMALAKKSAIFLHCLPAYRGSEVAASVIDGPQSVVFDEAENRLHAQKALLVWLMENQPR

SEQ ID NO: 26683 - protein, 514 aa, Streptomyces antibioticus
MRKQLDELLDIKESARGGPDPDATRRQHDKGKLTARERIELLLDKDSFQEIEQLRRHRATGFGLEAKKPYTDGVITGWGTVHGRTVFVYAHDFRIFGGALGEAHAQKIHKLMDMAIAAGAPLVSLNDGAGARIQEGVTALAGYGGIFQRNTRASGVIPQISVMLGPCAGGAAYSPALTDFVFMVRGTSQMFITGPDVVRAVTGEEIGQEGLGGADVHSRTSGVAHFAYDDEETCLEEVRFLLSMLPANNRESAPAVPCDDPADRRGQALYDLVPADGNRPYDMRAVIEEIVDDGTHLEVHERWATNVICTLARLDGKVVGIVANQPQSLAGVLDIAASEKAASFVQTCDSFNIPLVTLLDVPGFLPGVDQEHNGIIRHGAKLLYAYCNATVPRISLVLRKAYGGAYIVMDSRSIGADLALAWPTNEIAVMGAEGAAGVIFRRDINAADDPEAVRRQRVEEYKAELMHPYYAAERGLVDDVIDPADTREVLIRGLAMLRTKHADLPMRKHGNPPQ

SEQ ID NO: 26684 - protein, 459 aa, Prochlorococcus marinus str. MIT 9313
MLPENFLLSELRKPVISGLTRPEAWRRKQLKQIEVLIEKHQDEVLDALATDLGKPPTEALFELIALRGELKLAQRQLSRWMQPRHVQVPLAHQPGQAEVILDPLGCVLIIGPWNYPFSLTLQPLISALAAGNTAVLKPSEHAPATSRLIAHVIPQHFSSEVIQVIEGDGAIAAALIKQPFDHIFFTGSGAIGQKVMAAAAEHLTPVTLELGGKSPAIVIDGADLSVTARRLVWGKGLNAGQTCIAPDHLLIQEQLKQPLLQAMKGAITELYGGDPLRSPHLAKIINDRHFQRLQHLLDQAKQRGKVLSGGQIDPDQRRIAPTLIDVDKRDDPLMEEELFGPLLPVISVQSLHEALAEVRQQPKPLALYLFGGTHADQQQLLNTTSSGGVCFNDVVMHVGIPELPFGGVGASGMGRYHGLAGFETFSHQKSVLRRPFWLDLKLRYPPYKANLALLKKVLG

SEQ ID NO: 26685 - protein, 1491 aa, Rhodospirillum rubrum ATCC 11170
MMDPLQGCLLRLLRSDGESDIIVGTGFLSLGADGRPYVLTCAHVVNAALGRDKTETSHPGSCVVMANQQGGKPIPLDLQAWNAPISGASGNSDIADIAILTPLQSLSASWLPRLRAEPPSRVVPHNSKVPFHSFGFMVTSDGNPARGSLTAVDFANRFVAHGDHTFRRFIEEGLSGAPVFSDDSRVLGMVARRLAVEDKQGLVISAFALAQAWPLLAMPYPGLPSFEASNAHLFFGRGRPVNGEVPTGKLKELLERLQKQRLVALVGASGSGKSSLANAGVAEYYRQRNWRVVSFRPGLAPLRNLSEAIFEVIEEGETVLSRLQTVSYWESLLKRGMLRDAFDCINRAGADGTLVIVDQFEEFFPGREASSYDNGDLSVDLDPIAQERSLILKQLRQAEDRADVHCLLTVRLDLLESIIKGGKDAARLLSDPYPIFMLTAMTASEVREAIVGPAQVFGVETDTNFATNLAAEVTKGEGRLPLLQEALRQCWARIRFGEQGWNLYQPEDLSEGKEILLLEESVGRRGDEAMGEIERHYKPVEVNRMLLSLVRWVDGRPLRRILSMMESDESDVPMIAMLANQRLVILSGDGSRRTAELVHEALMTRWARLASLISNHHVFLEWRDRFDREFIVWERGRCEEKDLLRRHDVQLAMSWKENVDGFFIAPTSRQLKFIDESYLFYEKEEIRREEDFRQKEKQNRRIRKWLLLSIFALFLFFIFLCLSIFTFKKAQDETYSAQMQESRALAVLARQESEKGDQGTAILLALEGLPDPGFGGKRPLSPEAATMLRQAWLRNREVTTVGYDGPVRVASLSSDGQRVVVASDDEIVRVWDLSAPKSPGINLGEHQGSVFSANLSPDGQRAVTASYDGIVLVWDLSAPKFPAITLAGSSGSVLSGRESVSFSPDGQRVLKTSEDGTAQVWDLSSSKIQAITLGERGHYVQSASFSPDGRRVVTASSDGAAQVWDLSAPKTQAILLEGHEQPVQSASFSPDGQKVVTVSSDGTARVWNLSEPKPQALLLDGHKGLVQLASFSPDGQHVVTASGDTARVWDLSAPKSQAFLLEGHEGSIQSASFSPDGRRVVTGSGEGTVRVWDLSAPKSQPILLRGHLRATFFARFSADGRSVVTASYDGTARVWAVPAVEPGELFLEGSDDSVRSASFSPDGEHLVTISDDKTVRVWDLSVPKPRSLLLEGYEGSVQSASFSPDGQRLVTVSDDKTARVWDLAEPKAKALILEGDDASVGSASFSPDGRRVVTASYDKTARVWDLSALKPRAITLESSLGWVGSANFSPDGQRVVGASYGGAQIWDLSVPERPKLCMRLKQLNAGLLQSASFSPDGGRVVTVSDGGTRVVDLSTPKSPPITLGGRLDRARSASFSPDGQRVLTASYDGTARVWDLAGSQASALVLGEYSSSMLYANFSRDGRRVLTFSSPNKLRVWDVYPDIRELSSLVRKRLTRCLSTAQREEFGLRVEDRKRNRDAIPIPDSEGNCPR

SEQ ID NO: 26686 - protein, 397 aa, Bacillus cereus G9241
MFHRIEEALEDLKQGKVVIVCDDENRENEGDFIALAEYITPETINFMITHGRGLVCVPITEGYAERLQLEPMVAHNTDSHHTAFTVSIDHVSTTTGISAHERATTIQELLNPASKGADFNRPGHIFPLIAKEGGVLRRAGHTEAAVDLAQLCGAEPAGVICEIINEDGTMARVPDLIQCAKQFDIKMITIEDLIAYRRHHETLVTREVEITLPTDFGTFHAIGYSNSLDTKEHIALVKGDISTGDPVLVRVHSECLTGDVFGSCRCDCGPQLHAALTQIEREGKGVLLYMRQEGRGIGLLNKLRAYKLQEEGFDTVEANEKLGFPADLRDYGIGAQILKDLGLQHLRLLTNNPRKIAGLQGYDLEVIERVPLQMPAKEENKTYLQTKVNKLGHLLNL

SEQ ID NO: 26687 - protein, 153 aa, Bacillus cereus G9241
MVFEGHLVGTGLKVGVVVGRFNEFITSKLLGGALDGLKRHGVEETDIDVAWVPGAFEIPLIAKKMANSGKYDAVITLGTVIRGATTHYDYVCNEVAKGVASLSLQTDIPVIFGVLTTETIEQAIERAGTKAGNKGYESAVAAIEMAHLSKQWA

SEQ ID NO: 26688 - protein, 328 aa, Prochlorococcus marinus str. NATL1A
MSRIYEDNSFAIGHTPLVKLNSITKNAKATVLAKIEGRNPAYSVKCRIGANMIWDAEKKGLLNKDKVIIEPTSGNTGIALAYTAAARGYKLILTMPESMSIERRRMMAVLGAELILTEAAKGMPGAIAKAKEIADGDPQKYFMPGQFDNPANPEIHFKTTGPEIWDDTDGQIDVLVSGVGTGGTITGVSRFIKQEKNHSLLSVAVEPTHSPVITQTLNGEEVKPGPHKIQGIGAGFIPKNLDLSVVDQVEQVSNDESIAMALRLAQEEGLLVGISCGAAAAVALRLAEKEEFAGKTIVVVLPDLAERYISSVMFENVPTGVIKEPSLA

SEQ ID NO: 26689 - protein, 329 aa, Triticum aestivum
  misc_feature (183)..(183): Xaa can be any naturally occurring amino acid
MEKAASFLSSLLGGGGGGDGQAGEPAATVASILIYPIKSCRGVSVPQAPVTSTGFRWDRQWVVVNAKGRALTQRVEPKMALVETELPPAAFDEDWQPTPDSYLVIRAPGMDTLKVPLAAEHATLDDVSVWEWSGSAYDEGTEAAEWFSAYFGKPSRLVRFKEESEIRPTNPEYAQGYKITFTXDCFPFLIASQGSLDALNELLKEPVPINRFRPNILVDGCHPYAEDLWKTMKINKLTFDGVKLCDRCKVPTINQENGIPGGTEPTETMLTFRSGEVIRPSHKNKQKVYFGQNLVCKESVSAKGKGRIVKVGDPVHVLQTYPSSDEVPA

SEQ ID NO: 26690 - protein, 304 aa, Saccharomyces bayanus
MSSNAQINTPLPPAPAPKKESNFMIDFLMGGVSAAVAKTAASPIERVKLLIQNQDEMLKQGTLDRKYGGILECFKRTAQQEGIISFWRGNTANVIRYFPTQALNFAFKDKIKAMFGFKKEEGYGKWFAGNLASGGAAGALSLMFVYSLDYARTRLAADSKSSKKGGARQFNGLVDVYRKTLKSDGIAGLYRGFLPSVVGIVVYRGLYFGLYDSLKPVLLTGSLEGSFLASFLLGWVVTTGASTCSYPLDTVRRRMMMTSGQAIKYDGAFDCMRKIIAAEGVSSLFKGCGANILRGVRRAGVISM

SEQ ID NO: 26691 - protein, 307 aa, Saccharomyces bayanus
MSSSTKQQDSSFAINFLMGGVSAAIAKTAASPIERVKILIQNQDEMIKQGTLEKKYSGIVECFKRTAKQEGMISFWRGNTANVIRYFPTQALNFAFKDKIKLMFGFKKEEGYGKWFAGNLASGGAAGALSLLFVYSLDFARTRLAADAKSSKKGSSRQFNGLVDVYKKTLKSDGIAGLYRGFMPSVVGIVVYRGLYFGLFDSLKPVVLTGSLEGSFLASFLLGWVVTTGASTCSYPLDTVRRRMMMTSGQAIKYEGAMDCLKKIVAAEGVGSLFKGCGANILRSVAGAGVISMYDQLQMILFGKKFK

SEQ ID NO: 26692 - protein, 513 aa, unidentified eubacterium SCB49
MKDKKQILADKLSLAHLGGGQERIDKQHAKGKLTARERIHFLLDDGSFEEMGALVTHRTKDFGMEKQLFYGDGVVTGYGTVNGRQVCVFAQDFTVFGGALSETHAEKICKVMDMAMKIGVPVIGLNDSGGARIQEGVRSLGGYADIFHRNVMASGVIPQISAIMGPCAGGAVYSPAMTDFTLMVENSSYMFVTGPNVVKTVTNEVVTAEELGGANTHATKSGVTHVTADNDIQCINQIKQMLSYMPQNCEDKPKDLDFKVADETRLGLEEIVPENANQPYDMRHVIKEIIDTDSFFEIHKDYADNIVVGFARLAGKSIGIVANQPTSLAGVLDVESSKKAARFTRFCDCFNIPLLVLVDVPGFLPGTDQEWNGIITNGAKLLYALSEATVPKVTVITRKAYGGAYDVMNSKHIGADMNYAWPGAEIAVMGAKGASEIIFRKEISAAADPAAKLVEKEAEYAEKFANPYSAAERGFIDEVIDPKDTRRKLIKAYAMLQNKVATLPKKKHGNIPL

SEQ ID NO: 26693 - protein, 388 aa, Idiomarina loihiensis L2TR
MKIAVAGTGYVGLSNAVLFAQHNQVTAVDIDQEKVEKINKKQSPIVDKEIQHFLQEKPLNLSATTDAHAAYKNADFVVIATPTDYDPQTNYFNTKTVESVISQVIEANPNAVMVIKSTIPVGYTQSLKEKFGTNNILFSPEFLREGKALYDNLHPSRIIVGERSERSETFANLLKQGAEKQNIDTLFTDSTEAEAIKLFANTYLAMRVAYFNELDTYAEVHGLDTKQIIEGVCLDPRIGSHYNNPSFGYGGYCLPKDTKQLLANYDNVPQTLIKSIVDANRTRKDFIADQIIAKQPKVVGVYRLVMKSGSDNFRASAIQGIMKRIKAKGIEVVVYEPELKEERFYNSRVINNLTEFKAVSEIILSNRLADDLKDVQEKVYTRDLFNND

SEQ ID NO: 26694 - protein, 212 aa, Triticum aestivum
  misc_feature (175)..(175): Xaa can be any naturally occurring amino acid
  misc_feature (189)..(189): Xaa can be any naturally occurring amino acid
MSQEDSTSAQSRPAPKLNERILSSLSRRAVAAHPWHDLEIGPGAPAVFNVVVEITKGSKVKYELDKKTGLISGRPGRYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNXNKEVAVDAFLPATXTAREAIQYSMDLYAQYILQSLRQ

SEQ ID NO: 26695 - protein, 249 aa, unidentified eubacterium SCB49
MRKNIVAGNWKMNNDLAQTEALLLGLKKHAIPENVSVMVAPAFTNLYQAFETVRETPIEVIAQNMHQAKNGAFTGEVSAPMLKSVGVNTVIIGHSERRAYFHETNALLAEKVTAAIENDMQVIFCFGEELSDRKQGEHFEVVKAQLQQGLFHIDENQFKNIVLAYEPVWAIGTGETASPEQAQEIHNYVRKLVATTYSDAVSENVSILYGGSVKPANAKEIFANADVDGGLIGGAALKAEDFMAIVNAF

SEQ ID NO: 26696 - protein, 307 aa, Arabidopsis thaliana
MVKNKAFFGQIMEERDNPAFFKILRREDHSTEMMRMIPHHLIRSISDKSSSFKMVLRVPWGRSWQVKISKNPNFHYMEDRGWNQFVNDNGLGENEYLTFTHEANMCFNVTIFEADGTEMLRPRKTITSSSGRNKREERKSIYKDVKKEEEIESWSESSHPCHKTAESTSGRLTQKQELNLRKKEADKTEKSKTSKKKKVETVSNDSEAGTSSLIPEFKLTIKKSHLLFLGIPKKFVDMHMPTETTMFKIHYPRGKKSWDVTYVVTDVQSRFSGGWSRLAKELGLLVGDVCTFKLIKPTEMRVKVSKE

SEQ ID NO: 26697 - protein, 277 aa, delta proteobacterium MLMS-1
MWEYTDKVRDHFMNPRNVGEIPDADGVGEVGSLACGDALKLYLKLGADGRISDAKFKTFGCASAIASSSALTEMIKGMTLEEAEKVTNEDIANALGGLPKEKMHCSVMGREALEAAIANYRGVPLPMAEGEVVCECFGVTDLEIRRAIQESKLKSVEEITNFTKAGGGCGRCVDRLEEILRQERHEIQDIIPDQRQRKLTNIKKIKMIEDVLEREIKPALRKDGGDIELVDLDGDFVTVSLRGACASCKKSQTTIKDYVEKKLREQVLDSLIVEEER

SEQ ID NO: 26698 - protein, 193 aa, Triticum aestivum
GLDHRRWAGPARGGGHEFLADDVLRLGASKIRIGLDVAGGAANFAARMRERGVTVVTSVLDGPGKPMNEFVASRGLFPLLLSPAHRFPFYDGVFDLVHVGTAALDEAGAPAMGQAATPEALEFFMFDVDRVLRAGGLLWIDSYLCQSEERRRVVAKLIERFGYKKLKWVAGEKPGGAATSTFLSAVLRKPARS

SEQ ID NO: 26699 - protein, 123 aa, Boechera holboellii
AVLIQILNVVAFCHLEGVVHRDLKPENFLYTSKEENSQLKVIDFGLSDFVRPDERLNDIVGSAYYVAPEVLHRSYTTEADVWSLGVIAYILLCGSRPFWARTESGIFRAVLKADPSFDEPPWP

SEQ ID NO: 26700 - protein, 321 aa, Burkholderia xenovorans LB400
MSMHKVIYDTDPGVDDAMALVFQALHPDIELLGLTSVFGNATIETTTRNARFLAGRFAAGVPVARGAAAPLRRAAPEPLAWIHGDNGLGNIALDTTEQAPLDARPAHRFIIDTVRAHPGEVTLLAVGPLTNLALALAGDPQIAPLVKQVVIMGGAFGTDGVLGNVTPAAEANILGDPDAADIVFGAAWPVAIVGLDVTQRTIMSHDYLASLRARGGAAGRFVWEVSRHYEAFHEQSAQLAGIYVHDSSAVAYVLAPHLYTTRSGPVRVLTDGIAVGQSIQKPSAMPVPAPDWDSRPDCKVCMAVDVPGMLALYENTICGTL

SEQ ID NO: 26701 - protein, 123 aa, Boechera holboellii
AVLIQILNVVASCHLQGVVHRDLKPENFLYTSKEENSQLKVIDFGLSDFVRPDERLNDIVGSAYYVAPEVLHRSYTTEADVWSLGVIAYILLCGSRPFWARTESGIFRAVLKADPSFDEPPWP

SEQ ID NO: 26702 - protein, 245 aa, Aspergillus oryzae
MQDVILDYIRTRAASGLDRTSLTYHEGPFGSRRLREAMAKLITTYFYPASPITSDNILFTSSVTSLNAVCALCLTDPNDGILLDLSVPSGCQLIYTSFQGDDPSGPSAVIQYEEAFLKARDDDGVSVRALLICNPHNPLGRCYPRETLEALLQFCQKYQIHIISDEVYALSVYEENTSTDGFISLLSIEPANNGVNPALIHVLYGMSKDFAAAGLRLGCLISQNQNFLQAALSISNYLTSARQCG

SEQ ID NO: 26703 - protein, 817 aa, Pyrococcus furiosus DSM 3638
MAYRFIKWFEELSKNDVPLVGGKGANLGEMTNAGIPVPPGFCVTAEAYKYFVENVKVSKEDVKRILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVVGTKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCQRYGVETSICGQAGSDPKMARILVRLGIDSISANPDAVQLIRQVVAQEERKLMLEAARKQLFEEEEEEELF

SEQ ID NO: 26704 - protein, 319 aa, Vitis vinifera
  misc_feature (292)..(292): Xaa can be any naturally occurring amino acid
MASFTDSFGQPGDESRPAAAASTRPFDDDGYLGYDPRLPSQRFDSFTNFADSESVKESVEDSPIYNSASYAAADDVFTSQPIPDTPSPPPIYVSGGGFAADQHEFSSFSPEANGKVFDEGFAGSDGPILPPPTEMQSEEGFALREWRRQNAITLEEKEKREKELLSQIIDEADEYKVEFYRRRTITCETNKTTNREKEKLFIANQEKFHAEADKNYWKAIAELIPNEVPAIEKKRGKKDQDKKPSIVVIQGPKPGKPTDLSRMRQILLKLKHNTPPHLKPSPPPAPAPAKDXKTGNSASAAAPAKAAVGPSPPEAVAAA

SEQ ID NO: 26705 - protein, 426 aa, Aeromonas salmonicida
MSALKKDLGLWQRMGLLTTSLLGTGIFVVPATAASLAGGASLWAWVLLIVLVLPIAFTFARLGRRYPHAGGAPHLIGLAFGNGAERFSAFLFLTVLPVGLPAALTIAAGFWHALFDLGEWTLWAIQLLTLLGVFLLGLRGARSSGNLQLLIALAILGLTLLIWFKGDLSWRDAAQPLPTAAEWPAMGTALAVMFWCFVGLEAFAHMGEEFKRPERDYPLALLGGVLLAGLIYWVHSLVVLKYGLYGDEAKNATAIPALLSLLFGPTAKWLVAILGYLSCFGSINIYLQGFARLIWSMAREGKLPTSLARLSARGAPLNALCWVLAICLVSITLILWLRLPLDELIRYANGNFVLVYLLCMAAGWRLLGGMGKGLAGLSVLLCLAVLVALASQVFYAVLLSAGYGLFSLWRRYLRRTRATENICAIK

SEQ ID NO: 26706 - protein, 321 aa, Picea sitchensis
MISVFTRRGGRFIEEAAAALSVSAMAAAIGGGGPQVSASASECCSTPQALQQQKIDISRRRRGIEGGRRRCLSSIASTSTTETKEMSGGGEQEWYDKYRRSLYGGLTHKALLLDAVGTLVLPSQPAAQIYRNIGLKYGVCYSEDEILSRYRWAYQQPWPNTRLRFMDDARPFWQFVVQNATGCSDSRYFEELYEYYTTDQAWHICDPEAGKVFEALRRAGIKLAVVSNFDTRLRPLLQALKCEHWFDALAVSAEVEAEKPNPTIFWKACEFLGVEPEDAVHVGDDRRNDIWGARDAGCDAWLWGADVHSFKEVAQRIGVVV

SEQ ID NO: 26707 - protein, 282 aa, Beta vulgaris
MCESFKRQYQLCDEIGRGRFGVVFRCFSPSSHTSFAVKSIDKRLLLDDETDRECLDKEPKILQILSPHPNILQIHDIFDSDSHLLIVTDLCQESTLYDRVVSAGPFSETDACSVFTQLIDALAHCHRNYICHRDVKPDNILFDSRNRVKLCDFGSAEWFGGVEGRERMNGIVGTPYYVAPEVLAGREYNEKIDVWSAGVILYIMLGGVPPFYGDTVEDTFAAVLRGNLRFPTKIFRSISPEAKDLMRKMLSKDVSRRFSAEQVLRHPWVTSGGMTSTMNDMS

SEQ ID NO: 26708 - protein, 492 aa, Campylobacter jejuni subsp. jejuni NCTC 11168
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLKKLLAKCKRVHIIGLYSDGGVHSMDTHFKAMLEICAKNGNEVFAHAITDGRDVSPKSGLNFIKDLKEFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNATIKAVEAVDTCLGEILECAKKHDYAFIITSDHGNCEAMQDEKGNLLTNHTTFDVFVFVQARGVSKIKDNMGLSNIAASVLKILDLEIPKEMNEALF

SEQ ID NO: 26709 - protein, 470 aa, Lactobacillus plantarum WCFS1
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 26710 - protein, 465 aa, Bacillus cereus G9241
MTIVTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKAKKQRFVTLKEAYHGDTIGAVSVGAIDLFHQVYSSLLFEAIKMPYPYTYRSPYGNDKAEIVRKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVACKTEYVATQLEELFACKHVGDIRQCGLMVGIELVKNKETKEAFEWTERVGVQVCKRSRELGMILRPLGNTIVFMPPLASTIEEIDDMLRILYKAISDVTEGE

SEQ ID NO: 26711 - protein, 71 aa, Arabidopsis thaliana; identical to SEQ ID NO: 1560

SEQ ID NO: 26712 - protein, 545 aa, Oceanobacter sp. RED65
MFVPWRSKPLELGNNLSAGIIVAFLIIPQAIGYGLLANVPANIALAAATLPLIAYALFGGSRSMAVGPVAIVSLMVAEATTDMSANEIALSVPLLALMVGTILLTIRFLSLGKLVNFIGHPVIQGFTSAAAVLIIFKQLELMLGLPSDVFNVNTWHLPSLLLSTLSLISLIIVKGFMPSPLNKLGPLMVLLAGMIIALNLPNLKIETIGYHATGDIFTLFSPWNQDTNALSNTLLTLLPSAVIISVLVFLESTSVAKVVAKKHDERISPNQELMGLGSANIIAGFSGAFPVAGGFGRTMVNEEAGSTSPLAGVFTALFVLLFINFIPESINYMMKPVLGAIIAMAVWSLIDLSPLYSHWKIHPQDNAIWLASFLGVFILGVESGIMIGVGLSIAFLLRNAAHPHIAIIGRIPNTSHFRNVRRHKVETHPHVLAIRIDEGLTFANAENIEDFIARAIFDHPKTRHLLLVFSAVNQIDSDGLERLESIIRRQKKEGILTHLAEVKGPIMDKLQHLHLEKLLAPGQIYMSTHEAFEALENQNDNEHKS

SEQ ID NO: 26713 - protein, 155 aa, Acidobacteria bacterium Ellin345
MIRVGLGFDSHEFREGIPLRIGGLTIPHTHGLSGHSDGDVLLHAITDALLGAVAAGDIGAFFPPSDPKWKGANSVVFIEEAMRHIETAGYRVGNVDCSLVLNAPKIGPHAKAIQESVAKLLKIEPTAVGIKAKTPEGLNLDGTALAHVVVLLEKR

SEQ ID NO: 26714 - protein, 488 aa, Lactobacillus plantarum WCFS1
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 26715 - protein, 478 aa, Xanthomonas campestris pv. vesicatoria str. 85-10
MHADLDVCAEDIAALFAAQQPVAAAWRSSTAAQRRERLRALRSALLARRQALYAAFAGDFGKPALEVELSELLPVVDEIAAAIAGLPRWMRPRKVSPTLLTLGTHAQIGYQPKGRCLIIGPWNYPVATVLGPLVSALAAGNTAILKPSEFTPQVNAVLRELLAEAFDPSEVAMVQGGVATAQRLLACPFDHVFFTGSPAVGRQVMAAAAAQLASVTLELGGKSPGIVDRSANLERAAQVLVWGKLVNAGQTCVAPDTLFVHREVRTALLQRCRELLAQRYGSSAAAVAASPDLARMIHVGHAARLAALIDEARAAGAELVAGGEHDVAQRFIAPTVLADVPEHARIAQEEIFGPVLPVVTFDHLDTVLAGLDAAAKPLALYLWSNDAAQVARVLARSSSGSVVVNHCLQQFMHTGLPFGGIGQSGIGSAHGMHGFKAFSHERAVLRGGRLLTARAFFPPYRGWQHRVATALTAWLARR

SEQ ID NO: 26716 - protein, 225 aa, Prochlorococcus marinus str. MIT 9313
MTLSARWHDLVDRLADGVHLLAVSKGHPATLIRQLAELGQQDFGESRLQEALPKLEALADLKGLRWHFIGRLQANKVRGVVRSFAVIHSVDSLALAERISRIAVEEQCCPQVMLQVKFRDDPSKGGFSQEQLKQAWPDLIQLSHLQLIGLMTMAPIGLSLEQRQELFGQCRELADQLGLPDCSMGMSGDWLEAMHAGATWLRLGSLLFGARSMAKSSSVDDINAV

SEQ ID NO: 26717 - protein, 439 aa, Escherichia coli
MSCDMEHAGMKKLKLLNKYSYLHSINGSLIEAELDDVSVGEVCEIYASWQANERIARAQVVGFRNGKTLLNLIGSSVGLTRTAVLKPTGEQLTIQISDAFLGSVLNASGQIMERFVPDTPGDRGNLRLIDELPPSYQERRVINTPLETRIRVIDGVLTCGIGQRVGIFASAGCGKTVLMHMLVNNTEADVFVIGLIGERGREVTECAESLKKSVNAAKCVLVYATSDFSSVDRCNAALMATTVAEYFRDRGKRVVLFIDSMTRYARALRDMKLAAGEPPARRGYPASVFDSLPRLLERPGPTLKGSITAFYTVLLEGEDESDPLGDEIRSILDGHIYLSRKLAGQGHYPAIDVLKSVSRVFGQVTDEKHRDNAARVRKILTTLEDLQVFIDLGEYRAGQNAENDFAMNARPKLTNWLKQSVNEKMPMSETLKELERIVK

SEQ ID NO: 26718 - protein, 623 aa, Claviceps purpurea
MAALARLTAALAVSMSLAAAATINHDFNVTWVRANPDNAFERPVIGINGQWPIPTIECNVGDRIVINLNNQLGNQSTSLHFHGLYQNGTNQMDGPSGVTQCGVPPGSSITYNFTVDQPGTYWYHSHNDGQYPDGLRGPVVVHDPEFPYSKEIDQEVVLTLSDCYHDEIRDLIPQFLSKTNPTGVSLSNAALSMIAECTVSVQPGKTYHFRVINMGAFAGQYLWFEGHKMRIVEVDGVYTKQAEADMIYLSAAQRVSFLLTTKNDTNANFPFVASMDTSLFDQLPKDLNYNSTGWLSYDQTKTLPDPALVDELNPFDDMTLEAYDGMELLPEPDYNVELNVVMDNLGNGANYAFFNNITYKSPKVPTLYSVLSAGEQAENPAIYGEYTHPFVLKKDEIVQIVVNNLDSGRHPFHLHGHSFQAIYRSNESAGTWEAEGGPSGKTFPKVPMRRDTIVLYPPGNMVLRFKADNPGVWLFHCHIEWHVVSGLMATFIEAPTELQKKVSIPEDHLAVCRAGNVPTEGNAAGNTKDLLDLSGQNAPPDPLPEGFTTRGIVALVFSCITGLLGICVVAWYGMSQPTEEAPKAVAELIREVGENDSETRLGRENGVVGVGAETGAEGLRQRT

SEQ ID NO: 26719 - protein, 394 aa, Blastopirellula marina DSM 3645
MKIHEYQAKQLLRDAGVAVPRNIVAKTPEEAAKAYEELGGKIAVVKAQIHAGGRGKGTVKDNADQRGVQLVKSADEAKAVAAALLGKELVTIQTGPEGKLVSQVLVEEGCDIARELYMGIVLDRAAAKPVLMMSSEGGTEIEEVAAHSPELILKEHFDPSRGPDAFQVRKLCKKLGIEGATIKSAYKFIQGLCKVYVDTDCSLLEINPLVITGSGDMIALDCKMNFDTNGLFRHPKIVELRDLSEEEPAEVKAADTGLSYVKLEGNIGCLVNGAGLAMATMDIIKLHGGEPSNFLDVGGGANVDQVTEAFRILLADKNVKAVLVNIFGGIMRCTTIATAVVEAYKSVGFNVPLVVRLEGTEVEQGRKILSESGIPIIIGDGLTDAAKKVVASVA

SEQ ID NO: 26720 - protein, 316 aa, Bacillus cereus G9241
MSTVQVPKLNTKDLLTLEELTQEEIISLIEFAIYLKNNKQEPLLQGKILGLIFDKHSTRTRVSFEAGMVQLGGHGMFLSGKEMQMGRGETVSDTAKVLSQYIDGIMIRTFSHADVEELAKESSIPVINGLTDDHHPCQALADLMTIYEEKNTFKGIKLAYVGDGNNVCHSLLLASAKVGMHMTVAMPIGYEPNEEIVKKALAIAEQTGAEIEILHNPELAVNEADFIYTDVWMSMGQEGEEEKYTLFQPYQINNELVKHAKQTYRFLHCLPAHREEEVTGEIIDGSQSIVFEQAGNRLHAQKALLVSLFKNVEELS

SEQ ID NO: 26721 - protein, 130 aa, Chlamydophila caviae GPIC
MTTQSLETLVETLSNLTVLELAALKKLLEDKWDVTAAAPMMAVAAGAAVGGDAAPAESTEFAVILEDVPADKKIGVLKVVREVTGLALKEAKEMTEGLPKTVKEKTSKSDAEDTVKKLQDAGAKASFKGL

SEQ ID NO: 26722 - protein, 279 aa, Oryza sativa Japonica Group
MAYLGLLVLLLAFCGGAEHHGAEAAGDASARGASARRGLATVSVAKPSYPTVTTPMSASTSPSTMPMSSSPSAFPSLATAGGGGGGGGGGSWCVASQSASPTALQVALDYACGYGADCSAIQPGGSCFNPDTVHDHASYAFNSYYQKNPVATSCDFGGTATITNTDPSSGSCQYSASSGGGQNMLPPPSPTTLPPPTPMTPTTPMTPTPTTPDTGTPIYGGSTTPPDYGSMSPPGGFGSNSPPDYGDVGAAPATMASGRAAVALAGVLIATVSLMSMST

SEQ ID NO: 26723 - protein, 65 aa, Zea mays
  misc_feature (5)..(5): Xaa can be any naturally occurring amino acid
MKTFXPWPVFFRREWKRHWPFLPGFAIPGFIIPKMPANFPEEGLKNSKFVQEPKKPWPTRCCPNC

SEQ ID NO: 26724 - protein, 346 aa, Oryza sativa Japonica Group
MMLTKPHPSSNLLLPTTTALPNPSPNPSRVTPLASGRGRRGHHRVCASSVAPAQPASVAQPTAPALSRVDVLSEALPFIQRFRGKTVVVKYGGAAMKSPELQSSVIRDLVLLSCVGLRPVLVHGGGPEINSWLGRVGVEPQFRNGLRVTDALTMEVVEMVLVGKVNKQLVSLISVAGATAVGLCGKDARLLTARPSPDAAALGFVGEVTRVNPSVLHPIIESGHIPVIATVAADETGQAYNINADTAAGEIAAALGAEKLLLLTDVSGILADRNDPGSLVKEIDIAGVRQMVADGKVGGGMIPKVECCVRALAQGVHTASIIDGRVPHSLLLEILTDEGTGTMITG

SEQ ID NO: 26725 - protein, 187 aa, Triticum aestivum
  misc_feature (46)..(46): Xaa can be any naturally occurring amino acid
  misc_feature (82)..(82): Xaa can be any naturally occurring amino acid
  misc_feature (182)..(182): Xaa can be any naturally occurring amino acid
MMSTPQLRIETDAMRMLMSDYEVTLVNDNMQECYVRFRGPGETPFXGGTWKVHVELPDTYPYKSPSIGFVNRIFHPNIDELXSGSVCLDVINQTWSPMFDMINIFEVFLPQLLRYPNPTDPLNGEAAALLIREPKSYDAKVKEYVQKYASKEAADEAGAESEDDDELSSVASFGDDDDEPAXQMDDV

SEQ ID NO: 26726 - protein, 123 aa, Boechera holboellii
AVLIQILNVVAFCHLQGVVHRDLKPENFLYTSKEENSQLKVIDFGLSDFVRPDERLNDIVGSAYYVAPEVLRRSYTAEADVWSIGVIAYILLCGSRPFWARTESGIFRAVLKADPSFDEPPWP

SEQ ID NO: 26727 - protein, 1365 aa, Aspergillus nidulans FGSC A4
MGVYLFSSSLWATLLLAILIYRLVRITYNLYFHPLSGIPGPSAWAASRLPFVYALIRGTIIQDFQKLHEQYGPIIRIAPNEVTFAHPEAYTDIFQPRPEKSQGQFLKDPLWWARQPGHPDSLLSVINPERHAQMRRVLSPGFTARALRKQEPFVQKYVNLLVAQLQDLVSKSPSAHINMTPWFNYTTFDIFGDLGFGESFDCLQHSRYHPWIALLFDSVKAAGFVIATRYYPLIEAVLLKCVPPSMRKIQRDHYQQIVDKVQRRLGWELQRPDFMSYVIDERGGLRLDAGELYATFMILTTAGSETTATALTGTLNYLVNHSPESLQRLENEIRGAFSGLDAITLDAVRNLPFLNAVIQEGLRLCPPIPWVLPRLVPQGGSMICGTWLPGGTPVSIQAYTLNRDPTLFNRATSFLPERWLASSTSDSSSCFFNDQRQVVQPFSTGPRACLGQHLAWAEMRLILAKLVWVFDFGAIDGQGVNWEDLRTYLLVERKPINAVADVAHLWPGALEGVQACTVYWYPSSITESHPQKVHRECIDYLPALVLKPCVSFCLPYPIICSTSFTFTPSRKGEQRRGSHTSLGTRGTLSHHLQYQYHYRLYFPPLAKFPGSRIAAATGCHDPDFYNELYVTESKRRTNHYDVFCKGIEFEFDGSHLLTVDHTLHLKRRKPLEPFFSRKSIQKPQPTLAEVTLKFEQPLRASSGTGMVVQLDHACAAFSGDIIAKICLDDVAEGDRFLDHPEFAPYCGTMLADHDRIFSQTHNNSKPVTSLFPHVAQSDMPESDRSPERLAKEAQVLLGGGTASTARTIAFASFYIADSPDIRSSLRDELWETMAGWPERVPSGLSSRDLPICRPLLKSLSGIYCLYESPSTMMAIDPERAGTTEKAWTRFLQLAAHPRSRPLRTLEAYLPSRVIDAGELIWFGTLTFAMAISIRNEELELCLKLARPGYAAVSLTNDNYTWNKNCEEAQRLGIDYVYNAVWVIMQEQSVGEEEAKRVCAEQIRYYIKQYFQVVEQEKRCWWLSDDLKTYLEAVKATPATAREMGAQFSQFFPPHPTFTSENLSEQQGKVFLITGGTSGIGLELAKILYCHGGKVYITARSEEKAEKAIQEIQASAPNHHGELDFIILELDDLRSIKASVEAFKAQESKLDILWNNAGVSQPPLGSVSKQGHELQLAVNCFGPFLFTQMLLPLLDAAVASSVSPGSVRVIWTSSQVAELSSPDEGIIMSELTSPPKDNVRNYVNSKTGNWFLSAEFARRYGSRGIVSVALNPGAANTNLLKDARLMKILSYPLLHRAGLAAHTELYAGFSPAISLQNNGCYVIPFGRIHDQVADALLSAMKVAEDGGSGRAKEFWEFCEARTKDYL

SEQ ID NO: 26728 - protein, 123 aa, Boechera holboellii
AVLIQILNVVAFCHLQGVVHRDLKPENFLYTSKEENSQLKVIDFGLSDFVRPDERLNDIVGSAYYVAPEVLHRSYTTEADVWSIGVIAYILLCGSRPFWARTESGIFRAVLKADPSFDEPPWP

SEQ ID NO: 26729 - protein, 123 aa, Boechera holboellii
AVLIQILNVVAFCHLQGVVHRDLKPENFLYASKEENSQLKVIDFGLSDFVRPDERLNDIVGSAYYVAPEVLHRSYTTEADVWSIGVIAYILLCGSRPFWARTESGIFRAVLKADPSFDEPPWP

SEQ ID NO: 26730 - protein, 456 aa, Arabidopsis thaliana
MVSLMFFSSASPLCSSPSKIPKASLDFEMKKLGGSTKLVRNVNLEKLKNNYLFPEINRRELEHIEKHPNVQLISLGTGDTTEPIPEQITSHMSNFAHGLSTVEGYRGYGLEQGNKTLRKAIAETFYRDLHVKSNEVFVSDGAQSDISRLQLLLGSNVTIAVQDPTFPAYIDSSVIIGQTGHFHEKTKKYQNVVYMPCGPNNSFFPDLAMTPRTDVIFFCSPNNPTGYVASRKQLHQLVDFAKTNGSIIIFDSAYAAFIEDGSPRSIYEIPGAREVAIEVSSFSKFAGFTGVRLGWSIIPDELLYSNGFPIINDFHRIVTTSFNGASNIAQAGGLACLSSGGLKEIRSVNNYYKENRKILMDTLVSLGLKVYGGVNAPYLWVHFKGSKSWDVFNEILENTHIITVPGSGFGPGGEEYLRISGFGRRDHIVEASKRLQNFFNTRTKHFTYLSSTSNTN

SEQ ID NO: 26731 - protein, 431 aa, Corynebacterium diphtheriae NCTC 13129
MENNSFAQFDRDHIWHPYGPMPATVAPYVVAATNNTDIILDNGTRLIDGMSSWWAAAFGHGNERLKAAAHRQIDVMSHVMFGGLTHVPAIKLARQLCELTDEPLTKVFFSDSGSVAVEVALKMVYQYQLGQGHPERRRMLTWRGGYHGDTFATMSLCDPEGGMHAMWEGRVMDNVFASRPPLWGAASNEISAYIDHLDSLIDSTIAGIIVEPVVQGAGGMRFHAPEILKGIRQLCDQHGILFIADEIATGFGRTGNLFATQAAKVTPDILCVGKSLTGGFMSLAATITTDAVAESISSAAGGGALMHGPTFMGNPLACAVASEALSIIAEGDWKQQVAEIESELKKGLVPLASNPAVRDVRVLGAIGVVEMKEPVDMKRATHAAVNAGVWLRPFGRLVYTMPPFVCTHKQIQKISCAIASIVHTEQERFER

SEQ ID NO: 26732 - protein, 524 aa, Corynebacterium diphtheriae NCTC 13129
MEILIGLLALLFATVIMVAVGDRTGLPWPVLLTLVAAGGIFLPWLPEVAIPEEMILPIFIPPLLWALARHSSWASIKRQWRTVVLLSVLLVIVTAVTVGLVAYLLVPTLSFAAAVVIGAAISPPDPVAVDAVAEPAGVPRRLSNTLQVEGLFNDAASIVVFNLALSVVQSGHDITWWSALSTLVYSAAVAVVIGFVLGTGCAKLHSWMTSSVARNAFTWVIPFATFIAAEELHASGVIAIVIAAIQFNSKSQAGAEDRLSGSAFWQVVELLFTGVAFGLIGISVRDAIHSAGANLWHGVWFGLVLALTAIAVRALWLYLLYVGNKKAGRRTGAPLRLQEVLLLTWGGMRGLVTLALVLSIPMTTGFAIYRELSIVALTVLLVTMVIPGLTLPALMRVLNLEEGPDAFGDYAREKLFVRARFAARQVLDSYSHDIPEEFMASLRRRFEHDINADEDDDDAMTPEERRKIQERRFALFNKVRLEALYASQAELLRARSERDVDPMIVDEVLFEIDSQIIAAEKSTR

SEQ ID NO: 26733 - protein, 311 aa, Lactobacillus plantarum WCFS1
MEDIILDCDPGHDDAVALMIAIASKDINLLAVTTSAGNQRHSQTLRNAMSLLTLMKRQDIPVASGNTKPLMRSLISGVSMHGVTGLDGADLPSPDFFSQGIPAIELIAKILTDHPQKVTLVVTGPCTNIALFLSVHPELRSRIKQIVILGGGMGLGNWGPTTEFNIQVDPEAAKIVLDSGIPIILAPLNVAFEAQLLPNEIEKIHNIDNSVAQTISGLMDFYGISFGRQRWGFKGLPLYDPCTVAWLIDPSKFTSKRCNVEVETKGELTTGETVIDYYHITNRKPNAEVLFHIDRQWFADLTISSIKSFDF

SEQ ID NO: 26734 - protein, 273 aa, Arabidopsis thaliana
MTSNLIQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYLDEDLQVGRDGKGNVFVLERIEKP

SEQ ID NO: 26735 - protein, 280 aa, Prochlorococcus marinus str. MIT 9313
MASNHSMPCSLGVIGLGRMAQALVLPLLKQGELAPQQLVAVVGCGASVERLADQLPIGLRLKAADDPTAAEAWMAPIQLLAVKPQQLDQIAASAARLKKTADGPHLLISVLAGVSLARLQQAFPAHACVRAVPNTPALVGAGLTGLSWGEGVTPEQRLAVERLFLPVSEVLELPESQLDAFLALTSSGPAYVALVAEAMADGAVAAGLPRSLAHHLAHRTLAGTAALLKQQKLHPAELKDMVTSPGGTTIAALRKLERAGVRSALIEAVVAAAQRSRELA

SEQ ID NO: 26736 - protein, 323 aa, Acidobacteria bacterium Ellin345
MKALLVEQLGKLESLALRDVPDPQVKPDRVVVNIEAAGVNFADISSSMGKYPGVKVPYIAGREFAGTVEGTGERVMGYTQMGAFAEKIAIPRAFIWPQPQGWTSVESAAFPVNFFTAYLVYWKAGLTADAFEPAAPSKSPRRALIHAVAGGVGTAAVQIGKLLGIETIGTSSSDEKLEKAKALGLTHGINYSHDDYQQRVMELTNGEGVDCVFEMLGGEHTKRSTRCTREFGRVILYGTATGERPEFDTLTMYSKSISVHGLWLSTLANNREVIAAAWIALKPWVEAGQLKPEVGHVMPMANASEAYKLMLNRKNYGKIILTV

SEQ ID NO: 26737 - protein, 416 aa, Candida glabrata CBS 138
MSEEIKNEVIETPEEVIEKPEEVSQEVEGDNASQENDDDKPSVVPASATKGGRETSDRVLYVGNLDKSITEDLLKQYFQAGGPIQNVKIIEDMKNEYVNYAFVEYIRSHDANVALQTLNGVQLENKTLKINWAFETQQAAENDDTFNLFVGDLNVDVDDETLAGTFREFPTFIQAHVMWDMQTGRSRGYGFVSFSNQEEAQKAMDAMQGKDLSGRQIRINWATKRERNMGNNFGNNRGSRGGNFRPYGNQGHHNRNNRNMMPPAMGMPMDGLMPMQQGQQNGQQPNVQQQQPMVPPPVNPQAIEDMIRRAPPRVTTAYIGNIPHYATEADLIPLLQNFGFILDFTHYPEKGCCFIKYDTHEQAAVCIVALANFPFQGRNLRTGWGKERTNFMPPQGAPGQQMPVMMDPSQAPPAPQ

SEQ ID NO: 26738 - protein, 563 aa, Zea mays
MPSHTLYKHINSIAISHKITSGGKCDFDLAATFFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPVGIGRNTKIRNCIIDMNARIGKNVVITNSKGIQEADHPEEGYSYYIRSGIVVILKNATINDGSVI

SEQ ID NO: 26739 - protein, 255 aa, Bacillus cereus G9241
MSDYIVVKCGGSMLDQLNDVFFDCIKKLQQKYKVVIVHGGGPEIDAQLKDCNINVEKRDGLRVTPKEVMDVVQMVLCGSTNKKLVMNLQKHNLRAVGCSGCDGNLLQVQPVSEEIGYVGEVRYVETALLKGLINMNYIPVIAPVGINDNEIYNINADTAAAGIAAALSAKELIFITDVDGVLHEGKLVKKTDEFEIVNFIENGVITGGMIPKVQAALASLKMGVQKVSIVNGMKDFTEVTGECIGTTVTRGVSIA

SEQ ID NO: 26740 - protein, 309 aa, Coccidioides immitis RS
MSHLMHLKLSFERHLRTKPSRMSTVIAEALPERLPVEEECSSSYSPNHFYPVRLGEIFNERYQVVAKLGFSSNSTIWLAKDLHQWRWRSARYVAVKVNANPDDVKSAAEREFQVSQLLQGTKSRLVNSKPAGITGHQYAHILQDYFNLNGPHGVHFCTISDPLGESLEDLKQRLEGRIPLNLLKAVTRMILRGLEFLHAECLFIHTDLKPESIRLTLGRWEPQAVARAERKTPRPQKKLEDRTIYTSRQAGDLNDLVRVVITDFGASVAGNDCFRYEHLIQSLPYRAPEVIIGAGWSYGADIWNLGVMV

SEQ ID NO: 26741 - protein, 215 aa, Campylobacter jejuni subsp. jejuni NCTC 11168
MYVAPSLLSANFLKLEEEVKAIEAAGADLLHIDVMDGHFVPNLTFGPCVIEKISTISKLPLDVHLMVKDVSKFVDLFISLKPKFISFHMESEVHPIRLCEYIRSQGIHPAIVLNPHTPIDSIKHMLEFVDMVLLMSVNPGFGGQKFLPLIHEKIKELRQMIDKKNAKVFIEVDGGVNGLNASDLEESGADILVAGSYIFSSNDYKTAISSLKLEF

SEQ ID NO: 26742 - protein, 499 aa, Physcomitrella patens subsp. patens
MAYKFFKWVRTQRGGVPSVRACTTLVEMLGIARRFNEAEEVLAEVEKSRYILQPRIFIELARGYASAGLLEKSVEALKRMEGHRCALTASAYNSLIDAFVKAGYTQKALAVYRVMGQSGLRPDTYTFNVLMNAFKKAKRVDSVWKLFEEMQNQNCSPNVITYSILIDAVCKCGGVEKALKVFLDMKSRGCRPNIFTYTSMIDGLGKSGHVDKAFFLFEEMTSEGLVATRVVYNSLIHGLGRSGRADAAAKLFREMLSKGLQPDHVTFTSLVYGLGVAGRASEARRIFQEARDVGCALDVNLYNVLIDTLCKSKRLDEAWEIFGELEEDGLVPDVYTFNALMDGLCKSGRIHDAFILLGDMKRAGCTPDVTVYNTLIDGLRKSGRVEEAGQLLLEMQSLGYEPDVVTYNTLIDESCKGGRIEDALRLFEEISAKGFANTVTYNTILNGLCMAGRVDEAYKLFNGMKQETVDGVIDPDFVTYTTLLNGARQAGLSELANSL

SEQ ID NO: 26743 - protein, 461 aa, Lactobacillus plantarum WCFS1
MMKKVSAEDTVKTSVKEDQTSFGFDNSLPNLPIKTILAMTFGCIGVNMAFTLQGSQMSRITQTIGVNPNSLGWFFLLPPLLGMFVQPLLGKYSDSTWTRWGRRIPYLLVGAPITVIVMIMLPFTGSFGFGYGSMTAMVYAAIAIALMDLFSNVCLAPYKMLAGDMVNEKQKNLAWSWQQVFGYAGGILAALLPYILTKVGIANTASKGQVPATVIWAYLIGAVMLLVTSLVTIFNVHEYDPKTYAKYHKINESKQKVTPSLWKLLKTAPRSFWELAIVQLFSWIGIMYTWTYATGAMANNIWNTTNPASSGFQAAGNWYGVMTAFYSVAALLWGLFYAKTKATQRKFWYSFGLFADAISIIIVATTHNQWVALIAFALYGIGNFTINTLPYTMLTTSLDGRNNGSYLGLFNIAVCLPQIIGSLASFIIFPLVGNSQSMMMIIGFVAMVIGGFSVAIVHEGK

SEQ ID NO: 26744 - protein, 237 aa, Coccidioides immitis RS
MPLLARCPTLLSATPPLVTSSTSAALSRSLPRYSSSSLRPIARPSINLSTKNNSQFSRQFHASSAAMTIKTFFDVEYTDLSGAKKTERIVFNLFDEDVPKTAENFRALCTGEKGFGYKGSSFHRIIPKFMLQGGDFTRGNGTGGKSIYGDKFADENFKRTHTGPGILSMANAGPNTNGSQFFITTEKTSWLDGKHVVFGEVANPESLQAVMNIEKTGSSSGAITTKTKPTIVDCGQL

SEQ ID NO: 26745 - protein, 457 aa, Haemophilus ducreyi 35000HP
MATGKIVQIIGAVIDVEFPQDAVPKVYDALKVESGLTLEVQQQLGGGLVRCIALGTSDGLKRGLKVENTGNPIQVPVGTKTLGRIMNVLGEPIDEKGPIGEEARWDIHRAAPSYEEQSNSTELLETGIKVIDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGEEHYNVARGVQGTLQRYKELKDIIAILGMDELSEDDKLVVSRARKIERFLSQPFFVAEVFTGSPGKYVSLKDTIRGFKGILEGEFDHIPEQAFYMAGSIDEVVERASKM

SEQ ID NO: 26746 - protein, 279 aa, Bacillus cereus G9241
MSIQNISFLGAGSIAEAIIGGLLHANVVKGEQITVSNRSNETRLQELHKKYGVKGTHNKKELLTDTNILFLAMKPKDVAEALTPFKEYIHHNLLIITLLAGVSTHSIRNLLEKDIPIIRAMPNTSAAILKSATAISPSKHATKEHIQTAIALFETIGLVSVVEEEDMHAVTALSGSGPAYIYYVVEAMEEAAKEIGLKEDVAKSLILQTMIGAAEMLKASEKHPSILRKEITSPGGTTEAGIEVLQEHKFQQALISCITQAAQRSHNLGKTLEQLTKEK

SEQ ID NO: 26747 - protein, 425 aa, Xylella fastidiosa Temecula1
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 26748 - protein, 420 aa, Idiomarina loihiensis L2TR
MKDKICVIGMGYVGLPLAVAFAEKYSVVGFDINFSRVQELEAGQDSTLEVSSKELQAVKDLLKFTNNAADIRDANIYIVTVPTPIDRSNKPDLSPLEKASETVGSVLKAKDIVIYESTVYPGVTEEVCVPVLEKVSKLSYNQDFFCGYSPERINPGDKQHTVKNILKVTSGSTPETAERVDALYSSIITAGTHLASSIKVAEASKVIENTQRDVNIALINELAMIFNEMGINTDEVIEAAATKWNFIKLKPGLVGGHCIGVDPYYLTYKAEELGYKPNLILSSRQINNGMGKYVADATIKELIDKEKLVKNANVLILGYSFKENCPDVRNTRVVDVVENLYKYGVNVHIHDPWVAKPTSTDGLTFVTEVSSKSNFYDAIILAVNHDCFSSYTENDFAKLVRGKFILIDVKSVKNFSTWKL

SEQ ID NO: 26749 - protein, 283 aa, Bradyrhizobium sp. BTAi1
MNLFVIGFGYTAQRVVDLHGSGFSRITGTVRSAEKRALLAADDIHLFDGTRPADATLAKAAQADIVLISVPPGSGDDPALTAFGDAITTGRARRVIYLSTVGVYGDHQGAWIDEATPLAPEHDRVQARVRVEQEWQARIGDRLTVLRLGGIYGPGRNALVELRAGRARRIVKPGQVFNRIHVDDAAAAVMAAVRCGKGGAWNIVDDEPAPPQDVIAYAAKLMGVAPPPELAFDSAELSPMARSFYASNRRIRNIRAKQELGLVFTYPTYRAGLDALWAAGEGR

SEQ ID NO: 26750 - protein, 336 aa, Idiomarina loihiensis L2TR
MILVTGGAGYIGTHCCVELIESGYDIVVLDNLKNSTLEGLRQVERIVNKRVRFVEGDVRDLGLLEKLFGEFKFNAVLHLAGLKSVNESLSHPVEYYENNVTGSLSLLKVMEKFGCKCIVFSSSATVYGHPECVPISENSTLSTINPYGSSKLMVENILRDLSSSTLGWSIGILRYFNPVGAHESGLIGELPLGVPNNLMPYIAQVALGKLEKLTVFGNDYNTKDGTGVRDYIHVVDLAKGHVEALRELFGKEDLFIANLGTGVGYSVLELIKNFEKISGRKVPYEVGNRRRGDVAACYADPSYAKSRFGWSAEFDIDRMCHDTWRWMVKSNKTSVD

SEQ ID NO: 26751 - protein, 151 aa, Herminiimonas arsenicoxydans
MKVSEILKVKGNILFTVTPDSPMLDAVNVMAEKDIGSLVVMEKGNLIGMLSFREVMATIHAHGGAIGGGSVRQHMDSSPITISCDTEINEVRRMMLEKHARYVPVMDGKILVGVISFYDVAKAVLEAQSFENKMLKSYIQSSPAMASEQDG

SEQ ID NO: 26752 - protein, 402 aa, Oryza sativa Japonica Group
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCRYSNHQSHFSI

SEQ ID NO: 26753 - protein, 314 aa, Oryza sativa Japonica Group
MGSGSLLKVLAKNFDVLAGPLVALAYPLYASVKAIETKSPVDDQQWLTYWVMYSLITLFELTFASIIQWLPFWPSMKLIFICWLVLPYFNGAAFVYQNYVRPMFVKHQMVNIWYVPQKKGLFGKSDDFLTALDKFIEENGPEALKKLTNKAGKSSKQSGKSWKDSKSSKESKDSKSSKESKEPKPSKDSKQLKPPKVSKESKPLKDSKEDKKAVKEDKKAAAKDSKEQKKALKDSKELKKALKDSKEQGSQKDSDELKPKSNKRVTFAEVEPEKELKASNSDWHPTSEYHSVYPEHNSWSSSFMIFEDENSYWN

SEQ ID NO: 26754 - protein, 515 aa, Oryza sativa Japonica Group
MTTTTPFKPLPPPALTARNPSSSGRPPKPESSTVSAAAAAAAAAAAPKPDSASAAAGDGKEDPKGLFTDNIQTSGAYSAREEGLKREEEAGRLKFLCYSNDGVDEHMIWLVGLKNIFARQLPNMPKEYIVRLVMDRTHKSMMVIRNNIVVGGITYRPYTSQKFGEIAFCAITADEQVKGYGTRLMNHLKQHARDADGLTHFLTYADNNAVGYFVKQGFTKEITLDKERWQGYIKDYDGGILMECRIDQKLPYVDLATMIRRQRQAIDEKIRELSNCHIVYSGIDFQKKEAGIPRRTMKPEDIQGLREAGWTPDQWGHSKSRSAFSPDYSTYRQQLTNLMRSLLKASLLSSQIFLYDMQPFGLTSLDKPVLCLLPFEFFAPFLFQAYFLKPDQLDGLFNGSMIEMATFYKFNIQIFLNMNEHPDAWPFKEPVDSRDVPDYYDIIKDPIDLKTMSKRVESEQYYVTLEMFVADMKRMFSNAKTYNSPDTIYYKCASRLESFFSNKVASQLAQASTKN

SEQ ID NO: 26755 - protein, 221 aa, Clostridium acetobutylicum ATCC 824
MGITYNLQKVKEKIPKEVTLVAVSKTKPIEDIKEAYEQGIRDFGENKVQELMSKYDEMNSDVRWHLIGHLQVNKVKYIVGKVFLIHSLDSIKLLKEIEKRYTNEGLKADVLIYVNIGREESKTGILEENLEALLDECQKCNSVNVKGLMAVIPVGDDNSNRHYFRKMKAIFDDLKHKNIKNVDMKYLSMGMTHDYEIAIAEGANIVRVGEGIFGKRDYNKI

SEQ ID NO: 26756 - protein, 261 aa, Coprinopsis cinerea okayama7#130
MKFLGPFGLLSAALVGFANGAAIHGSTSQHHHRELAKRASGELVKRVTNSKWSFYDTETGNAGACGQHIRNSDFVVAMNTADFRQSDCFKTITLSFGGKTTQATIGDMCPGCPPGGLDLSMGLFAFFADHGRGIIYGEWNFGEPAPPPPPPPPPPPPPPPPPPPPPPPPPTTLEPPPPPPTSSEPPPPPSTSATPTSSAVPSSSVVPSEASSTLSGSGASLRPTASATPSPAVGNLGALNQLVVQFAEVVVDGAAAPRDVA

SEQ ID NO: 26757 - protein, 1448 aa, Botryotinia fuckeliana
MERLEHMSWRNKTPCMGLSWGTQHWTPTPQILTYINGLKCKFWHVQVFIWTQTNCTCRMMRLVDENGVIQRRAGIVFKNLKVCGSGSAINVQKNVGSLLMAPLRFKEFIGKGPEKTILNDFNGVLKSGEMLIVLGRPGSGCSTFLKSLMGELYGLDMKAQSEIHYNGITQKQMLKQFRGEIVYNQEVDKHFPHLTVGETLEFAASVRTPQQRLVEGTTRSAWAKHMTKVVMAIYGLSHTYNTKVGNDFVRGVSGGERKRVSIAEMALAGSPIASWDNATRGLDAATALEFTKSLRMTANLSGSCHLVAIYQASQQIYDQFDKAIVLYEGRQIYYGPCDQAKQYFEDMGWECPSRQTTGDFLTSITNPSERKARPGYENKVPRTPEEFEKYFKDSKIFQRMMSEMKSHEEEFPMGRKTLEQFKASRKGMQADHLRPESPYTVSIVMQTKLCARRAVQRLWNDKTSTITTIVGQIAMALIIGSIFYNTPSNTASFFQKGGVLFFAVLLNALIAISEINTLYSQRPIVEKQASYAFYHPFTEALAGVVVDIPVKFAIATCFNIILYFLSGLKREAGAFFVFFLFNFVAILTMSQIYRSIAAATKTISQALAIAGVATLAIVIYTGFVIPRPLMHPWFKWISWINPVAYAFEALFVNELHGKEFVCSTLVPTGPGYVQAGNNFVCAVAGSVVGATTVSGDDYLQAQFQYSYSHIWRNLGFLFAFMIFFLAFYLLATEFNASTDSKAEVLVFRRGHVPTNLLAAEKAAKNDEEAHAGNGSAVKEGNSDKQGDEVQALAPQTDIFTWKDVCYDIKIKNEPRRLLDNVSGWVKPGTLTALMGVSGAGKTTLLDVLAQRVSMGVITGDMLVSGKPLDASFQRKTGYVQQQDLHLETTTVREALRFSAMLRQPKTVSKKEKYDFVEEVIKMLNMEEFSEAVVGVPGEGLNVEQRKLLTIGVELAAKPALLLFLDEPTSGLDSQSSWAIVSFLRKLADNGQAVLATIHQPSAILFQEFDRLLFLAKGGRTVYFGDIGHNSETLLNYFESHGAAKCGEDENPAEYMLTMVGAGAQGKSTQDWHEVWKASDEAKGIQTEISRIQQEMGHQPSQDDSNSHGEFAMPFTVQLLEVMKRVFQQYWRTPGYVYSKLVLGVASALFIGFSFFHADASQQGLQDVIFSIFMITTIFTTLVQQIMPRFILQRDLYEVRERPSKAYSWKAFIIANIAVEIPYQIILGIMVFASYFYPIYTKNGIPPSGRQGLILLLLIQFFVFASTFAHMLISALPDAETAGNIATLMFSLTLTFNGVFQPPQALPGFWIFMYRVSPLTYLVSAIASTGLSGRQVICSDNELAVMQPPAGDTCGSYLQSYATAAGGSIYNPEAMADCQYCSSSNADQFLSSVAISYTTRWRDYGIVFVYIFFNIFMAVLLYYLIRVRKSSGKSLKEKFGALGALFKKN

SEQ ID NO: 26758 - protein, 479 aa, Arabidopsis thaliana
MTFREKMPTSPKSPLRRRRSSWTGTWLNHQTTSFKQAVSAVIQAQSPRSRFKSLSSDFSDVDRTLSLSDSLLLKILEKLPESQNEDVSLVCKRWLSVQGRRLRSMKVFDWEFLLSGRLVSRFPKLTSVDLVNACFNPSSNSGILLCHTSISFHVSTDSSLNLNFVEESLLDNEMVDKGLRVLGRGSFDLIKLVVINATELGLLSLAEDCSDLQELELHKCSDNLLRGIAACENLRGLRLVGSVDGLYSSSVSDIGLTILAQGCKRLVKLELSGCEGSFDGIKAIGQCCEVLEELSICDHRMDDGWIAALSYFESLKTLLISSCRKIDSSPGPGKLLGSCPALESLQLRRCCLNDKEGMRALFKVCDGVTKVNIQDCWGLDDDSFSLAKAFRRVRFLSLEGCSILTTSGLESVILHWEELESMRVVSCKNIKDSEISAALSSLFSLLKELTWRPDTRSHLSSSLEGTGIGKRGSKFFKKR

SEQ ID NO: 26759 - protein, 439 aa, Prochlorococcus marinus str. MIT 9313
MPALSSTMTEGKIVEWLKQPGDKVGRGESVLVVESDKADMDVESFQDGYLAAVLMPAGCSAPVGETIGLIVESEAEIAAVQANAPAAPASDPAPLKTAAKVVDDPAPASTPAPVVESPPVAAPPPVASQAVDTDKRIVASPRAKKLAAQMGVDLAKLRGSGPHGRIQAEDVQLAAGQPISVPQLAEGNASFATTHATSAGVAHAVSSPVGQSFGAPGETAAFNNLQQAVNRNMEASLAFPCFRVGYTITTDQLDAFYKQVKPKGVTMTALLAKAVALTLVRHPQVNAAYSTAGMVYPEQVNVAVAVAMDDGGLITPVLQNADRTDLYEMSRQWADLVKRSRSKQLQPEEYSTGTFTLSNLGMFGVDRFDAILPPGTGAILAVAASRPAVVAGKDGSIAVKRQMQVNLTADHRVIYGADGAAFLKDLAELIETRVESLAL

SEQ ID NO: 26760 - protein, 411 aa, Thiobacillus denitrificans ATCC 25259
MIRTVFALGAHPVRAAFLMEENMSDPLTATPAAPAHSLGDEFALDPGLVYLNHAAVAPWPRRTARAVQRFADESLHYGASHFPRWMEKEVQLRGQCRDLVNAPSADDIALLKNTSEALSVVAHGLDWQAGDNVVISDEEFPSNRIVWESLRARGVETRRARLAAAPSPEDALAACIDARTRLLSVSSVEYASGLRLDLDRLGEICRARGVLFCVDAIQSLGVLPFDVAACGADFVMADGHKWLLAPEGLALFYVRPEIRDRLRLNQYGWHMVEEAFDFSRDDWQIAASARRFECGSPNMLGIHALSASLEVLAEAGTANVAAQVLAHSAYLMDALAALPGIEILTPRAPGRYAGIVSFRHVRVAPVELHARLIAQRILCAQRGGGVRFSPHFYLTREQLDTAVAAVAAATR

SEQ ID NO: 26761 - protein, 328 aa, Prochlorococcus marinus str. MIT 9313
MSRIYEDNSQAIGNTPLVKLHAVSKNAKATVLAKIEGRNPAYSVKCRIGANMIWDAEKRGLLSKERTIIEPTSGNTGIALAYTAAARGYKLILTMPESMSLERRRVMAVLGAELILTEAAKGMPGAIAKAKEIAESDPQKYFMPGQFENPANPDIHSKTTGPEIWNDCDGAIDVLVSGVGTGGTITGVSRYIKQEKGKAIISVAVEPTHSPVISQTLNGEEVKPGPHKIQGIGAGFIPKNLDLSLVDRVEQVSNDESIAMALRLANEEGLLVGISSGAAVAAAIRLAEQPEFAGKTIVVVLPDMAERYLSSVMFESVPTGIIQAPVAA

SEQ ID NO: 26762 - protein, 351 aa, Idiomarina loihiensis L2TR
MKVLVTGTAGFIGFYTALKLLKQGHTVVGLDSINDYYDVNLKYGRLQESGIKQSNIEYGATVQSGLYPDYSFVQLKLEDKPALDALFEQEQFDAVCNLAAQAGVRYSLENPNAYIDSNIVGFMNVLEACRHNGVKNLSYASSSSVYGLNEQMPFSTSHSVNHPVSLYAATKKSNELMAHTYAHLYGMQCTGLRFFTVYGPWGRPDMAPFIFTKAALKGDTIKVFNNGKMKRDFTYIDDIVEGVVRVIENPCKASSEWSGKQPDPSSSSAPYKIYNIGNSQPIELMTFIEAVENAAGVEIPKDFQPIQPGDVVATYADVSELESDMGYRPSTPVTEGMKRTVDWYRNFYGMA

SEQ ID NO: 26763 - protein, 330 aa, Oryza sativa Japonica Group
MRRSLVIVMVACSCATAIARGGGGGGLKLNFYSESERCPRAEEVVREEVRRLYEEHGNTAVSWLRALFHDCMVYSCDASLLLHTTTTTGVSEQSSHRSFGMRNFKYITAIKAAVERECPATVSCADILALAARDGVAMLGGPSVAMRTGRRDSRESYYGVVEQYIPNHNDSVSTVLSRFAAIGVDTEGAVALLGAHSVGRVHCFNLVGRLYPQVDGSMEAAYGEYLRGRCPTAAATEDTREVVYARNDRVTPMLIDNMYYRNLLAGRGLLLVDQQLASDARTAPYVRRMAADNDYFHQRFAAALLTMSENAPLTGAQGEVRKDCRFVNSS

SEQ ID NO: 26764 - protein, 438 aa, Salmonella typhimurium
MALLPAVRRYGRLTRATGLVLEATGLQLPLGATCIIERQDGPETKEVESEVVGFNGQRLFLMPLEEVEGILPGARVYARNGHGDGLQSGKQLPLGPALLGRVLDGGGKPLDGLPAPDTLETGALITPPFNPLQRTPIEHVLDTGVRAINALLTVGRGQRMGLFAGSGVGKSVLLGMMARYTRADVIVVGLIGERGREVKDFIENILGPDGRARSVVIAAPADVSPLLRMQGAAYATRIAEDFRDRGQHVLLIMDSLTRYAMAQREIALAIGEPPATKGYPPSVFAKLPALVERAGNGIHGGGSITAFYTVLTEGDDQQDPIADSARAILDGHIVLSRRLAEAGHYPAIDIEASISRAMTALITEQHYARVRLFKQLLSSFQRNRDLVSVGAYAKGSDPMLDKAITLWPQLEAFLQQGIFERADWEDSLQALDLIFPTV

SEQ ID NO: 26765 - protein, 440 aa, Chlamydophila caviae GPIC
MSPVVYKFGGTSLGTAESIRKVYAIVCKNTPRFIVVSAVAGITDLLDMFCCVSSEYREQIVLDIAKKHDEIIHELQLAFSLSPWIEKLNKWVDKKEISLGDRAEILALGEDISASLFQAFCHSNNFPIEFLEARTVILTDDEYHRATPDISRMRENWHTLNLKGDACYITQGFIGASTSGKTTVLGRGGSDYSGALIAEMSCAEEVRIYTDVNGIYTMDPRIIEDAQLIPELSFEEMQNLATFGAKILYPPMLSPCVRAGIPIFVTSTFDVSKGGTWIYAMDKTVSYEPRVKALSLRQHQRLWSVDCGILGAVSLDKILPILDTYRILPGLITSQDAKVSFTTDDDDISEEIIQDLYSQLSNIGTVHMLYDLALITMIGSGLASTKVVTTVTDKLRNYPAPVFCCCQSCMALSLVVPENLAGSIVEQLHNDYVKQKFSVV

SEQ ID NO: 26766 - protein, 446 aa, Triticum aestivum
  misc_feature (112)..(112): Xaa can be any naturally occurring amino acid
  misc_feature (315)..(315): Xaa can be any naturally occurring amino acid
  misc_feature (344)..(344): Xaa can be any naturally occurring amino acid
  misc_feature (368)..(368): Xaa can be any naturally occurring amino acid
  misc_feature (434)..(434): Xaa can be any naturally occurring amino acid
MDAAISAAHEAPPAVVLVSAGASHSVALLAGNVLCTWGRGEDGQLGHGDAEDRLVPTVITGFEAPGITSVICGADHTTAYSEDEHQVYSWGWGDFGRLGHGNSTDVFTPQPXVKALQGIKIKQLACGDSHCLAVTMAGEVLSWGRNQNGQLGLGTTEDSLLPQTIQAFEGISVNMIAAGAEHTAAVTEDGEIYGWGWGRYGNLGLGDRNDRFVPEKVSSVEGEKMVLVACGWRHTITVSSSGSLYTYGWSKYGQLGHGDFEDHLVPHKVEALKDSSTSQISGGWRHTMALTSDGKLYGWGWNKFGQVGAGDNADXHCSPAQVNFPEEQKVAQVACGWRHTLAFXEKKNVFAWGRGTSGQLGHGEIVDXRNTPVIIDALSPDGPGSKKLESSAAIPFAAKIWVSPSERYALVPDEKVAKPGDVSARGNGADASVXPENDVKRMRVSS

SEQ ID NO: 26767 - protein, 235 aa, Zea mays
  misc_feature (94)..(94): Xaa can be any naturally occurring amino acid
  misc_feature (123)..(123): Xaa can be any naturally occurring amino acid
MAEEPAIVVAASSSCEVDLGNLMAYDPCHHVAAAASASREELRQECLRKGTELAQAVADALFALPPTEDRDGPIVHLPPHTVRLPREKHFMFLXLPKPKPPTKWELFAKAKGITKRKKVTTQXREREWDEQTQSWKRTHGYARVNDDKDIPIIEAKLTDEPGVDPFAQRRDEKKKRVEKQEKNRLDNLKKAAKVGALPSHIQLAAKALPITGTKADLPKKKKKKKKNHVRVAYHC

SEQ ID NO: 26768 - protein, 489 aa, Idiomarina loihiensis L2TR
MIKNGPYLALDTSYQKLSVDELLETAGKRLPEHFDDYRQQLCRGEYRNISEDRPVTHVLSRSVHAVAKQSNRKTRFVDTVQKLRSGRRLGSTGKPITDVVNIGVGGSDLGPQMGAFALREFANDAALHNLQVHFVSSMDGGQLYAVLPIVDPETTLFIISSKSFGTVDTFANVDTVRKWIEPELTQEQWLENHVIGVSANAQGMTDYGIPPAQQFTFGDGVGGRFSLWSALGLSIALTTGIRPFERMLEGAKAMDEHFLDAPLNENLPVLLALYGVYNREQLGINNLAILPYDGRLRMLPNYLQQLDMESNGKQYTAENEAIDYPTGPIIWGGFGPNGQHAFFQHLHQGYDQFTADFVTVLKREAPGFSDATRSGLAEQQRLAVANCLAHRRLMSDGSENADSPSDHYPGGHPSNLLIMDELTPESFGALIAAYEHKVFTQGVIWGLNSFDQPGVEKGKKIAMDVLRVLDGESDESFDESTDAVIQRMR

SEQ ID NO: 26769 - protein, 396 aa, unidentified eubacterium SCB49
MPAVSKKGLSMPESPIRKLVPYAEKAYKANKTVFHLNIGQPDIKSPQIAMDAVTSHNLEILAYTRSEGSELYRNKIAGYFQKHNINVTGDEIIVTTGGSEALLFAMGSIADTDDEIIIPEPFYANYNGFATASGINIVPVNSKIEDNFALPPIEEFEKLITPKTKAILICNPGNPTGYLYSKEEIQKLAKIVKKHDLFLVADEVYREFTYDGAKHYSILEEESLVENAIVIDSVSKRYSMCGARIGCLVTKNKEVLKTALKFAQARLSPPTFAQIASEAALQTPQSYFDDVIVEYKERRDTLVKHLEEIPGVKVGHPKGAFYCIAQLPVKNSDDFAQWLLESFDVDGATIMVAPAAGFYSTPGVGKNQIRIAYVLNTESLIKAVHILKEALKVYKD

SEQ ID NO: 26770 - protein, 784 aa, Gibberella zeae PH-1
MAANAAPGAVDQLANDLNNTSLNGSEANAPAVDTGVTAAADDAAAPTPTTTAPHPQNSASLYVGELDPSVTEAMLFELFSQIGAVASIRVCRDAVTRRSLGYAYVNYNATPDGEKALEELNYTIIKGRPCRIMWSQRDPALRKTGQGNVFIKNLDVAIDNKALHDTFAAFGNILSCKVAQDETGASKGYGFVHYETDEAASQAIKHVNGMLLNEKKVYVGHHIPKKDRQSKFEEMKANFTNVYVKNIAADVTEDDFRQLFEKYGDVTSSSLARDQEGKSRGFGFVNFTTHESASKAVDELNNKDFHGQDLYVGRAQKKHEREEELRKSYEAARRGEGQQMNKECGSITSTKVMRETPTEVVEEKKEKAETVKENQEEVKDEVKEEPKEESKDETKEGEEDKKAEKKSDKKLGKSKGFGFVCFSNPDDATKAVAEMNQRMFNGKPLYVALAQRKDVRKSQLEASIQARNQIRMQQAVAHAGMPQQYMQPPVYFAPGQQPGFMPQGGRGVPFPQGGMGMPQGRPGQFPYPQQGGRGGVPQQMPPNMYGMPGQFPPGYGQPGTPQFMAAMQAQQAALGGRGAPQGGRGGPQGMPGMPPMAGNMPGFPPNNNRQGGRGGPGRNGNGPQGGRGADAAGLSSLQQQLASAPPPQQKQILGELIFPKIQAINADLAGKITGMLLEMENPELVNLIEDESALKAKVDEALAVYDEYVKTQTSEGGREIQKFGDFKVAGSRREPSLAHSNGVGAFERTHQDGVDGFLTLWLLAYTPYQWSSFAGTINAEVLCG

SEQ ID NO: 26771 - protein, 356 aa, Herminiimonas arsenicoxydans
MKIAILPGDGIGPEIMNQAVKVMNALGEKFETETVPVGGAAYAEQGHPLPESTLKVAKEADAILFGAVGDFKYDTLERSLRPEQAILGLRKHLGLFANFRPAILYPELAGASSLKPEIVSGLDIMIVRELTGDIYFGQPRGMREAPDGPFKGAREGFDTMRYSEPEIRRIAHVAFQAAQKRSKRLTSVDKANVLETFQFWRDVVTDVHKEYKDVKLDHMYVDNAAMQLVRAPKEFDVVVTGNMFGDILSDAAAMLTGSIGMLPSASLDANNKGLYEPSHGSAPDIAGKDIANPLAQILSLAMMLRYSLGKTEQADRIETAVKAVLKQGLRTVDIYEAGTTKVSTTQMGDAVVKALA

SEQ ID NO: 26772 - protein, 486 aa, Atuna racemosa
SWSSAFEKKTLGRIAQIIGPVLDVAFPPGKMPNIYNALVVKGRDAVGQQINVTCEVQQLLGNNRVRAVAMSATDGLMRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATTLEMENN

SEQ ID NO: 26773 - protein, 306 aa, Neurospora crassa
MTSDKPVVAATTTKTKKSKQQTIHYPFWFGGSASSMAATVTHPLDLVKVRLQMRTGDAPKTMSGTVLHIIRHNGITGLYNGLSASLLRQITYSTTRFGIYEELKTRFTTKDHPASFPVLIAMATVSGVAGGLVGNVADVLNVRMQHDAALPPAQRRNYAHAIDGLARMTREEGFRSWFRGVWPNSARAAAMTASQLASYDVFKRILIRHTPLEDNLATHFSASFLAGVAAATVTSPIDVVKTRVMSASGKSSIGQVLGSLYAQEGVRWMFKGWVPSFLRLGPQTICTFIFLEGHRKMYKKVKGIEE

SEQ ID NO: 26774 - protein, 482 aa, Austrobuxus megacarpus
EKTNPGRIVQIIGPVLDVAFPRGKMPNIYNALVVKGRNSTGQQINVTCEVQQLLGNNRVRTVAMSATDGLMRGMEVIDTGAPLSVPVGGATLGRIFNVLGEPVDELGPVDTRTTSPIHRSAPAFIQLDTKLSIFETGIKVVDLLAPYRRGGKIGLFGGAGVGKTVLIMELINNIAKEHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRPLAVKGIYPAVDPLDSTSTMLQPTIVGKEHYETAQSVKQTLQRYKELQDIIAILGLDELSEEDRLTVARARKIERFLSQPFFVAEVFTNSPGKYVGLAETIRGFQLILSGELDSLPEQAFYLVGNIDEATAKAANLEMENDLK

SEQ ID NO: 26775 - protein, 501 aa, Oryza sativa Japonica Group
MPRRPSGGGGGAGPAAAAVRKVPLRKLLRAASVACGVQFGWAPQLSLLTPYVQELGIPHAFASLVWLCGPLSGLLVQPLVGHLSDRIAPAASPLGRRRPFIAAGAASIAAAVLTVRFSADLGRIFGDSITPGSTRLGAITAYLVGFWLLDVGNNATQGPCRAFPADLTENDPKRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 26776 - protein, 312 aa, Buchnera sp.
MKLFSGNSIPKLAKFIANRLYINLGKASVGRFSDGEISVQINENVRGSDVFIIQSTCSPTNDNIMELVVMVDSLRRASAGRITAVIPYFGYARQDRRVRSARVPITAKVVADFLSSIGVDRVLTVDLHAEQIQGFFDVPVDNVFGSLILLEDMLQRELKNPIVVSPDIGGVVRARAIAKLLYDTDMAIIDKRRPRANVSQIMNIIGDVANRDCILVDDMIDTGGTLCKAAEALKERGAKRVFAYATHPVFSGDAPKNLKNSVIDEVVVCDTIPLSENIELLPNVRTLTLSGMLAEAIRRISNEESISAMFEH

SEQ ID NO: 26777 - protein, 380 aa, Coprinopsis cinerea okayama7#130
MAANFFAARAPSNKNNAAAAKHVVNPANQPWVEKYRPKTINEISAQEHTTSVLSRTLTSANLPHMLFYGPPGTGKTSTILALARELFGPDNFRNRVLELNASDERGISIVRDKIKNFARQTPRAQQAVSSDGKTYPCPPYKIIILDEADSMTQDAQGALRRIMETYAKITRFCLVCNYVTRIIEPLASRCSKFRFTPLDPDSASARLSYIAQAENIDISKPVIDALISTSHGDLRRAITYLQSAARLAGSSDPPTPILPRDIQEIAGVVPDGVVNDFASTLGVPVEDEGMEVDGQTSRKATNFSGIQKKVKELMREGYSATQILSQLHDLIMLHPELNGLKKSKCALAFAEADKALCDGADEELWVLEVGLKIHKAVNAP

SEQ ID NO: 26778 - protein, 150 aa, Triticum aestivum
NKFVQKSRLVPVRNSRDIVDPRVRAKQVGIKDEESVVVRITGCPNGCARPYMAEVGFVGDGPNSYQIWLGGTPNQTTLAETFMNKVKLQDIEKVLEPLFSYWNSTRQEGESFGSFTNRMVSGFYFSIRYCCSFVICERVVWTSEKMVICC

SEQ ID NO: 26779 - protein, 207 aa, Oceanobacter sp. RED65
MSILVGKKAPDFTTAAVKGDGSIVDNFSLSDTIKGKYAVVFFYPLDFTFVCPSEIIAMDHRVEKLKELNTEVIGVSIDSHFTHNAWRNTPVNEGGIGQLQYTLAADMDHAICRAYGIESEGGESYYPAGVAMRATFVIDQNGVVRHQVVNDEPLGRNMDEVVRIVEALQFFEENGQVCPAGWNKGDSGMVNTPEGVAKYLSEEADKL

SEQ ID NO: 26780 - protein, 543 aa, Zea mays
SESGPFPRHCHYGGRRQRCGRHPLPLILPTLACLILLPLPYLSFLSLITRRPALASSYSAPGCPSMAASLLRRGVVTSRRRCPVEMLRRLVSSEAAADRAPSRPPPEMPPFDHRPRPYAGLGGAEIFEKRKAVLGPSLFHYYQKPLNIVEGKMQYLYDEHGKRYLDCFGGIVTVSCGHCHPDIVNAVVEQTKLLQHTTTIYLHHTIVEFAEALTSKMPGNLKVAYFVNSGTEANELAMLMARLYSGNLSMVALRNAYHGGSAGTIGLTGLQTWKYPIPQGEIHHVMNPDPYRGTFGSDAAAYAKEVEEHITYGSSGRVAGFIAETFQGVGGAVELAPGYLKLAYDIVRKAGGVCIADEVQSGFGRTGSHYWGFQTQGVIPDIVTMAKGIGNGLPLGAVVTTPEIASVLAQKIQFNTFGGNPVCSAGGLAVLKVLDKEKRQAHCADVGSHLLERLKSLQEKHEIIGDVRGRGLMLGVELVTDRKEKTPAKSETIELFEKLRDLGVLVGKGGLHGNVFRIKPPMCFSKDDADFLVDSMDYAMSRL

SEQ ID NO: 26781 - protein, 318 aa, Rhodospirillum rubrum ATCC 11170
MPNWKALQDSSFLEANARDRALGVVDEGTFTELAGPFDRRFSPHLEVLGEAVEFDDGIVTGVGRIGVTPVFVISQEGRFIGGSVGEVGGAKMVNTIRLAVEFHDQLVASVPDLTDAEKPIVVISFETGGVRLHEANAGLLAHAEVMDQIQKARGKVPVITLIGSKVGCFGGMGFVAAATDVIVMSEFGRLGLTGPEVIEQEMGKEEFDSSDRGLVFRTTGGKHKYIMGDCNYLVENTVAAFRAKVAELAVLPISAFEEMRRIGSAATVERQLRGVALAAEMQPKDARDVWAKAGNANAAALTDLPLADFLAQVKRLSV

SEQ ID NO: 26782 - protein, 586 aa, Physcomitrella patens subsp. patens
MDSHALAIFLRENQGEEGVTDEEANIQIRSFLAVRAHSGRHKFPGMSQRHSKRELSGRQQPATLDISAFVKFLLNPESNGHQKFFNKGLKKQPTDDMTAPLSHYYIFASHNTYLTGNQLVSKCSTRPIVKALLNGCRVIELDCHDGKDGKIKVLHGGTLTKPVDFEDCIKEIKKHAFTASDYPVILTIESHLDQEHQKRAAMLLKEILGDMMFIPSPEHRPPIAFLSPEELKNRIIISDKPPGESVACQIKEEPETLDNLGSKSIPRTDDSDSEEDVQAKWERKMQRRQSKIAKNVALKVASMRCKDDENPSIAKIHEFEELLYIYCQKPKEMEARQVKGGPLVAGDRAIMANLAEPQLYRLIKEHPSSLTEFSKTNLGRVYPFGLRIDSSNANPTDAWSHGLQVAAINMQGHDRPVWISQAFFKRNGGCGYVKKPDFLLPGSTVDFKSLQPKLELTVKVLLGTDWHRHYDIFKKPDYFVKVAIHGFHDDEVKKRTEVKKRCSEPHWSEVFVFPLRVPELAILRLEVGEHDKFMRDDMVGQSCLPVTELRQGIRAVKLESKKGQPRNSKLLCDFSLCTLPRADLLI

SEQ ID NO: 26783 - protein, 561 aa, Pseudomonas stutzeri
MTHLKITGITCDSCAGHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNLGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPEPLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALNLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFNKDVKQLSCCAG

SEQ ID NO: 26784 - protein, 1185 aa, Leptosphaeria maculans
MASVDETVANVQRKIDRERALINAANAMRQSTNNPAVLSRLDGQIKDGHRNIEYFESKLRDLDVQRTSTGMENMSLQPGSGGSGARKPVNNPLTPPPKDGWSSYTQPDQGGYGGPQSQYSNLSGGDGLMPPRAPYAPPGPGTTNKRPNYSKLGKSHLIKYDTPHLGPRIQLMLSQLEFKLSVEKQYKDGIEKMVRLYQMEGDRKSKTDAEAKRIESAQKIQLLKHSLKRYEDLHVDIEGEGGDDDSLNIPSQRKPLSGHLSLRIHAVADVDHAATGRFSRGPETFVNIKVEDAIKGRTKPTRNDRWIDEQHEFAIDKANEIEITVYDKTGDHLLPIGMLWVRISDIAEEMRRKKIETELQNSGWVAADKMSGAAAGIQPDLQFQPPPGQNPAGTPGAPAPGGARPQGGPQPQTGPIMIDDWFSLEPVGRIHLTMSFAKNTGNKQPFDLGLGRKGAVRQRKEDVVEQYGHKFVQQQFYNVMRCALCGEFLKYAAGMQCSDCNYTCHKKCYPKVVTKCITQSNAETDPDEAKLNHRIPHRFENFSNMGANWCCHCGYVLPLGRKQTKKCAECNLTCHAHCVHFVPDFCGMSMEVANQILMEIKRTRRGQSASGPGVPPMAQRTLRPQSAKPLPPAQSQYPAQPGQEPSQTDRYSYGKEQMSPPPGPPRQPSYATSAASVDAARVSYSTSNSTPTPTSPTSSTTSRPSSGARTQSSVAAAQAAMSKTTPPAPGYGRSNTDYQPQGNRTSGGNYPADQRTPQQPQAPQQAPYDPSAYANIPSYPPAQAQQGGMQSYPPGKGSYALPQPSPQMQQPHQSPMSQKQPEAIAQIPPSKQLPPANPENKVTPSANTQGSGKRIGLDHFNFLAVLGKGNFGKVMLAETKSTKQLYAIKVLKKEFIIENDEVESTRSEKRVFLIANKERHPFLLSLHACFQTETRVYFVMEYISGGDLMLHIQRGQFGTKRAQFYAAEVCLALKYFHENGVIYRDLKLDNILLTLDGHIKIADYGLCKEEMWYGSTTSTFCGTPEFMAPEILLDKKYGRAVDWWAFGVLIYQMLLQQSPFRGEDEDEIYDAILADEPLYPIHMPRDSVSILQKLLTREPEMRLGSGPTDAQEIMSHAFFRNINWDDIYHKRVAPPFVPQISSPTDTSNFDTEFTSVTPVLTPVQSVLSQAMQEEFRGFSYSADFN

SEQ ID NO: 26785 - protein, 332 aa, unidentified eubacterium SCB49
MKEQITVGINGFGRIGRNLFRLLLEYPNIKVVAVNDIAPLATLAHLLKYDSIHGILTAEISHNEDLLTINEQQVTFTQESEIEQIAWKNVDVVIECTGKFKQRDQLQNHIDNGAKKVILSVPPIDENIKMVVLGVNEHVITKQDTIISNASCTTNNAAPMLKVIDELCGIEQAYITTIHSYTTDQSLHDQPHRDLRRARAAAQSIIPTTTGAAKALTKIFPNLADVIGGCGIRVPVPNGSLTDITFNVKKEVSIDEINNAFKEASKKHLKGIIQYTEDPIVSIDIKDNPHSCVFDAGMTSVIGKMVKIIGWYDNEIGYSNRIIDLIYFTPKK

SEQ ID NO: 26786 - protein, 525 aa, Idiomarina loihiensis L2TR
MTRDIHDHRILILDFGSQYTQLIARRIREIGVYCELWAWDVDEADIREFAPKGIILSGGPESVAEEGSPRAPEYVFNAGVPVFGICYGMQTMAHQLGGSVQCSLEREFGYAQIELVEQSPLFKAIEDAVSESGAPLLDVWMSHGDKVEMIPEGFHTVAKTSYCPYAAMADEERQFYGVQFHPEVTHTRQGQRMLEHFVSDICGCEKQWTPAKIIDDAIERIREQVGSDKVILGLSGGVDSSVTAMLLHRAIGEQLTCVFVDNGLLRLNEAEQVMEMFGDHYGLNILPIRAEDRFLDALAGENDPEKKRKIIGNTFIEIFDEEAGKLTEVDWLAQGTIYPDVIESAGSKTGKAHVIKSHHNVGGLPEDMKLGLVEPLRELFKDEVRKIGLELGLPYNMLYRHPFPGPGLGVRVLGEIKKEYCDLLRRADAIFIEELHNADWYNKVSQAFAVFLPVRSVGVMGDQRKYDWVIAIRAVETIDFMTARWAHLPYELLEKVSNRIINEVNGISRVTYDISGKPPATIEWE

SEQ ID NO: 26787 - protein, 444 aa, delta proteobacterium MLMS-1
MEKVTEFMKVVTDKNPGESEFHQAVLEVVETLMPFIEDNPKYRETKILERMVEPERVIIFRVPWVDDKGEVQINRGYRIQMNSAIGPYKGGLRFHPSVNLSILKFLAFEQVFKNSLTTLPMGGGKGGSDFDPKGKSDNEVMRFCQSFMTELYRHIGAETDVPAGDIGVGGREIGFMFGQYRKITNEFTGVLTGKSRNWGGSLIRPEATGYGAVFFAEEMFKVRGDSLAGKTCIVSGSGNVAQYTIEKVNQLGGKCVTLSDSAGFIHDPEGIDDEKLAYVMELKNVKRGRISEYAEKYGCKYYPGERPWKIPGDVAFPSATQNEIDAQDAETLVAGGCTCVSEGANMPSTSEAVRIFLKAKIMYGPGKAANAGGVATSGLEMSQNSLKLSWPREEVEERLRQIMEGIHEACYKYGKEGDFVNYVKGANIAGFVKVADAMIEQGVI

SEQ ID NO: 26788 - protein, 307 aa, Bradyrhizobium sp. BTAi1
MTGRPDLQGDATALTRPGGATRLAFFILCHKAPHQVIRLIERLRDDRNVFVVHVDKRAAVEVYQELQALSERLPSQVFLCTERHRCYWGRFGIVAATLSCMREAITRTLAFDRAFLLSGQDYPIKSQNEIRARLDAHPNAEFIESFAADAPNRWTAAQGEHNALNRVLYWTLSFRSRHIQIKWRRRFPLGFRPHGGSMWWCLTRDCVAYVDSFVRQNPAYVRYFKTVFIPDESFFQSLLSNSPFRDRIVSDDLRYADWERPNPLYPRTLDIDDAERLRASPKLFARKFDERSLALLDLIDREIALSP

SEQ ID NO: 26789 - protein, 281 aa, Brassica oleracea
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGVSGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSNATN

SEQ ID NO: 26790 - protein, 775 aa, Coccidioides immitis RS
MTVSYDQSYRTPNTAPLEDRFEVIRQIGDGSFGSVVVARVRTAGSHVAKRGTMVAIKTMKKTFESFSSCLELREVIFLRTLPHHPHLVPALDIFRDPLSKKLHICMEYMDGNLYQLMKARDHKCLDGKSVKSILFQILSGLDHIHAHNFFHRDIKPENILVSGSAPFESVLGRYATPPSTPPNYTVKIADFGLARETHSKVPYTTYVSTRWYRAPEVLLRAGEYSAPVDMWAIGAMAVEIATLKPLFPGGNEVDQVWRVCEIMGSPGNWYNKSGAKVGGGEWKDGIRLAQKLGFSFPKMAPHSLESILQPPQWPASLSHFVTWCLMWDPKNRPTSTQAINHEYFADAVDPLRPKSSTARLIGRKQSDKSFKAQGDSPGLSSKSSWFRRSLIGRSESPAPTLEQIDSSKQTPYNGGADSPAKAKASTSKRATWTHGAPMPILPSIRPVSPLSNAVHAQANSSITGDNSPSKANSKTASKKIGRQLSVNSNGNHYADIHRQEAERALNGGTNVTSPSALKESFFSHLRKRARRLSGRNQVPAPSDDVEASNGCVPWSNRSSMALDPVNIAEGKSGQDLLDLDTALQNVRYSMDMSSPPNVPIHTCGTTGNTPKRQSVPHAQAVRVTENGTIANGTSLSSRTRRVMQGSTRSVPRYETPEEEDELLHEVLHSTNSAARRLGQGSITMDEATRDTLFQNLNNQPSLSTDANRHNPYPTPSPTARRDGPAFLSDITPSKPLGMNKPGVESHRQWPTPPYDEAEWANATAADMFAAENTYR

SEQ ID NO: 26791 - protein, 527 aa, Gibberella zeae PH-1
MLSATSVAIRAGARRAAPRFAARAVSVKTASTTLRSIDISASRTLSTTRALASSLARDRTREIVAQTINSIGSKREGEQYLKLFTSVESQKFAVIKVGGAILTEYLDELCRSLLFLTELGLLPVIVHGAGPQLNNLLEAAGVEPQFEEGIRITDAKTLGVARKLFLEENLKLIDRLDELGIAARSISGAFIADYLDKDKWQYVGKITKVNKEAIENSIEAGYIPVLTSMAESEDGHLLNVNADVAAAELARALEPLKVVYLSEKGGLYNGDGEKISVINLDAEFDHLMSQPWCRYGTRLKIREIKDLLDTLPRSSSVAIIHPSDLQKELFTDSGAGTLIRRGDKVRKVSSLGEIEDVAKFKEALIRDRQGMDAEATVDRFVDQLKDKKFDAYYDDGMQCLAIVLPASEERAIATLATLNITKSGWLSNIAENVFASIKKDHPSLAWTVSEEDENLTWFFEKADGTFNRNGNVLFYYGCDLRSEALVPVFEDFKAHGRAMLGDANLESRLRDAAKTTSESLNASQSRN

SEQ ID NO: 26792 - protein, 290 aa, Gibberella zeae PH-1
MEGIQTHPSNAAQAKAFTAPGSLSFPGATNELTPPPVGNGDATQQPPHNGQQAANGNGVAPATPVATPAATQGPSGITPTLQNIVATVNLDCRLDLKTIALHARNAEYNPKVHQTLRRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMIKPKIVLLIFVSGKIVLTGAKVREEIYQAFEMIYPVLQGLRCHHIISYPTHHIITILSTCMIRHKPSRYHDCF

SEQ ID NO: 26793 - protein, 428 aa, Clostridium perfringens SM101
MNNNFRELFIGVDEEITIYNGKKIVPINLDNAATTPALKEGLKCVSDMLHVYSSIGRGKGYKANFCNEFYEKSRKKILEFFNVKNTEDYTVIYVKNATEGLNLLAHSLGNKKDYIISTRMEHHANDLPWRENSNILYVEVDELGLLKKEKIEELIKKHKGKVKYLTITGASNVTGYLNPINEIAKMAHDNGIKIIVDAAQLVAHKPINIGGTGNNDHIDFLVFSAHKMYAPFGTGVIIALKELIKDKDPLLKGGGAVDLVSDNKVFLDSEPERFEAGTPNIIGVCSLLSSIKAIKSIGFDKISLLEEDLKKVLLEGLERMPDIITYGDSNYENRIGVVVFNVKDIHHDVISDRLANFRGISIRNGSFCAHPYVRRLLNFKDEEFSKYAYSNKPRPGMLRASLGLYNTKEEIEEFLNTLEIVKEKDFRL

SEQ ID NO: 26794 - protein, 899 aa, Oryza sativa Japonica Group
MNICAAILLFYILQFVHGQPDSQGFISIDCGIPEKSSYQDPTSSIIYVSDYGFISTGANHNISSAYIKPSLAQRNYNVRFFPDGTRNCYTLRSLQEGNKYFVRAVFYYANYDSLNKLPVFDLYLGANYWHEVKFSNADAVNWMDIIVVAPADYLQVCLVNKGTGTPFISGLDLRPLKSTLYPEANTTQSLVLINSNRFNMGPTDNSITRYPLDPHDRLWSTYDTIPDWTEISATSVVQNYLTDVYDVPSAVMQSAATVNSSRINFTWDPSDPSVNISSKYFFVLYFSELQSVPSNGLRQFDIIVNNNTWNTQPYTPPFLFADSLSGTVQGLASYSVSLVATKNATLPPILNAMEMYLVKPLTEFATDPRDARAMMEVQQNYDVKKNWMGDPCAPKAFAWEGLNCSYPPADSSKITSLNLSSSGLAGSIATYFGDLKSLQYLDLSHNNLSGPIPNFLGQLPLLMFLDLSSNDLSGPIPYNLLQKSQNGSLSLRVGYNAKLCGNDTECGSGQKKIKGSLLSAIIITIVATVALIVVLFLLLRRMLKAKDKRRAAGPTYESALLENREFSYRELKHITNNFSQQVGKGGFGAVFLGYLENGNPVAVKVRSESSSQGGKEFLAEAQHLTRIHHKNLVSLIGYCKDKNHLALVYEYMPEGNLQDHLRATTNKPLTWEQRLHIALDAAQGLEYLHVACKPALIHRDVKSRNILLTTNLGAKIADFGLTKVFSESRTHMTTEPAGTFGYLDPEYYRNYHISEKSDVYSFGVVLLELITGRPPVIPIDESVSIHIGEFVHQSLDHGSIESIVDARMGGGGGYDINSVWKVADLALHCKREVSRERPTMTEVVAQLKESLELESHGDRKHLVTGDDDVSVSNLGEETALEVEEQSGEISRVSPGPAVR

SEQ ID NO: 26795 - protein, 267 aa, Alteromonadales bacterium TW-7
MHPMLNIAVRAARNAGKILLRAGEDLSKVEVQQKGANDLVTNIDKEAEAVIRDTILQSYPTHSVVGEELGEHKGKDDDYQWIVDPIDGTTNFIKGIPHYAISIALKVKGRLDQAVIYDPIRGELFTASKGQGAQLNSKRLRVSKTTVLAGTVLATGFPFKHKQHTDAYTEAFKALFVHTADIRRAGCSALDMAYVAAGRVDGFFEIGLKPWHSAAGELMVKEAGGMVVDFAGGNNYNHSGNIICGAPKLTQAIIREIRPVLTESLLR

SEQ ID NO: 26796 - protein, 316 aa, Bacillus anthracis str. Ames
MSTVQVPKLNTKDLLTLEELTQEEIISLIEFAIYLKKNKQEPLLQGKILGLIFDKHSTRTRVSFEAGMVQLGGHGMFLNGKEMQMGRGETVSDTAKVLSHYIDGIMIRTFSHADVEELAKESSIPVINGLTDDHHPCQALADLMTIYEETNTFKGIKLAYVGDGNNVCHSLLLASAKVGMHMTVATPVGYKPNEEIVKKALAIAKETGAEIEILHNPELAVNEADFIYTDVWMSMGQEGEEEKYTLFQPYQINKELVKHAKQTYHFLHCLPAHREEEVTGEIIDGPQSIVFEQAGNRLHAQKALLVSLFKNVEELS

SEQ ID NO: 26797 - protein, 255 aa, Bacillus anthracis str. Ames
MNDYIVVKCGGSMLEQLNDVFFDCIKKLQQQYKVVIVHGGGPEIDAKLKDCNINVEKRDGLRVTPKEVMDVVQMVLCGSTNKKFVMNLQKHNLLAVGCSGCDGKLLQVQPVSEEIGYVGEVSYVETALLKGLINMNYIPVIAPIGIHDNEIYNINADTAAAGIAAALSAKELILITDVDGILHEGKLVKKTDESEIATLIEKGVITGGMIPKVQAALASLKMGVQKISIVNGTKDFTEDTGECIGMTVTRGVSIV

SEQ ID NO: 26798 - protein, 129 aa, Zea mays
  misc_feature (44)..(44): Xaa can be any naturally occurring amino acid
GGGDKLILPGLQFHGFHGVLREEKTLGQKFVVDIDAWMDLAAGXESDCIADTVSYTDIYRSPDNHIAKDVVEGTPRNLLESVAHSIAEATLLKFPQVSAVRVKVGKPHVAVRGVLDYLGVEITRHRKKE

SEQ ID NO: 26799 - protein, 553 aa, Acidobacteria bacterium Ellin345
MHEWLPKSVLALRDYSRQRFVADLLAGITVGLVALPLAMAFAIASGVPPQSGLYCAIVAGFLVSACGGSLTQIGGPTGAFVVVVYNIVAKHGIDGLFMCTLEAGVILVLLGITGLGSAVKFIPRPVVVGFTNGIAVIIASTQIKDFFGLKIEKVPGDFLDRMEVLGKNFRTLSVEETCIGLLALAIIIAFMRYVKRVPGYIVALVAGTAAVLLLHLDVQTIGTRFGGIPSGLPKLEIPQFHANLLRPLISPALTVAMLGAIESLMSAVVSDRLSGDKHNPNVELVGQGIANIFSPLFGGLPATGAIARTATNIRSGATSPVAGMIHSATLLAIVVFAAPAAKFIPLAVLSAILFVVAYNMGEWREIPQILKLSKLEIGTWLASFLLTVFADLTTAVEAGMIMAVLVFIRRVSLTTTVSMVTEEYVKAGHAHILQNKDIPGYVAIFRIHGPFLFGTTEKMEEITSRIDELPPVVIVRLRNMTAIDATGIQALETAIEAIRRTGRKVLLCGARRQPKELIEQSGLGAHVGEENMLNSISDALERAKALQTSVVHA

SEQ ID NO: 26800 - protein, 621 aa, Candida glabrata CBS 138
MMGIRKLIFSFLIYLQVSCLAVVDQNTKGFFTSDGDDHNIDISPLPRWPSLNPDQKLLKVGRNGAISSDLELCNNLTINEIFLKYPQANAADAAVTQALCIGMVNFFNSGIGGGGYVVFAKGPRAPDTTGNHLFIDFREKAPAAAHKSMFENCSLCSKVGGLAVAVPGELKGLYELYKSRGSGKVTWKQLLEPIIKLGEDGWVVEEALGATLTLYEQFILERKYDWEFVLNSTKNGVKKTGDKISRPVLSKLLRELANNGSADPFYDKDGWIVKSMVDKIKENQGIITSQDFDDYTVRKDKPLERKIRQGFSFAPNNDLTVLTSGGSSSGPALLASLAVMETFGDSMGGDYGDEEIFQLVETMKWMGSARSRLGDYVGKRFPDNIQEVLNPKWVSKIIHAIKHQCRQSPLRTLNNYTCYDPMYDINEPHGTAHFSITDKFGNAISLTTTVNLLYGSLVHDPNTGVIFNNEMDDFAQPNRSNSFDLAASIYNLIEPGKRPLSSTAPSIIMNELGYPDLVVGASGGSRITTSILQTIIRVYWYQMPLLESIAYPRVHHQLLPYQLEVESEAMIGSETIQALKSMGHNVLQVEPKSVVNAIQRIAGEWHAVSDYWRKRGISAVY

SEQ ID NO: 26801 - protein, 377 aa, Candida albicans SC5314
MCGPLHVSDIFIFNQTDAGNITLRIGKLPRGPNLQFKINNYSLCKDVRKILKHPKSISKDNSIFQSPPLLVLNGFGKISEMSQHEKLMVTIFQNMFPPIQPQQTKVSSIKRVLLISKNKVTNEIELRHYAINTKLVDENRNVKKLIQSHHNLKKKLPKLTNNQDVSDLLLNPYSIGGLTSDSEFEDDAVVEIQQETFVKKEPTKAITTTITATTEKEVESQSQPQPQPQPQQGKSKRAIKLTELGPRLNMSLIKIEEGLIGSSKTIYHSSIQKTEDEIKSLEKKHLLKQQLKLERRSKQQAAVKAKLDKKEAKKARRKAREEGREKDNDDNNNEEEEEEEDSADEEQVDDDDSDSDAVDINPEDYENDSDLYSDVDV

SEQ ID NO: 26802 - protein, 173 aa, Bradyrhizobium sp. BTAi1
MFDNIRHDLQAYDHDWGAQGFWAMLVYRFGRWRYRVRPALLRKFFSALYKMCFKLIQIITGIELPCEAEIGRNFVIDHFGGIIVSGYTRIGDNCRIRNGVTIGLRRVEEKVAPVIGDNVDIGAGAKLLGPIRIGNNVVIGANAVVITDVPDDSIAVGVPAIIKPRRTQSTADD

SEQ ID NO: 26803 - protein, 181 aa, Bradyrhizobium sp. BTAi1
MIEHRSWDHLSGHDRSAIADWSRERPQRFWDPGRKLLLALRRYQYWQARGGLLAAIFCKCLVLRHRFWSVVTGADIPLNCNIGGGLLIPHPNGIVIHPGAQIGVNCLLFQQVTVGSVEDGRGLPRIGDHVDIGAGAKILGPVSIGSHARIGANAVITRDVDAGSTAFGVNQSKQSQGGREP

SEQ ID NO: 26804 - protein, 527 aa, Chlamydophila caviae GPIC
MNKKGFLDSSSTKILQDLAVAPIDLTAPGVISKERIERFSLSVEGFTLSYATERVDEGILSALEDLASERGLIESMQAMQNGEVVNYIENFPSESRPALHTATRAWVKESPLQGNAEDISLRSKIEAQRLKDFLNRYRDVFTTIVQIGIGGSELGPKALHWALKGCCPSDKKVYFVSNVDPDNAAEVLQEIDCAKTLVVTVSKSGTTLETAVNEELLADHFLKQGLHFQDHFIAVTCEGSPMDDTSKYLEVFHIWDSIGGRYSSTSMVGGVVLGFAYGFDVFLQLLEGAASMDLAALEPRMSENLPLLSAMLGIWNRNFLRYPTSAVVPYATGLEYFPAHLQQCGMESNGKSVAQTGEVIGFATSPILWGEVGTNSQHSFFQCLHQGSDIVPIEFIGFQENQRGKDIVIAGSSSSQKLFANMVAQSIALAKGRENTNPNKNFRGNRPSSLLVSERLTPYTMGALLAFYEHKIVFQGFCWGINSFDQEGVTLGKDLANQVLQVMQGQEKEGALLEAEALLRLFNNIKK

SEQ ID NO: 26805 - protein, 360 aa, Clostridium perfringens SM101
MDIISSINTRFLSKSEQSKKEIFNKIDNIVKGGGNIIRMNLSHGKHRDVECCIDYIRSNHKNVKILLDLQGNKIRVANNIYGTFKVNSGDLVYFCSEETYDVYLKNVDRNKLIPLNIKNKFIYNNTFKKIYMKDATMEFIVISNNNGLIKTKVKLGGVVRKEKGCNLPNLDRKNWGVSEKDLEDIKFAIDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKGV

SEQ ID NO: 26806 - protein, 484 aa, unidentified eubacterium SCB49
MEKILNYIDGKYCEPISGKWLDNYNPSTGEVYSQIAASDDSDISEAYNAATKAFPAWSNSTIETRSRILLKIADLIEENLEQLATAEAKDNGKPLSLATAVDIPRASSNFRFFGNAITQFASQAHESIGMQTMNFTLREPLGVVGCISPWNLPLYLFTWKIAPALAAGNCVVAKPSEVTPMTAYLLGDICTQAGLPAGVLNIVHGNGPQAGEAIVVHPKIKAISFTGGTKTGEHIARTAAPMFKKLSLELGGKNPNLIFADCNYDKMLAVTLKSSFANQGQICLCGSRIFVEESIYETFKKDFVSKVSAMKVGDPFDADTKMGALVSQPHLEKVISYIELAKTEGGTVLCGGEKVTVSGREKGYYLAPTVIEIPNNKCRVNQEEIFGPVVTLIPFKTETEALEMANDVKYGLSATVWTKDLDRTMRLSKKLEAGIVWVNTWLNRDLRTPFGGMKESGVGREGGFEALRFFTEPKNVCISWTVEE

SEQ ID NO: 26807 - protein, 579 aa, Herminiimonas arsenicoxydans
MTSETNNAVGEELTGAEIVVRCLAEEGVEHVFGYPGGAVLYIYDAIYNQDKFQHILVRHEQAAVHAADAYSRSSKKVGVSIVTSGPGVTNAVTGLATAYMDSIPMVIISGQVPTHGIGLDAFQECDTVGITRPCVKHNFLVKDVRDLAATMKKAFYIATTGRPGPVLVDIPKDVSMHKCMFSYPKEVEMRSYKPVDKGHTGQIRKAVQLLLQAERPMIYTGGGVILANASEELTQLVDKLGFPCTNTLMGLGSYRASSDKFVGMPGMHGTYEANMAMQHSDVMIAIGARFDDRVIGNPKHFSSNPRKIIHIDIDPSSISKRVKVDIPIVGNVKEVLVELLAQLDAAEAKPNSVALSNWWKQINEWRKRDCLKFENSTTVIKPQSVIQKVWDVTKGDAFVTSDVGQHQMWAAQYYPFDKPRRWINSGGLGTMGVGLPYAMGVQMANPDATVACITGEASIQMCIQELATCKQYHLTPKIILLNNRFLGMVRQWQQLEYGSRYSESYMDSLPDFDKLVEAYGHVGMTIENPADVDGALKEAFAMKDRLVFMNFITDQTENVWPMVKAGQGLTEMLLGSEDL

SEQ ID NO: 26808 - protein, 163 aa, Herminiimonas arsenicoxydans
MRHIISVLLENEAGALSRVVGLFSARGYNIETLTVAPTEDATLSRMTIVTSGSDEVIEQITKHLNRLIEVVKVVDLTEGAFIERELMLIKIRAVGKEREEMKRTADIFRGRIIDVTDKTYTIELTGNKTKLDAFIESIDRTAILETVRTGSSGIGRGERILKV

SEQ ID NO: 26809 - protein, 331 aa, Streptococcus agalactiae A909
MAILVLGGAGYIGSHMVDYLLTKTDETVVVVDNLVTGHREAIHLEAIFYKGDLADKTFMRQVFVENPSIDTVIHFAAYSLVAESMEQPLKYFNNNTAGMINLLEVMTEFAIKFIVFSSTAATYGIPNDIPIKEITPQRPINPYGESKLMMETIMKWADAAYGVKFVPLRYFNVAGAKPDGSIGEDHKPETHLLPIILQVAQGKREKVMIYGDDYQTSDGTNIRDYVHPFDIAAAHLLAVDYLRKGNPSTAFNLGSSIGFSNFQILEVARRVTGKDIPVEVTKRRIGDPDILIADSSKARDILGWQPEFDDIEKIISSAWAWHSSHPDGYKS

SEQ ID NO: 26810 - protein, 429 aa, Escherichia coli
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 26811 - protein, 641 aa, Mycobacterium avium subsp. paratuberculosis K-10
MLEQIRGPADLQHLSTHQLRELAAEIREFLIHKVAATGGHLGPNLGVVELTLALHRVFDSPHDPIIFDTGHQAYVHKMLTGRAHEFESLRKKGGLSGYPSRSESEHDWVESSHASAALSYADGLAKAFELSGHRNRHVVAVVGDGALTGGMCWEALNNIAASGRPVIIVVNDNGRSYAPTIGGVADHLATLRLQPAYEQALQRGRDALRALPLVGKFAYRVMHSVKAGIKDSLSPQLLFTDLGLKYVGPVDGHDERAVEAALRHARGFGRPVIVHVVTRKGMGYAPAEDDEADQMHSCGVIDPVTGQATKVAGPGWTATFSDALIGYARKRRDIVAITAAMPGPTGLTPFGQQFPDRLFDVGIAEQHAMTSAAGLAMGGMHPVVAIYSTFLNRAFDQIMMDVALHRLPVTMVLDRAGITGSDGASHNGMWDLSILGVVPGMRVAAPRDAARLREELGEALDVDDGPTALRFPKGDVGEDIPAIERRGSGLSGVDVLALPASGCNHDVLLIGVGAFAPMALAVARRLADQGIGVTVVDPRWVLPVSDSILELAARHKLVVTCEDNGVNGGVGSAVSAALRRAELDVPCRDVGLPQRFYEHASRGELLADLALTDQDIARRITGWVAALGSGVAEAEIREHLD

SEQ ID NO: 26812 - protein, 279 aa, Bacillus anthracis str. Ames
MSIQNISFLGAGSIAEAIIGGLLHANVVKGEQITVSNRSNETRLQELHQKYGVKGTHNKKELLTDTNILFLAMKPKDIAEALIPFKEYIHHNVLIISLLAGVSTHSIKNLLQKDVPIIRAMPNTSAAILKSATAISPSKHATAEHIQTAIALFKTIGLVSVVEEEDMHAVTALSGSGPAYIYYVVEAMEAAAKKIGLKEDVAKSLILQTMIGAAEMLKASEKHPSILRKEITSPGGTTEAGIEVLQEHKFQQALISCITQAAQRSHNLGKTLEQLTKEK

SEQ ID NO: 26813 - protein, 169 aa, Nicotiana tabacum
GLIVSFGEMLIDFVPTVSGVSLAEVPGFLKAPGGAPANVAIAVTRLGGKSAFVGKLGDDEFGHMLAGILKQNGVQADGINFDKGARTALAFVTLRADGEREFMFYRNPSADMLLTPDELNLEVIRSAKVFHYGSISLIVEPCRSAHLKAMEVAKEAGALLSYDPNLRLP

SEQ ID NO: 26814 - protein, 413 aa, Treponema denticola ATCC 35405
MASTYEKLLTTITEAAKTANLEEDDYISLLSPEREMHVSIPVKMDNGKIKVFSGYRVQHSTLRGPAKGGIRFHQDVNIDEVRSLSAWMTFKCAVADIPYGGGKGGICVNPSNLSETELEKLTRGYTRRITSFIGPKTDIPAPDVGTNAKIMSWIVDSYSSYAGEFTPAVVTGKPLPLGGSKGRVEATGRGVLFATREILKKLNKTLKDQSVVIQGLGNVGGVTADLFYKEEARIIAISDTSSAIYNEKGLDIPQILKHKKGGKKLKSFEGDFKRITNEELLELKADILIPAALENQITEKNASNIKASIIIEAANGPITPEADKILEKKNIITVPDVLANSGGVIVSYFEWVQNLQGFYWTEEEVNKRLEDKMIEAFKLVWDVKEAYKVSMRKAAYIKALKELVETQKVKGIN

SEQ ID NO: 26815 - protein, 213 aa, Brassica napus
TWENRMQIAVEAAQGLEYLHNGCQPPMVHRDVKTTNILLNERYGAKLADFGLSRSFPIDGAYHVSTAVAGTPGYLDPEYHRTNSLSEKSDVYSFGIVLLEIITNQPVIDKTRERTHINEWAVLMLTKGDIRNLIDPKLMGDYDTTGAWKIVELALACVNPSSNRRPTMAHVVIELNECVALENARRQGSEEMSARSSVNFSLSSASEFIPGAR

SEQ ID NO: 26816 - protein, 459 aa, Mycobacterium avium subsp. paratuberculosis K-10
MSVLLFGVSHRSAPVSVLEQLSIDESDHGKIVDRVLQSPLVTEAMVLSTCNRVEVYAVVDAFHGGLAVIGQVLSDHSGMSMSDLTKYAYVRYSEAAVEHLFAVASGLDSAVIGEQQVLGQVRRAYATAETNRTVGRVLHELAQRALSVGKRVHSETAIDAAGASVVSVALDMADRRLGGLAGKTAVLVGAGAMGALAAAHLSRAGIGQVHVLNRSLSRAQRLVRKIRETGVRADALPLEHLADALAGADVVVSCTGAVSPVVSLADVHHALAAAGRSAADETAHPLVICDLGMPRDVDPAVAGLPGVWVVDVDRVQHEPSAHAAAADVDAARTIVATEVAAYLAGQRMAEVTPTVTALRQRAADVVEAELLRLDNRLPGLDSAHREEVARTVRRVVDKLLHAPTVRIKQLASAPGGDSYAEALRELFELDQTAVDAVAAGELPVIATGFDAGAPQQPTE

SEQ ID NO: 26817 - protein, 426 aa, Acidobacteria bacterium Ellin345
MPEVHSSLPIPSGPSFLRKLVAFAGPGFLVAVGYMDPGNWATDLAAGSQFNYALLSVVLISSLMAILLQSLSLKLGIVVERDLAQACRDAYSKPVSIGLWVLAEIGIAACDLAEVIGSAIALQLLFHIPLTIGVCITAGDVLLMLLLQQRGFRYIEAIVVTLIATISICFGLEILYSRPELWPMLAGFLPHQELVTNHAMLYIAVGILGATVMPHNLYLHSAIVQTRQYERTPEGKREAIKYCNIDSAIALSFAFLVNAAILIMAASVFYRSGHREVAEISDAYRLLSPLLGVTGASVIFAIALLASGQNSTLTGTLAGQIVMEGFLSIRLKPWLRRLVTRLIAIIPAVIISFFYGASGTAKLLIFSQVVLSMQLSFAVFPLVAFTSSKEKMGEFANGALLKLVAWTVAIVIAGLNIWLLVEAVRG

SEQ ID NO: 26818 - protein, 306 aa, Lactobacillus plantarum WCFS1
MNTVTVIGSINLDRTIRVENMPKPGETIHTKEIFSAGGGKGANQAVAAQRSGANTHFIGAVGDDAAGKTMLDLLTQEKINLAGITKMTNQSTGQAYVTVDDAGENQIMIHGGANMAFTPADVEAHRDIIETSDFVVAQFESAVDSTVEAFKIAQAAGVRTILNPAPAMEKVPAELLAVTDMIVPNETETETLTGIAITDEVSMLKASAALHALGISAVIITIGSKGAFYDIDGRHGIVPAFKVEAVDTTSAGDTFIGAMSSVLNKDFSNLEDAIRYGNRASSIAVQRFGAQPSIPYKNEITAAEGK

SEQ ID NO: 26819 - protein, 528 aa, Rhodospirillum rubrum ATCC 11170
MRDFFRVGRDPVLAREAMIATSHPLSTAAGLEILSAGGTAVDAALAAVAVQSVVDPLMTGIGGDCFALYAPAKGDVVALNGSGRAPLAASVSRLKALGVGEITQTSPHAITVPGAVGAWTKLHGDYGRLPLATLFARAIAYAEGGYPVTPRVAHDWAREAALVAGDSGAAAVFLPDGRAPVAGARHAQPKLGDQLRAIARDGAAAFYLGPTAEALVAYLQGLGGLHTLDDFACGLEDAEYVTPISTIYRGHEVFECPPNGQGLAALMILNILSGFDLSDDLALADRLHLQAEATKLAYYHRDALIADPAHLPYPPDALLAPEVAETLRRRIRMDRVLAPALWTEPEHKDTVYLCVVDGQGNAVSLINSIFHGFGSTHLDPATGILLHSRGASFRVIEGHPNAIGPRKRPMHTIIPGMVRKDGKTVMPFGVMGGQYQAAGHAAFLSGVLDRRLDVQQAIDAPRAFGFGGTLEVEPTVEAGVLAALAARGHRVTTAANPIGGAQAIWIDPQSGLLAGGSDQRKDGCALGF

SEQ ID NO: 26820 - protein, 430 aa, Bacillus licheniformis ATCC 14580
MPYIVDVYAREVLDSRGNPTVEVEVYTESGAFGRALVPSGASTGEYEAVELRDGDKDRYLGKGVLTAVNNVNEIIAPELIGFDVTEQVSIDKLLIELDGTENKGKLGANAILGVSMAVARAAADFLQIPLYQYLGGFNSKTLPVPMMNIVNGGEHADNNVDIQEFMIMPVGAENFREALRMGAQIFHSLKSVLKEKGLNTAVGDEGGFAPNLGSNEEALQTIVEAIEKAGFKPGEEVKLAMDAASSEFYNKEDGKYHLAGEGVVKTSAEMVDWYEELTSKYPIISIEDGLDENDWEGHKLLTERLGSKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIQSFYNLNK

SEQ ID NO: 26821 - protein, 421 aa, Rhodospirillum rubrum ATCC 11170
MGWVVDSYIIVLVGFGALVLLTAWLPMVLREAPLSLPILCVAIGAAVFALPPLAGVVPRPQDHLPVIERVSEMLVILSLMGAGLKIDRPFGWKSWAVTGRLLAAAMPLTILGLALVGWLVLGLGAAAALLLAAALAPTDPVLASDIQVGPPNSGEENQTRFALTSEAGLNDALAFPFVHAALALAVAGKTGEPWLGHWLSVDIVWKLGAGLAMGVLVGHGLAWLLFRVPHRARLSRSGDGFVALGITCVVYGLTEMVQGYGFLAVFVAALTLRAGERRHAYQGTLHDFAEALERLLMMALLVGFGAALSGAGLLAGLTWEGVAFGLIALVVVRPLTAWIGLAGMGGPLAERAIISLYGIRGIGSIYYLSYALGRGSFDGEDLLWSTLAFTILVSIFLHGATVTPVMRAFERRQGRDTTPGR

SEQ ID NO: 26822 - protein, 511 aa, Bacillus licheniformis ATCC 14580
MSNKLAALIILDGFGLRDETVGNAVAQAKKPNFDRYWNKYPHQTLTASGEAVGLPDGQMGNSEVGHLNIGAGRIVYQSLTRVNVAIREGEFEQNETFLAAMKHVKEKGTNLHLFGLLSDGGVHSHIHHLYALLKLAKKEGVENVYIHGFLDGRDVGPQTAEKYIKELQDQIEEIGVGEIATLSGRYYSMDRDKRWDRVEKAYRAMAYGEGPKYQNPLDVVKDSYENGIYDEFVIPSVITKENGEPVATIKDNDAVIFYNFRPDRAIQISNTFTNDDFRDFDRGDKHPKNLHFVCLTHFSETVDGYVAFKPVNLDNTVGEVLSQNGLKQLRIAETEKYPHVTFFMSGGREEKFPGEERILIDSPKVATYDLKPEMSAYEVKDALVKEIEAEKHNAIILNFANPDMVGHSGKVEPTVKAIEAVDECLGEVVDAILAKGGYAIITADHGNADVLITEEGKPHTAHTTNPVPVIVTKEGVTLREGGILGDLAPTLLDLLGVEKPKEMTGSSLIQK

SEQ ID NO: 26823 - protein, 139 aa, Brassica napus
MAPIAVGSVLPDGKIFLFDENDQLQTVTVHSLLAGKKVILFGVPGAFTSACSLQHVPSFIEKADQLKAKGVNEIICYGMNDPYVMKAWGKTFPENKHVKFVSDGSGEYTKLPRDWSLTLRTRVLVLGQGDLLCCSITSR

SEQ ID NO: 26824 - protein, 99 aa, Synechococcus sp. WH 5701
MASYKVTLINESEGLNKTIEVPDDQYILDAAEEQGIDLPYSCRAGACSTCAGKLTTGTVDQSDQSFLDDDQIEAGFVLTCVAYPTSDCTIKTHAEEELY

SEQ ID NO: 26825 - protein, 254 aa, Glycine max
MATRRYEFGRMNEASHPDSIRAALAEFLSTCIFVFAGEGSALALRQIYKEPGSSAGELVVIALAHAFALFAAISASMHVSGGHVNPAVTFGALLGGRISVLRAVYYWVAQLLGSIVAALLLRLVTNNMRPQGFSVSIGLGAFHGLVLEIALTFGLMYTVYATAIDPKRGSIGSIAPLAIGFVVGANILAGGPFDGACMNPARAFGPAMVGWRWHYHWIFWVGPFIGAALAALLYEYVMVPIEPPHHQPLAAEDY

SEQ ID NO: 26826 - protein, 355 aa, Mannheimia succiniciproducens MBEL55E
MKLTKLALTMSLGLGVSFANAAELPNITILATGGTIAGSGATSVSSSYKAGQLTVQTLIEAVPEMKDLANITGEQVVNIGSQDMSDEVWLKLAKTINAKCNETDGFVITHGTDTMEETAYFLDMTVKCEKPVVLVGAMRPATEKSADGPLNLYNAVVVATDKKSAGRGVLVAMNDKVLGARDVTKTSTTAVETFNSPNFGSLGYIHNSKVDYERSPESKHTTATPFNVDNLTALPKVGIVYAYSNMPTEPLKALLDAGYEGIVTAGVGNGNVNQANSAILEKAAKDGVAVVRSSRVPTGYTTRNGEVDDNALGFAASGTLNPQKARVLLQLALTQTKDINKSNNILMISKSGRST

SEQ ID NO: 26827 - protein, 327 aa, Mannheimia succiniciproducens MBEL55E
MNQNQPHFYRGRFSVAPMLDWTTRHCRYFHRQFSRHALLYTEMVTAPAIIHAKYDHLEFDPAENPVALQLGGSDPEQLQHCAKLAEQRGYTEINLNVGCPSDRVQNGMFGACLMAKADLVAECVEKMQAEVEIPVTVKTRIGIDNLDSYQFLCDFIQKVHSKGCNEFIVHARKAWLSGLSPKENREIPPLDYNRVYQLKRDFPQLSISINGGIKTIEEMTAHLQYVDGVMVGREAYQNPALLGQIDRALFDLNAPIVTPREAVEKMFPYIERQLSRGVHLNHIVRHMLGAFQNCKGARQWRRLLSENAHKTGAGIEILETALHFVEE

SEQ ID NO: 26828 - protein, 330 aa, Streptococcus agalactiae A909
MRSLFGGLREKVASDYVKIVFPEGSDERVLRAAARLKFEGLVDPVILGKADEVHDSLARLGFVDQDYSVIDPEQYEKFEEMKEAFVEIRKGKATMEDADRLLKDVNYFGVMLVKLGLADGMVSGAIHSTADTVRPALQIIKTKPGISRTSGVFLMNRENTQERYIFADCAINIDPNAQELAEIAVNTADTAKIFDIDPKIAMLSFSTKGSAKAPQAEKVQEAAKIAKDLSPELAVDGELQFDAAFVPETAEIKAPNSDVAGKANVFIFPDLQSGNIGYKIAQRLGMFEAIGPILQGLNAPVNDLSRGSSAEDIYKLAIITAAQAIDEKSK

SEQ ID NO: 26829 - protein, 180 aa, Cryptococcus neoformans var. neoformans JEC21
MIKPSDPRLKENVEKAAKKAEKEKAAEERKAVAQVSSSLFLSHNTDLGPPYRILVDTNFINFSIQNKIELVQGMMDCLMAKCIPTITDCVLAELEKLGPKYRLALKIAKDPRFERLHCDHNGTYADDCLVQRVTVHKCYIVATCDRDLRRRIRKVPGVPLMYVVKRRYQIERLPEGGASF

SEQ ID NO: 26830 - protein, 335 aa, Metarhizium anisopliae var. anisopliae
VKVGINGFGRIGRIVFRNAAEHPEIEVVAVNDPFIDTEYAAYMLKYDSSHGIFKGDIKKEADGLVVNGKKVKFFTERDPSAIPWKSAGAEYIVESTGVFTTTDKAKAHLAGGAKKVVISAPSADAPMYVMGVNEKTYDGKADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTARIEKGASYDEIKEAIKEAANGPLKGILAYTEDDVVSSDMNGNTNSSIFDAKAGISLNKNFVKLVSWYDNEWGYSRRVLDLLAYIAKVDAGK

SEQ ID NO: 26831 - protein, 223 aa, Streptococcus agalactiae A909
MDELKKLAGVTAAKYVKNGMIVGLGTGSTAYFFVEEIGRRVKEEGLQVVGVTTSNRTTEQARGLAIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 26832 - protein, 364 aa, Clostridium perfringens SM101
MNERNHGLGIIALESCTELGNAIDKLIQEKRNCEESFLIKTDEIRFSNGEGKVKIPESVRGRDIYILCDIGNYSCTYKMFGFENHKGPDEHFQDIKRTVSAIRGKARRITVIMPLLYESRQHRRKGRESLDCALALQELERLGVDEVLTFDVHDPNVQNAIPLMSFENFYPTYDIVKSLIHNEKDLELDKEKLLVISPDTGAMDRAIYYSSVLGVDVGLFYKRRDHSRIVNGKNPIVKHEYMGRDVDGKDVLIVDDMIASGESVLDIAKELKGRNARNVYVATTFSFFTEGLEKFNKFFNDGIIKSVYSTNLTYIPDELKTAPWFKAVDLSDFIARIINRLNYDKSVASYMDATHIIQRLLDEK

SEQ ID NO: 26833 - protein, 152 aa, Cryptococcus neoformans var. neoformans JEC21
MSTTEQTYIMIKPDGVQRGLVGEIIGRFEKRGFKLVALKLHTPSKEHLEKHYSDLSEKPFFPRLIEYMMSGPVVCMVWEGLDAVKTGRVMLGATNPLASAPGTIRGDYALQVGMNVCHGSDSVENGQKEIALWFPEGINQYKLSSQAWLYEA

SEQ ID NO: 26834 - protein, 292 aa, Mycobacterium avium subsp. paratuberculosis K-10
MMPSDDELVRLRSVAETLAAEAAAFVRRRRAEVFGTEPGGASAPDGGAVRSKSTPTDPVTVVDTETERLLRDRLAQLRPGEPILGEEGGGPAEPSPPGDGTVTWVLDPIDGTVNFVYGIPAYAVSVGAQVDGESVAGAVADVVGDRVYSAAAGLGAHVSDGAGRQPLQCAAVDDVSMALLGTGFGYARQRRAAQAALLARMLPVVRDVRRIGSAALDLCMVAAGRLDAYYEHGLKVWDRAAGALIAAEAGARVVLPAPDGDGAGLVLAAAPGIADELLAVLERFDGLDPILD

SEQ ID NO: 26835 - protein, 149 aa, Nicotiana tabacum
RYKTEEYSTDATNKFNIYPEQIPHWLMDWIPEEGGYLIGNLQPAHMDFRFFTLGNLWSIVSSLGTPKQNEAILNLIEAKWDDIVGSMPLKICYPALENEEWRIITGSDPKNTPWSYHNGGSWPTLLWQFTLACIKMNRTDLAKKAVDSA

SEQ ID NO: 26836 - protein, 1749 aa, Arabidopsis thaliana
MEQLRPFFLLLAIFVASLVNAEVHFHEFVIQETPVKRLCRVHNSITVNGQFPGPTLEVRNGDSLVITAINKARYNISLHWHGIRQMRNPWADGPEYITQCPIQPGGSYTYRFTMEDQEGTLWWHAHSRWLRATVYGALIIRPPLSSPHYPFPVIPKREITLLLGEWWDRNPMDVLNLAQFTGAAPNISDAFTINGQPGDLYRCSSQETLRFLVGSGEIVLLRVINSALNQELFFGVANHKLTVVAADASYTKPFSTNVIMLGPGQTTDVLLTADQPPAHYYMAAHAYNSANAAFDNTTTTAILKYKDASCVTLQAKSQARAIPAQLPGFNDTATAAAFTAQMKSPSKVKVPLEIDENLFFTVGLGLFNCPTPNTQRCQGPNGTRFTASINNVSFVFPKQNSIMQAYYQGTPTGVFTTDFPPTPPVTFDYTGNVSRGLWQPTRGTKAYKLKFNSQVQIILQDTSIVTTENHPMHLHGYEFYVVGTGVGNFNPNTDTSSFNLIDPPRRNTIGTPPGGWVAIRFVANNPGAWLMHCHIDSHIFWGLAMVFLVENGEGHLQSVQSPPLDLPQWYYSTTRPLVLVCPKRKIHLYYQTYNNACSFVQLNLTEHFSSRRDTNIVTFAAMASALECWTTRNAAGGCADDDFVDQVLMSSEDRSESLTAPPPSDQTSSAMQKRFQRLGRNVSDAIASLKNSLNLDSSRDNQNAATGGGRKLVWATVVRNLAKMYPGSQLPDKLVSNLRKHYDSLPLSYSQTGFDMKDVFVHIKLIEQAFGDDNPVFVIQEVCDEEADDQGSVFKLTFACTCSLPWSTISGSLDGALICCKKVQIFEKKGLTLGVVLLLVESGQEKMFKVKVVNALRSAVRKPKSTSVKLPFGLCGCEEQNAGVGEFGDVDVESIDQCYRHELDDLNTRIQLQMPPPSSSFSVSVDEWQTIQSGGDDIRKWLLNSDDLEFSGQLGPNSFKGVYRGTKVAIEKLKGCEKGNSYEFAIRKDFLELMTCGHKSILQFYGVCIDENHGLCVVTKLMQGGSLRELVLKKKKLQTKLIFQIAVDIAEGMKFINDHGVAYRDLNTQRILLDKQCNACLGDLGIVTACKSVNEAMEYETDGYRWLAPEIIAGDPEKTRESWMSNAYSFGMVLWEMVTGEEAYGSCSPVQAAVGIAACGLRPDIPKECPQVLKYLMIKCWNTCPSTRLNFSQIHCILLRAISRLLRPAFFIFFFLFFLPHNLTFGLCFNTEALALMKFKERIEIDPFGALVNWGELSHCSWSGVVCSHDGRVVILNLRDLSLQGTLAPELGNLTHLKSLILRNNSFSGKVPEEVTELQELEILDLCDNNFGQPFPFARRLLQISPPPSQPSPPSPMEEVPIDFPFFFAPPPQNIGASPPTETQVIPNPSPVPPPPAQPPPAQTPPPQLSEVPHAVNKKKSHKSKMYIIVGVLVGVLGVMAALVAFFFLWNQKVKLIKPWGETGSSGQLQDVVTTGVPKLKLAELETACEDFSNIIGSTSSDATIYKGTLSTGSEIAVLAVASGSLQDWSEDHETQFQEKRLSQVNHKNFLNVIGYCHEDEPFNRMLVFEYAPNGSLFEHLHDQDAEHLDWPMRLRIVMGIAYCMEHMHNLNPKPISHTNLNSSSVYLATDYAAKVSDFTFLSSTPLDPMTNVSSFGALLQEIITGKIPDPDSLLQEETKPVADPTLKSFQEEVMERVWEVVKECLSQKVEMKEVVVKLREITGITPEAALPSRSPAWWAELEIISTEM

SEQ ID NO: 26837 - protein, 639 aa, Coprinopsis cinerea okayama7#130
MSSTSWLPKPIASLLRFAYSLLTDPGHFWNLATLVILGDAFLTRLIVAYVPYTEIDWETYMVQTNVFLKGQHNYSMITGPTGPLVYPAGHVRIHQFLYEITDGGKNMDLAQQIYGLLYIASLSLACLIYGSTRAVPNWLLLFLPLSKRLHSIFVLRLFNDCWAVVLSQMAIYALQQGYDDTGVMLFSAALSVKMSVLLYFPGLFVILFKRKGLLRTLAYIMSIVAIQHIVAAPFLKVDAWAYLQNAFDLGRVFLYKWTVNWRIFDEETFLSSEFAASLLFGHVFVLCAFGLYRWCEIDGGVWTVITRGFKRPLLPAGIARVTPDYITTVLYTSNLIGIIFARSLHYQFYSWYAHSIPFLAWKTKYPIALRIAFIGAIEYAWNIYPSTRLSSGILLAANTWILLGLWHGHATFAAAKKAPVSVVFPEIAEKERLECRAVLEDQILVVDDFLSPVECKEYVKFIDSLPLELTPPKKRGEAERVNHRFSVTSLDFAQKLHKRLTPHLPSLPYPTSMPKRKTTVQEDAPRLPHSFNSNIRVYKYTAGQYFGPHYDDSVKDPLTGATSEWTLLVYLTGEEDGVEGGETLFYKEQKGKPRETITPPLKRGSALLHRHGFECMLHEGSPVLKGTKYVLRSDLMFMR

SEQ ID NO: 26838 - protein, 253 aa, Bacillus licheniformis ATCC 14580
MRKPIIAGNWKMNKVLSEAVSFVEEVKSSIPAADKAEAVVCAPALFLEKLTSAVKGTDLKVGAQNMHFEESGAFTGEISPAALKDLGVEYCVIGHSERREMFAETDETVNKKAHAAFKYGIVPIICVGETLEEREANKTNELVADQVKKALAGLTTEQVAASVIAYEPIWAIGTGKSSTAQDANEVCAHIRKTVASEFGQTAADSVRIQYGGSVKPANIKEYMAESDIDGALVGGASLEPQSFVQLLEAGQYE

SEQ ID NO: 26839 - protein, 394 aa, Bacillus licheniformis ATCC 14580
MNKKSVKDIDVKGRVVFCRVDFNVPMKDGKVTDDTRIRAALPTIQYLTEQGAKVLLASHLGRPKGQVSEELRLTPVAARLGELIGKEVKKADEAYGDAVKAQISEMKDGDILVLENVRFYPGEEKNDPELSKAFADLADVYVNDAFGAAHRAHASTAGIAEHLPAVAGFLMEKELEVLGKALSNPERPFTAIIGGAKVKDKIGVIESLLEKVDNLIIGGGLAYTFVKALGHEVGKSLLEEDKIELAKSFMDRAKEKGVNFYMPTDVLVADDFSNDANTKIVPVSEIPSDWEALDIGEETRKTYADVIKNSKLVVWNGPMGVFEIDAFAKGTRAVAEALAEANDTYSVIGGGDSAAAVEKFGLADKMSHISTGGGASLEFMEGKELPGVKALNDK

SEQ ID NO: 26840 - protein, 316 aa, Mycobacterium avium subsp. paratuberculosis K-10
MLALGGVIGAGLFVGSGVVIKDTGPAAFLTYALCGLLIVLVMRMLGEMAAANPSTGSFADYAAAALGRWAGFSVAWLYWYFWVIVVGFEAVAGGKVLNYWFHAPLWVLSLGLMLLMTATNLFSVSSFGEFEFWFAGIKVATIVIFLAVGAAYVVGLVPGHHDGLTNLVSHGGFFPRGVGAVFAAIVVVIFSMVGAEIVTVAAAESRDPRRAVQKATRSVVTRIGIFFVGSVFLLVAILPWDSVELGASPYVAALKHLGLAGADQVMNAVVLTAVLSCLNSGLYTASRMLFVLAERGEAPARLVRLSGRGVPHIAIL

SEQ ID NO: 26841 - protein, 335 aa, Bacillus licheniformis ATCC 14580
MAVKVGINGFGRIGRNVFRAALNNPEVEVVAVNDLTDANMLAHLLQYDSVHGKLDAEVSVDGSNLVVNGQTIQVTAERDPSKLSWGEQGVEIVVESTGFFTKRADAAKHLEAGAKKVIISAPASEEDITIVMGVNEDKYDAANHHVISNASCTTNCLAPFAKVLNDKFGIKRGMMTTVHSYTNDQQILDLPHKDYRRARAAAESIIPTTTGAAKAVSLVLPELKGKLNGGAMRVPTPNVSLVDLVAELDKEVTAEEVNAALKEAAEGELQGVLGYSEEPLVSKDYNGNTNSSTIDALSTMVMEGSMVKVISWYDNESGYSHRVVDLAAYIAKQGL

SEQ ID NO: 26842 - protein, 493 aa, Magnaporthe grisea 70-15
MEPPPKPVQLPKLEILPRGKGWKFQAPTKKINDGADVSHFLTSKAYRDICVFVLQLNRSLCPRKKSGAPANAGTVFTLASPRDDPPSVRRLQTLLDKVVAIVDETPPDPGPRRFGNIAFRTWHKHLEDRVDALLAGSIAPEILSFDNDGEQPKADDSAEGKADEHKIISTASAIDELRAYFLGSFGSSQRLDYGTGHELSFLAFLGGLWKLGAFTDGPESDHGDIERSIVLGVFEQYLKVIRKLILTYTLEPAGSHGVWGLDDHSFLPYIFGSAQLTRPISEDETMPLEGSVMRAPKLGDITKVETVEVQRELNMYFSAVGFINDVKKGPFWEHSPMLWDVSGIKDGWGKVNKGMIKMFNAEVLSKFPVVQHFPIGSLFSWEVDPEAPIPTQSVHMQNQPVFAATGQAPMGMPPTGMPPPQLNPMGVSMGTAAPWAQGGRMPAPGISSRVQQPVTGTTRPPPPDPVARQSGGPAAASSGTNDGQAGLTKAPWA

SEQ ID NO: 26843 - protein, 253 aa, Silicibacter pomeroyi DSS-3
MADSGYLFSVRGRVACVTGASSGLGRRAATVLAQAGAQVVGVARRADALAEWQAEAGGETHAIPYDLSDRDGLEGLARQVVDPFGAPDILVHAAGINTRQPADEVTPEGWDITLTLNLSVPFFLSQYLVPGMKARGWGRIVNFASLQTTRAFPGGIAYGASKGGVAQMTRAMAEAWSPHGITANALGPGFFRTELTAPVFADPERAARNAAQTCIGRNGEPEDLDGPLLFLCSQASAYVTGQVLMVDGGYTAK

SEQ ID NO: 26844 - protein, 455 aa, Bacillus licheniformis ATCC 14580
MEKDMQKLERTMTSRHIMMMALGGAIGAGLFKGSSKAIDLAGPSVMIPYLIGGVILLFIMQGLAEMAVRNSEARTFRDLVQSILGPYAAYFLDWIYWKMWVLNIAAEAVVAAMFLQYWLPGLPIWVLALFVSLVITSVNLLSVKSFAETEYWLALIKITVIVVFIISGFILLFFSFGQHSAVGFTHLTDHGGFFPNGAGGLITAMLVVIYSYGGTEIIGVTLAETKNPEKVVPKAVRGTLTRIIAFYLLPFFVIVSLIPWNQVNGVSESPFVMVFKMIGVPGADHLMNAVILLAVISSMNSGLYGASRILYTQASDGRMPKIFSRLSARKVPVYSILLCTSFLYLGVLFSLFAGSQTFEYLMGSLGYTVLVIWMLIAAAHLKSRKRNQTAGNGYYVKWFPYTTWVAIISLTAILIGVILTTSIVITLVTAGIYLLISAAYFFKGRNQTAGQTAAS

SEQ ID NO: 26845 - protein, 258 aa, Rhodospirillum rubrum ATCC 11170
MNARLWIGTSWKMHKTIAEAEAYVGELTASPLLDRVEAFIVPPFTALAAVHRALGDAPVHLGAQTMHWQDEGAQTGEISPLMLRDCGVGIVELGHSERRASHGETDATVNAKVASALRHGLRPLICVGDQGDDLDAGASIETVLRQVKLAIKGIDTASLGRALIAYEPVWAIGEAGRPAEPAHVAEVHGALRAMLGQRGLAALPLLYGGSVDRANAGALTALANVDGLFVGRAAWTARGFEEVIEAALHGAKDRAGLA

SEQ ID NO: 26846 - protein, 277 aa, Sinorhizobium meliloti 1021
MGGPMSVYFEKSYQRGFGTYPLKGEPLKAAVREAITVGYRAFDTAQMYGNEAETGEALAESGLARDELCITTKVHPDNYSEEAFLPSVEASLKALRVDQADVLMLHWPEINGENARSLRLLQKAFDIGLARNIGVSNYTAPMMREAQSIVEAPLVTNQVEFHPLIDQSRLLDAAEETKIALSSYCSVARGEVFKHPVFAEIGARYGKTAAQTVLRWILQKGVSMNTMSTKPENIRANFEILDFALSPHDMKRIDAMNATNYRILKAGMLPWVPDWDR

SEQ ID NO: 26847 - protein, 300 aa, Bacillus halodurans
SFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 26848 - protein, 498 aa, Sinorhizobium meliloti 1021
MDQLNNFLSPPAAPRDFGFFVDGKWQSGHDFFVRHSPGHGVAVTRTAKCSVDDLNAAVAAARRAFEDRRWSGLPGGSRASVLLRVAEILRTRRDELAYWETLENGKPIAQARGEIDHCIACFEVGAGAARLLHGDSFNSLGDGLFGMVLREPIGVVGLITPWNFPFLILCERVPFILASGCTMVVKPSEVTSATTLILAEVLAEAGLPDGVYNVITGSGRTIGQAMSEHPDIDMLSFTGSTAVGRSCVHAAADSNFKKLGLELGGKNPIIVFADSDLEDAADGAAFGISFNTGQCCVSSSRLIVERSVAREFEALLAEKMKRIRVGDPLDETTQVGAITTEAQNTTILDYIAKGKTEGAELVTGGTAIDLGRGQYIAPTLFSGVSREMAIARDEIFGPVLCSMTFDTVEQAVELANDTVYGLAASVWTKNIDKALTVTRRVRAGRFWVNTMMAGGPEMPLGGFKQSGWGREAGMYGVEEYTQVKSVHVEIGKRTHWIS

SEQ ID NO: 26849 - protein, 549 aa, Geobacillus stearothermophilus
MLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPGVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTITSDGWGEFKVNGGSVSVWVPRKTTVSTITRPITTRPWTGEFVRWTEPRLVAWP

SEQ ID NO: 26850 - protein, 141 aa, Herminiimonas arsenicoxydans
MAIERTLSIIKPDAVAKNVIGQIYSRFEGAGLKIIAARMAQLSRAEAEGFYAVHSARPFFKDLVDFMISGPVMIQVLEGENAIAKHRDLMGATDPKKAEKGTIRADFADSIDANAVHGSDAEETAKVEIAYYFPALNVYSR

SEQ ID NO: 26851 - protein, 336 aa, Opitutaceae bacterium TAV2
MSGVQAISARGAHSFFLKIDGSTWAVGRNKYGQLGDGTTTDQSKPVKVMSEVQASVATTIETEGSTPIEAMSGLPAVAAGTFHSLFLKSDGSVWVVGLSGFGQLGDGTTADRGTPVKVMSGVKAIAAGGAHSLFLKSDGSVWAVGLNNLGQLGDGTTANRITTPVEVMSGVKAIAAGMGHSLFLRNDGSVWAVGHNESGQLGDGTTVDRSTPVKVMNGVQAIAAGVTHSLFLKSDESYWTVGDNESGQLGDGTTTGRSTPVKVMSGVQAIAAGEAHSLFLKSDGSAWTVGSNGSGQLGDGTMTGRSTPVKVMNGVQAIAAGEAHSLFLKNEEVPRL

SEQ ID NO: 26852 - protein, 328 aa, Synechococcus sp. RS9917
MSRVYADNSQAIGNTPLVRLNHVTKGCKATVLAKVEGRNPAYSVKCRIGANMIWDAEKRGVLSEGKTIVEPTSGNTGIALAFTAAARGYKLVLTMPESMSIERRRVMAVLGAEIVLTEAAKGMPGAIAKAKQIAESDPAKYFMPGQFENPANPEIHEKTTGPEIWNDCDGAIDVLVAGVGTGGTITGVSRYIKNQAGKAIESVAVEPAHSPVITQTLNGEEVKPGPHKIQGIGAGFIPKNLDLSVVDKVEQVTNEESIAMALRLAKEEGLLVGISCGAAAAAAIRLAQQDAYAGKTIVVVLPDLAERYLSSVMFADVPTGIIEQPVAV

SEQ ID NO: 26853 - protein, 308 aa, Coprinopsis cinerea okayama7#130
MSFALPARQITFGRTNAQSQQQQHTFHQQQQQQQQQQQQQQQLQYQPQNNGLALPAGAYSHQPPTTAASSSSLPGPSPLATNSYTAAQLQKQPAASTSTNAVAGPSSPPAAPSPSTPLTLEQQHITAVEGIVPTLQNIVATVNLDCRLDLKTIALHARNAEYNPKRFAAVIMRIREPKTTALIFASGKMVVTGAKSEDDSRLASRKYARIVQKLGFDAKFSEFKIQNIVGSCDVKFPIRLEGLAYSHGQFSSYEPELFPGLIYRMIKPKVVLLIFVSGKIVLTGAKVREEIYTAFNTIYTVLCEFRKP

SEQ ID NO: 26854 - protein, 439 aa, Bacillus anthracis str. Ames
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVNTPEKAPKAKQPTDGKPRFSPAVLKLAGEHNVDLDLVEGTGANGRITRKDILKLVESGNIPQAGAVKKEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 26855 - protein, 614 aa, Zea mays
  misc_feature (61)..(61): Xaa can be any naturally occurring amino acid
  misc_feature (107)..(107): Xaa can be any naturally occurring amino acid
  misc_feature (123)..(123): Xaa can be any naturally occurring amino acid
MAAALPHSRLHLPLHTPSPTSRRRPCPRSRRRLPSFVAVSRLQNTTAATHPVLPPPAPPPXSAALLAAEGASLAPRREHRFPGSVSSPTSTASASNEAEYAVLLRAXLQVRRAVAAEVLVAAXLGGGKVGGLTYIKNLTGRMGPFVDRVVVEAAAMRRDRPELAHMSFNARAKAYIQESGLVELVKWFKHNSMTYPQIAKVVCACSGDLGKVRKMIKWLRSIYVKGDFLGRVLANGGSFLNRSFEELEEIIGYLESLGVRRDWIGYVISRCPQLLSLSMDELETRVRFYTDLGMDKKDFGTMVYDYPRVLGFLSLEEMNSKVQYLKEFGLSTEELGRLLAFKPQLMACSIEERWKPLVKYLYHLNISRDGMKRMLMVQPTIFCLDLETVIAPKVQFLIDIGVRSDAIGNVLAKFPPVLTYSLYKKIRPVVIFLLTKGGVKQDDIGKVIALDPQLLGCSIAHKLEVSVKYFRSLGIYHFVLGQMIADFPTLLRYNVDILRPKYQYLRRVMVRPLKDLIEFPRFFSYSLEDRIEPRHRTLVVNRINMKLRYMLTGSDEEFAQRVREAVERRARFEAGKAGLETFSCSSETSSDAEATEAAACQNSMDVVGVLQKEA

SEQ ID NO: 26856 - protein, 303 aa, Bacillus cereus ATCC 14579
MCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGVGKKVLCIAPDTGERYLSMGLFE

SEQ ID NO: 26857 - protein, 471 aa, Mycobacterium avium subsp. paratuberculosis K-10
MSSPQEYDMVVIGSGPGGQKAAIASAKLGKSVAVVERGQMLGGVCVNTGTIPSKTLREAVLYLTGMSQRELYGASYRVKEKITPADLLARTQHVIGKEIDVVRNQLMRNRIDLLIGHGRFVDPHTIEVEDPSRREKITISGKYVVIATGTRPARPSGVEFDEDRVLDSDGILDLKSLPTSMVVVGAGVIGIEYASMFAALGTKVTVVEKRDDMLDFCDPEVVEALKFHLRDLAVTFRFGEEVTAVDVGSAGTVTTLASGKQIPAETVMYSAGRQGQTDHLDLHNAELEADNRGRIFVDDNFQTKVPHIYAVGDVIGFPALAATSMEQGRLAAYHAFGEASDGITELQPIGIYSIPEVSYVGATEVELTKDAIPYEVGVARYRELARGQIAGDSYGMLKLLVSTQDLKVLGVHIFGTSATEMVHIGQAVMGCGGTVEYLVDAVFNYPTFSEAYKVAALDVMNKVRALNQFRR

SEQ ID NO: 26858 - protein, 473 aa, Bacillus anthracis str. Ames
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIVAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 26859 - protein, 333 aa, Bordetella bronchiseptica RB50
MPEARLPRIAVLATGGTIAGAQTDAASGAYRAGSYGVGQLLAAVPQLAGLARIGAEQIANVGSQNMSHAVWRQLALRAAALCDDPATDGIVITHGTDTLEETAYFLSLVLPVDKPVVLLGAMRPATALSADGPVNLYNAVALACHPAARGRGPLVVMNEDIHLARHVQKTAASGIAAFASPNAGRAGVMQGGRPVFHARAERQAADALLRPDELPQQAWPRVDIVHACVDLDGELIDFMAGRAQGIVLAGVGDGNATDAALQALQRASARGVAVVRASRTGSGRVGRNIEIDDDACGFIAAGDLSPQKARVLLTLGLCQTRDTARLQALFDSR

SEQ ID NO: 26860 - protein, 485 aa, Hibiscus punaluuensis
  misc_feature (6)..(6): Xaa can be any naturally occurring amino acid
STLEKXNLGRISQIIGPVLDVAFPPGKMPNIYNALVVKGRDTAGQQINVTCEVQQLLGNNRVRAVAMSATDGLTRGMEVIDTGAPLSVPVGGSTLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQSVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKLK

SEQ ID NO: 26861 - protein, 398 aa, Acidobacteria bacterium Ellin345
MPHGTETLLLQLFTIFVWAKAFGEIFERLRLPAVLGEILAGVILGPFAAKLIEPSDTIVSMAEIGAIFLLFSVGLETSPKDLIKVGRTSLNVALAGIAAPFLLGFIYLKARGEVTHEAAFVAAAMVATSVGITARVLSDLHVIKSYTSQVILGAAVFDDILGMILLTIVVSLAEGSGIQYIHLGIVAAEAVGFALIMIFVAPRVVGRMEPGLQKMSSGNAPLILALAICLGFSVLATKIGMAAIIGAFFAGLIFADHAPRWELESPVRGITEFLTPFFFFTMGARLDLHIFTPDLIVAASIVGFLALVSKVVGCGLPVLHEGWKTALKIGVGMTPRGEVALIVALIGLQMNMVSQRAYAIVILMTAITTILPPPFLRMLYRDEIVDSEEEPQSVAADV

SEQ ID NO: 26862 - protein, 56 aa, Zea mays
MKTFDPWPVFFRREWKRNWPFLTGFAITGFIITKMTANFTEEDLKNSKFVQEHKKR

SEQ ID NO: 26863 - protein, 524 aa, Synechococcus sp. WH 5701
MVLAILDGWGFREEARHNAVQGASTPVMDALWEVYPHTLIQASGGDVGLPDGQMGNSEVGHLTIGSGRIIRQELVRIGKAVRDGSLAANPALNELADRLLRDGGTLHLLGLGSDGGVHSHIDHLGGLLQWAASRGLSDVCIHVITDGRDTPPQSAIPYLECIEAQVEAAGVGRISTICGRYWAMDRDNRWERTEKAYRLLSEDGEITSLSFQEAIHAAYAEGINDEFLEPLRLAPGSLKPGDGLICFNFRPDRVRQLIRSLVLDDFDQFERKRISPLHVVTFTQYELGLPVAVAFPPESLDGLLGQVVSAHGLRQLRTAETEKYPHVTYFLNGGIEQPFPGEDRHLVPSPRVATYDQAPAMAADQLTDNCIAFLNKGVYSLVVINYANPDMVGHTGRMDATQQAITTVDHCVGRLVEATNRLGGTVLITADHGNAELMEGEDGRPWTAHTTNPVPVILVEGEKRKIGGHGAAPQLRQGGGLADIAPTLLQILGLPQPSSMTGSSLVEPLDLVSPKAAFAEALQV

SEQ ID NO: 26864 - protein, 319 aa, Physcomitrella patens subsp. patens
MASWTVTLLVGAAVAVVVTNLAAVTDAELQYGYYDRVGCFGVENRVRTLVRRSFIADVTASAAMLRLAFHDCQVGPGGCDGSIMIEGNGGEMSSGNNFGVKRLDIINSVKADMEKMCPTTVSCADIIAMAGRDAVAFNGGPDIKIPLGRKDAVSSSATEADAKLPPATSSIDRVFNVFGAFGMTHEESVAILGAHTIGVGHCKSIQDRLQSNSPTAPNSLVFRTQLTAACAVNVFNIAVLTNDATQFTFDNQYFKDIQNGRGLFTVDNLLSIDPRTAPIVNTYAANKGAFFAAFQSAYVKLTSRALKGNQGSVRSTCLH

SEQ ID NO: 26865 - protein, 179 aa, Triticum aestivum
  misc_feature (16)..(16): Xaa can be any naturally occurring amino acid
  misc_feature (35)..(35): Xaa can be any naturally occurring amino acid
SSHAPPPLWASSATSXVAPFPGLKSTAGLPVSRRXNGASLGSVSNGGRIRCMQVWPREGIKKFETLSYLPPLSTEPLLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 26866 - protein, 391 aa, unidentified bacterium
EFQTGDVLRISMDENLEGTKEKIAVTYAGLFDDVQVGGQVLFDDGLLGTTVLEKDVANRELVVRVDNDGILGSRKGVNAPGVSINLPGITEKDADDIRFGLDHGINYIAASFVRKPEDVLEIRGLLKEKNMEHVQIVPKIESQEGIDNLDAIIAVSDGLMVPRGDMGVEIPAENVPLVQKEMIRKMNLAGLPVITATQMLDSMEENPRPTRAEASDVANAVFDGTDATMLSGESANGEYPVEAVATMAAIDEKAESSLPYYGRHQDLHFDETDSTEAVASAVSRIAHSVNAKAIVVSTNSGYTACMVSKYRPEVNILAVTYSERVQRGLTLNYGVLPVVYEAPATIDEMIALAKTAVKEQGLANSGDTIVIAAGVPMSQSGTTNMITVQTV

SEQ ID NO: 26867 - protein, 564 aa, Cryptococcus neoformans var. neoformans JEC21
MQPPAIYNHHRLPPAGTPSQPSVLAQPSTARLNELFDLIRQEYETLGTDGNIWKQQRDEYEAKVQSQINELGMIRQSLYELEANHAKIRQEYETEIARLRRELESRGGPSSSAPSGAAAALNNPSSPSDLHRPGEDRPPFGMTLPGPTLNGLDAGRSRSPYPNPTAGPPILRPPSAADRDRERRITRPPQFNAPPSPPVHLSDLDPDNVSRELRKEGSDWQAMWSSQMRKQLDVTLVHTLEHETVVCCVKFSNDGKYLATGCNRTAQIYDVKTGARVSTLQDDLANRTGDLYIRSICFSPDGKFLATGAEDRQIRIWDLKQRRICHLLQGHMQEIYSLDFSRDGRFLVSGSGDKSARIWDVEKGTCVFNLQIEDFIHNEHGPIDAGITSVALSPDGKLVAAGSLDTMVRVWNVSTGQQVERLKGHKDSVYSVAFSPDGKCLVSGSLDRTLRIWDLTGTKREVESLPPGKEAQKNLGTCQSTLNGHKDYVLSVAISPDGQWVVSGSKDRSIQFWHISTGQAQLMLQGHKNSVISIDLARSGGYLASGSGDCMARIWKYEPIPGRD

SEQ ID NO: 26868 - protein, 295 aa, Bacillus cereus ATCC 14579
MDYLLSKEKVKRWPKDMIAAGRCHTVGLKSDGTVVAVGRNKEGECNVSGWRDIEAVAVGNVHMATNTGNAHTIGLTCDSTAVALGWNKHEQCDVNDWHNIVAVAAGWRRTIGLKSDGTVVAVGRNKEGECNVSSWQGIVAVTAGDWHTVGLKLDGTLTTVGNNRYGQCNVSSWRGIVAVKAGYLHTVGLKRDGTVTAVGNDKHNQCDVSGWRDIVAIAAGTNHTIGLKSNGTVVAVGWNEYGQCNVSDWRDIVAIAAGCAHTVGLKSDGTVIAVGNNEFGQCDVGSWRDIRLPGK

SEQ ID NO: 26869 - protein, 851 aa, Deinococcus radiodurans
GAFGWEQDRGAPFSGRSPRILTRMTDAPRPTAGADAPARPPAAPLVAPNFITEIIERDLEAGKYPRVVTRFPPDPSGYAHLGHVFASLLDFNTARQYGGQFNLRMDDTNPELARQEYVDSIADDLKWLGLDWGEHFYYASDYFDRYYAYAEQLIRQGDAYVESVSPEELSRLRGNATTPGTPSPYRDRSVEENLDLLRRMKAGEFADGEHVLRAKIDLTAPNMKLRDPVLYRIVNKPHFRTSDEWHIYPAYDFEHPLQDAIEGVTHSMCSLEFVDNRAIYDWLMEKLNFDPRPHQYEFGRRGLEYTITSKRKLRELVQAGRVSGWDDPRMPTLRAQRRLGVTPEAVRAFAAQIGVSRTNRTVDIAVYENAVRDDLNHRAPRVMAVLDPVKVTLTNLDGEKTLSLPYWPHDVVRDSPDGLVGMPGGGRVAPEEAVRDVPLTRELYIERDDFSPAPPKGFKRLTPGGTVRLRGAGIIRADDFGTDEAGQVTHIRATLLGEDAKAAGVIHWVSAERALPAEFRLYDRLFRVPHPEGENADVEDDSAGPAEHEAEPGAGQETAPVSQGFMRYLTPDSLRVLRGYVEPSVAGDPADTRYQFERQGYFWRDPVELERVDSREDALVFGRIITLKDTWGKQGGGTQQKAEGKKRPSTKGRGPDEVRGEGSSSPAKAHAPKAQPLTPEQDAEFTRLLGLGASEGDARTIARDPALLAFVGGAAPGDTFAQVASWTVNELVAGLRAGEVKVRAADLAPLAEGVASGQLSARIAREALARAAASGDAPLTIIEREGLNAGLSAEALQQVVAQVIAANPDKAEAYRGGKTALLGFFTGQVMRATAGKADPQALAAALKDALA

SEQ ID NO: 26870 - protein, 308 aa, Zea mays
  misc_feature (142)..(142): Xaa can be any naturally occurring amino acid
MGHLRGLTAARLLAAAFLLSVAVPAARAQEETEHEEEFSYVVGDENGPEHWGSIKAEWGNCSAGRMQSPIDLSHERVSLVRSLGYLTHSYRPAEAAIANRGHDIMVRFKGDAGFLVINGTAYYLKQMHWHSPTEHTVDGRRXERMNGGLLVSSSSLRANNIIKTRRAYVWTAYDMELHLVHESSANKAAVIGMLYEIGAEDPFLQALEPSIHRIADRQDREEAIGVVDPRRARGRASVYYRYVGSLTTPPCTEGVIWTVVKRVRTVSRHQLELLREAVHDGMEKNARPVQDVNDRDISIFRPKPHKHY

SEQ ID NO: 26871 - protein, 143 aa, Brassica napus
  misc_feature (23)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (53)..(53): Xaa can be any naturally occurring amino acid
  misc_feature (58)..(64): Xaa can be any naturally occurring amino acid
  misc_feature (66)..(66): Xaa can be any naturally occurring amino acid
  misc_feature (70)..(71): Xaa can be any naturally occurring amino acid
  misc_feature (78)..(78): Xaa can be any naturally occurring amino acid
  misc_feature (82)..(83): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(94): Xaa can be any naturally occurring amino acid
  misc_feature (96)..(96): Xaa can be any naturally occurring amino acid
  misc_feature (103)..(106): Xaa can be any naturally occurring amino acid
  misc_feature (109)..(109): Xaa can be any naturally occurring amino acid
  misc_feature (111)..(116): Xaa can be any naturally occurring amino acid
  misc_feature (118)..(118): Xaa can be any naturally occurring amino acid
  misc_feature (126)..(126): Xaa can be any naturally occurring amino acid
  misc_feature (131)..(132): Xaa can be any naturally occurring amino acid
  misc_feature (134)..(134): Xaa can be any naturally occurring amino acid
  misc_feature (141)..(141): Xaa can be any naturally occurring amino acid
NVKRKEEEEVVVASSMLSSAAVXXSXAXXTXXAXFTGLXASAAFPVTRXAYNXITSIXXXXXXXSXMKVXXPVEKKKXETLXXLPDXTXXELXXEXDYLLRNXXXXCGXFXXXXXXVXREHGNTPXYYDGXXWXMWKLPLXGC

SEQ ID NO: 26872 - protein, 506 aa, Zea mays
MATANGSSKGSFEVPKVEVRFTKLFIDGKFVDAVSGKTFETRDPRTGEVIASIAEGDKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGPDAAVGAHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 26873 - protein, 592 aa, Oryza sativa Japonica Group
MVSDASKKKAAQKKAAAAAKRGAKASSSSSSSSSAADKAANGIAALKLSDRTCTGVLASHPLSRDIHIESLSLTFHGHDLIVDSELELNYGRRYGLLGLNGCGKSTLLTAIGCRELPIPEHMDIYHLSSEIEASDMSALQAVICCDEERMKLEKEAEILSAQDDGGGDALDRIYERLEALDASTAEKRAAEILFGLGFNKQMQAKKTQDFSGGWRMRIALARALFMNPTILLLDEPTNHLDLEACVWLEETLKKFDRILVVISHSQDFLNGVCTNIIHMQSKKLKLYSGNYDQYVQTRSELEENQMKQYKWEQEQIASMKEYIARFGHGSAKLARQAQSKEKTLAKMERGGLTEKVVRDKVLVFRFTDVGKLPPPVLQFVEVSFGYTPDNLIYKNLDFGVDLDSRIALVGPNGAGKSTLLKLMTGDLAPLDGMVRRHNHLRIAQYHQHLAEKLDLDMPALQYMMREYPGNEEEKMRAAIGKFGLSGKAQVMPMRNLSDGQRSRVIFAWLAYRQPQLLLLDEPTNHLDIETIDSLAEALNEWDGGLVLVSHDFRLINQVAQEIWVCEKQAVTRWEGDIMDFKEHLRSRAGLSD

SEQ ID NO: 26874 - protein, 150 aa, uncultured proteobacterium RedeBAC7D11
MKTSKLDIKKPSSDLDHFKIAVVSTNWHEEIIKPMLEDCLTLLKEYNLEKKSFVVPGAYELPFIAQVLCKNYDAIILLGCIIKGETPHFEIISQSISDKVLETSLEKDTPIIFGVLTTNNESEAKERAAYKGSEFAMSALSILDTLNNLK

SEQ ID NO: 26875 - protein, 450 aa, Sinorhizobium meliloti 1021
MLIAAARQLEKGRMTTITVDDALDRAGTGTYQRRLMAIFGLVWAADAMQVLAVGFTAASIAATFGLTVPQALQTGTLFFLGMLFGAAGFGRLADRIGRRRVLIATVACDAVFGLLSVFAQDFTVLLLLRFLTGAAVGGTLPVDYAMMAEFLPARNRGRWLVMLEGFWAVGTLIVALAAWAASLAGVADAWRYIFAVTAIPALIGVGLRFLVPESPLYLLRLGKTSEAKAIVDEILVVNGKMRLGAGASLVPPPPTASAGIFSADLRKRSLMILAIWFLVSISYYGVFTWMPPRLAGEGFGFVRGYGFLVVLALAQIPGYALAAYGVEKWGRRPTLIGFCLLSALGCLLFVAAGTAMLIGVSLLIMSFALLGTWGALYAYTPELYPTASRATGMGAAGAMARLGGLLAPSLMGLVVAQSFGLAIGIFAGLLLVAAVAAFLIDAETRRVSLA

SEQ ID NO: 26876 - protein, 345 aa, Zea mays
PRVRRDRERDCQRGEAAGQSSIRARGLRAERQGAMAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKSLAEKYGKTPAQLVLRWGLQRDTVVIPKTSKAERLQENFDVFGFDISGEDMERMKAVDRKYRTNQPAKFWGIDLYA

SEQ ID NO: 26877 - protein, 201 aa, Bacillus halodurans
MGKPTGFMEYKRETPPKKDPFERSKNWQEFTLLMPESALRQQGARCMDCGVPFCQTGTSMDGSGEIGCPVYNLIPEWNDLVYRGHWKEALERLHKTNNFPEFTGRVCPAPCEGSCTVAISDDAVAIKSMEFHIVERGFQEGWIVPNPPRSRTGKKVAVVGSGPAGLAAAAQLNKAGHWVTVFEREDRIGGLLTYGIPDVKL

SEQ ID NO: 26878 - protein, 167 aa, Crocosphaera watsonii WH 8501
MQAIYIPHLLNAPNRTQTLVFDDFIPELQSLTPFRGKMMVRHGGTFLEVGVKGETIITLTCDRCLQRYNRRLALDTSEIIWLDKDAELPQNYPQEREVSLEDLSETLSPDGHFDAQGWLYEQLCLAVPLRQLCGKDCQPPKTKTEENEPKIDSRWSGLEALKQQLQN

SEQ ID NO: 26879 - protein, 370 aa, Bacillus halodurans
MQVVRSFKIRGAFHQISSIPKEELNNGVVCASAGNHAQGVAYSCHTLQIPGKIFMPTTTPRQKVDQVKFFGKEYVEVILTGETFDDSFNEAKEYGIKHKMTFIHPFDQEKIVAGQGTVGMEIMNDIDDNIDYLFCSIGGGGLISGVGTYIKSISPRTKVIGCEPAGAPAMKESLKQGKVIELEKIDKFVDGAAVKKVGEIPFEICQKILEDIVLVPEGKICTTILNLYNQDAIVAEPAGAMPIAALDFFKDEIKGKTVVCVLSGGNNDIGRMQEMRERSLIYEGLQHYFIIQFPQRAGALKEFILDVLGPDDDITRFEYTKKNNKSNGPVLIGIELKCDEDYHRLMDRLNKKGFEYREINKNESLFNLLI

SEQ ID NO: 26880 - protein, 309 aa, Magnaporthe grisea 70-15
MCLGICRARNYSFVIAPLDVVKIRLQLQTHSLSDPLSQRAELLRGGPVYKGTLSTMRHIARQEGITGLWKGNVPAELLYITYSAVQFATYRSAAQLLHRVAGEDRQLPAAAESFVAGAAAGVTSTTVTYPLDLLRTRFAAQGSGDDRVYQSLRRAVADIWRDEGYRGFFRGIGPAVGQTFPFMGIFFAAYESLRAPLADLKLPFWGGQLALASMTASTLAKTAVFPLDLVRRRIQVQGPTRSKYVHKNIPEYKGTFSTISTIARTEGFRGLYRGLTVSLIKSAPASAVTMWTYERVLRALITFQSGRQD

SEQ ID NO: 26881 - protein, 523 aa, Zea mays
MAWARLASRSRLRPAASAAGRSRHASTPAPPPPPSPPTTRTVPAATSAPPLRRLLLLPRHRFADATPSASTAWLLGARWRQGHGRRCFASAAYPAQATPGEASELVDVPLAQTGEGIAECELLRWFVAEGDQVDEFQPLCEVQSDKATIEITSRFKGKVHKIHFVPGDIVKVGETLLKMVVGDSQIVSPDNIVPSAGKSLGVESAVFSSEGNVPGGNLSTPAVRHLAKQYGISINEIVGTGKDGRVLKEDVLNYAVSKGVCKQQSLASEGNIGQVELLEEGKALLDEDFYEDKKILLRGYQRSMVKSMSLAAKVPHFHYLEEINCDSLVQLKTTFQNENKDQTIKHTFLPFLIKSLSMALSKYPMLNSSFIEETNEVVFKGPHNIGVAMATTHGLVVPNIKKVQSLSILEITKELARLHEMASQNRLSAADIEGGTITLSNIGAIGGKFGSPLLNLPEVAIIALGRIQKLPRFDDDENVYPSSIINVTVGADHRVVDGATVARFCNEWKSLVEKPELLLLHMR

SEQ ID NO: 26882 - protein, 412 aa, Bacillus cereus ATCC 14579
MKIEDILMAHNCLKDIVIKTPLQRDTVLSEKYDCDVYVKREDLQLIRSFKIRGAYNLIQSLPKEKLQNGVVCASAGNHAQGVAYTCNLLKIPSKIFMPTTTPKQKVSQVQFFGGDFAEIVLVGDTFDSSFQEAQCYCEENRMTFVHPFDDPYVVAGQGTVAVEIMHDMEKPVDYIFTAIGGGGLASGVGTYVKGVSPTTKVIGVEPMGAASMKEAFLQNENVALEKIDSFVDGAAVKKVGKLTFETCKDVIDDIILVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLITRFKENNIQFMELNKNPVLFDLLI

SEQ ID NO: 26883 - protein, 360 aa, Cryptococcus neoformans var. neoformans JEC21
MLPHLILSLASLFALPAVFAATTCNGHSELCSRLYSNVTFIGAHDSYAVGSSVADDQDKDVTSQLNDGIRTLQIQAHNASDGIHLCHSSCSLLDGGLMSDYLSTVASWVNDNPNDVITIVIVNSDNLPPTSFSPVFESAGLSSKVYTPASQPTQLSDWPSLSDMIDAGTTVVAFMDYEADTSSVPYLLDEFAAMWEDAYGVTTQEFGCAVNRSSGDTSSQPFLINHFLDSTYSFSSIQVFVPNKDKLNETNAETGTGSIGYHVNNCRQLWGRNPNHILLDFYDSNGNSPFNVAASLNGVSAPTNTVTAGTASATSSGTAAVVSTQSLSGSVTSIEGIAKGITLGLGVMLGVGMGVGRVFL

SEQ ID NO: 26884 - protein, 630 aa, Bacillus anthracis str. Ames
MDLTQIQNPSFLKDMSISELEGLSEDIRKFLIEELSQTGGHIAPNLGVVELTIALHKLFDSPKDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARTDERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVIMMPKDENEGQHLVYTAMQYEDGPIALRYARGNGLGVHMDEELKAIPIGSWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 26885 - protein, 296 aa, Bacillus anthracis str. Ames
MTIAFDTFLKESKTFVEEKLVSYANELQCPNVLREAMAYSLEAGGKRLRPLLLFATLQAFDKERNLGVGAACALEMIHTYSLVHDDLPCMDDDDLRRGKPTNHKVFGEAMAVLAGDGLLTYAFQVIMAYGQKEISAEKKVRLVLELAKAAGPEGMVGGQVADMEAEGKQLTIDELEYIHKHKTGKLLEFAVLAGSILSDATEEQEEKLLEFAKYIGLAFQIRDDILDVEGTEEEIGKPIGSDVSNEKSTYTTLFTVDRAKDILDETIAKAKDAIGSLQLQDEYLLSICDLIAKRNN

SEQ ID NO: 26886 - protein, 366 aa, Ostreococcus tauri
MGTRSSSARVTTASASATRRAWEISSKGSLKNLELNTVPSVVLNPDECRVRVRAIGLNFADVFTALGLYSAAPKGRFVPGLECSGEIVELPNGYAGDFHVGDKVMCVVRFGAFADEVAVPMTQMRPLPNGWTFEEGAGFLVQGLTSYYGLRALGDVKRGSTVLVHSAAGGCGLMSLGICEAVGAEPIAVIGNAGKEETLKERFPSLRAVIVRDRKRFKQQVKEACDSIGASEGCDIVFDATLGDFFQGGWDNLARGGRYVVYGAADLTPRGDSIGVVGWVKLAWKFLRRKKVDPLMLPGENKGILGFNLIWQFDKQEELARLLAELNALNLPAPKVGATFNFTDLPEAMRLFQTGQTTGKVVVTVE

SEQ ID NO: 26887 - protein, 211 aa, Methanococcoides burtonii DSM 6242
MAYEYNEEWVPQTRLGKLVFDGQVTSMDEAMDSGLPIRESKIVDLLLPELEDEVLDINMVQRMTDSGRRVKFRATVIVGNGDGFVGLGQAKDVQVGPAIRKAIDNAKINITRIKRGCGSWECGCGLPHTVPSEVNGKAGSVTVVLKPAPRGLGLAAGGTARKVLEKAGVKDVWTRTEGQTRTTLNFAKATYNALMNTGTVRRPIVFDETEA

SEQ ID NO: 26888 - protein, 614 aa, Arabidopsis thaliana
  misc_feature (24)..(24): Xaa can be any naturally occurring amino acid
  misc_feature (46)..(46): Xaa can be any naturally occurring amino acid
MASLSGLYSSSPSLKPAKNHSFKXIAGAISRFLLFPTYLQTHQSTXLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 26889 - protein, 99 aa, Triticum aestivum
MAAEGGGGGGGGKVSFKVILTSDPKLPFKVFSVPEAAPFTAVLKFAAEEFKVPPQTSAIITNDGVGINPQQSAGNVFLKHGSELRLIPRDRVGATAASF

SEQ ID NO: 26890 - protein, 265 aa, Saccharophagus degradans 2-40
MSTPIVWIDAFTSTPYGGNPAAVCLLSSPKPDAWMQALAAELNISETVFLLALDDGSYSLRWFTPAAEIELCGHATLASAHALWNHFNQSGETLVFKTLSGDLTAVKNEQGITLNFPEVAPTPFAINADVADALGKQPVWSGQAGKKLFIELESAQAVRDCQPDFAAICALPLRGVVITAASDEPQYDFISRFFIPELGINEDPVTGSAHCSLAPYWAAKFNKTTLTGYQASKRSGVVKVALIENRVTLTGQCQTIFAGELSEHL

SEQ ID NO: 26891 - protein, 647 aa, Bacteroides thetaiotaomicron VPI-5482
MKNEPIYNLLNSINSPDDLRRLEVDQLPEVCDELRQDIIKELSCNPGHFAASLGTVELTVALHYVYNTPYDRIVWDVGHQAYGHKILTGRREAFSTNRKLGGIRPFPSPEESEYDTFTCGHASNSISAALGMAVAAAKKGDDQRHVIAIIGDGSMSGGLAFEGLNNSSTTPNNLLIILNDNDMAIDRSVGGMKQYLFNLTTSNRYNQLRFKASRLLFKLGILNDERRKALIRFGNSLKSMAAQQQNIFEGMNIRYFGPIDGHDIKNLSRVLRDIKDLKGPKILHLHTIKGKGFAPAEKHATEWHAPGKFDPVTGERFVANTEGMPPLFQDVFGNTLVELAEANPRIVGVTPAMPSGCSMNILMSKMPKRAFDVGIAEGHAVTFSGGMAKDGLQPFCNIYSSFMQRAYDNIIHDVAIQNLPVVLCLDRAGLVGEDGPTHHGAFDMAYLRPIPNLTIASPMNEHELRRLMYTAQLPDKGPFVLRYPRGRGVLVDWKCPLEEIPVGKGRKLKDGKDIAVISIGPIGNKARSAIARAESESGRSIAHYDLRFLKPLDEELLHEVGRTFRHIVTIEDGTIQGGMGSAVLEFMADHEYTPTVKRIGIPDKFVQHGTVAELYQLCGMDEDSLTKELLKQCELLPDMSKIKELTN

SEQ ID NO: 26892 - protein, 304 aa, Haemophilus influenzae R2846
MIELNGKPFAEMWQSYGGDTLNSATYLSRVSSSKEIQVHYVSALGTDNLSKQMLKYWQEDGIQINCVLQDEQHQPGLYLIQLDAQGERTFLYWRNQSAARYMVQHPDFAKIIAELQQVDLIYLSGISLAILSKNDRTFLIEQLSSLAKKGVEIVFDSNYRPKLWGSLEEAQDCYLQLLPSVNIALVTFDDEQALWKDKTSRDTLERLHKIGIPKVIVKCGKNGAIFSDRYLSQYGQVMPEPILNVVDTTSAGDSFNAGFLNGYLRNKPLEICCQQGNRIAGIVIQHKGAIIDKVATSHLQSEFN

SEQ ID NO: 26893 - protein, 702 aa, Physcomitrella patens subsp. patens
MASSFRAASHCIPVSAPASAFPTNPFLLRSAPIWSGFGGLRVGVENGGSEAVHRPPHAGCGLGVRAGAGRVDRGGGREVVYGLLGRRAGESRRGKAGAALLRDFGSSRGRVLTAAMTDNMKNLNLDDDKSVNGDVAEKVDKSEEIGASGSLGRKKLEDLIWDHSFVRELPGDKRSDGPTRQVLHACYSKVTPSVRVKNPELVSWSRHVADLLDLDYKEFERPDFPLLFTGASQLKGGLAYAQCYGGHQFGVWAGQLGDGRAITLGEILNSKGQRWELQLKGAGKTPYSRTADGLAVLRSSVREYLCSEAMYHLGVPTTRALSLVTTGEGVLRDMFYDGNVKMEPGAVVCRVSPSFIRFGSFQIHAARDKADLPIVKQLADYTIHHHYPDFEDLPFERQGQDGSESQKGENNAPQIDTSKNKYSAWFTEIAERTALMIAKWQAVGFTHGVMNTDNMSILGLTIDYGPFGFLDAFDPKYTPNTTDLPGRRYGFANQPDIGLWNVMQLANTLYTAELITADEAQYVTIQIYADKFMFLYQQHMSNKIGLKTYNKDLLSKLLNNMAFDKVDYTNFFRSFSNLKATPETSDDDLIAPLKNALLDLSKERRKVWLDWLHQYVKNVVDEGVSEADRKALMNSVNPRYVLRNYMLQSAIDMAEQGDFSEVENLLKLIERPYDDQPGMEKYARLPPAWAYRPGVCMLSCSS

SEQ ID NO: 26894 - protein, 387 aa, Campylobacter jejuni subsp. jejuni NCTC 11168
MNIHEYQAKAIFVDNGIPTLKGKVAFSVDEAVANAKELGGSVWAVKAQIHAGGRGLGGGVKIAKNLDEVKDYASKILGMNLVTHQTGPEGKLVQKLYIESGANIVKEYYLAILFNRMAEQITIIASSEGGMDIEKVAKESPEKIAKVGIDPQIGFKMFHGLEVARVLGLDKDEGKKLISMIAKLYKLYMDKDMNMLEINPLIKTAEGDFYALDAKCSFDDSALYRHPEIAELRDTTEENPAEREAAEFGLSYVKLDGDVACMVNGAGLAMATMDIINYSGAKPANFLDVGGGASPETVAKAFEIILRDKNVKVIFINIFGGIVRCDRIANGILEATKNVEVNIPIVVRLDGTNAAEAKTILDNSNLKNIKAATNLKNGAELVKSLVG

SEQ ID NO: 26895 - protein, 597 aa, Silicibacter pomeroyi DSS-3
MRIRWQESLCLLWVGAATPLFAQQAADAVAPEGAATGQVRPFSAVVEAGQAAKEAGQPVEAENWMVAAANPLAVMAGGNVLRQGGTAADAMVAVQTVLGLVEPQSSGLGGGAFLVWYDGNTGQMTTLDARETAPREATPRLFQDADGQPLKFFDAVVGGLSVGTPGTPALLEEAHRRWGQANWGSLFGDAIWLAENGFTVSPRLAGLVEGDAEKLGRFPETAAYFLPGGAAIKAGDTLKNPAYAATLRALAAEGSAAFYGGPIAADIVRTVRNAEGNPGVLSGADLALYQVIEREPVCASYRAFEVCGMGPPSSGALTLGQILGLLEPYDLAALGAENPESWRLIGDASRLAFADRGRYMADSDFVPMPTKGLVDPDYLKTRSELLAGPNALESVAPGNPEFDHASNWADDISLELPSTSHISIVDRYGNVLSMTTTIENGFGSRLMTNGFLLNNELTDFSFKTHDNGVPIANRLEPGKRPRSSMAPTIVMQDGKPVLAIGSPGGSRIIGYVAQSIIAWADWSMNVQQALNAPHLVNRFGTYDLEEGTDAAGMEEALTGLGYKVSVRALTSGLHAIEIGDTLKGAADTRREGIALGE

SEQ ID NO: 26896 - protein, 461 aa, Raphanus sativus
MERRREFQRKVQEAQLPVEEQDEMMRSLARRETEYMRLQRRKIGIDDFELLTVIGKGAFGEVRLCRLRSTGEVYAMKKLKKTDMLSRGQVEHVRSERNLLAEVDSRYIVKLFYSFQDSECLYLIMEYLPGGDIMTLLMREDILSEDVARFYIAESILAIHSIHQHSYVHRDIKPDNLILDKSGHLKLSDFGLCKPLDDKYSSLLLEDEEMLSQEAESQSGKADSDKAPWQMPKEQLLQWKRNRRALAYSTVGTLDYMAPEVLLKKGYGMECDWWSLGAILYEMLVGYPPFCSDDPRITCRKIINWRVCLKFPEEPKISEEARDLICRLLCDVESRLGTRGAEEIKTHPWFNGTQWDKLYEMEAAYRPTVDGELDTQNFEKFPEVEGSASEAPQVGPWRKMLTSKDNNFIGFTFKKSDITRSMENTGTDMKPNGSGDAPSLISLLGRINMEEAEGGELNQKT

SEQ ID NO: 26897 - protein, 440 aa, Aspergillus nidulans FGSC A4
MADHEQEQEPLSIAIIGGGIIGLMTALGLLHRNIGKVTIYERASAWPDIGAAFAFTGIARECMQRLDPAILSALSKVAQRNPHDKVRYWDGFHPKSKEEAQDPEKSVLFEIEEKNMAYWACLRGVFHAEMARLLPERVVRFGKRLVAYEDGGDQKVVLRFEDGEVEEADIVIACDGVHSTARRVLLGAEHPAANARYSRKAVYRALVPMPAAIDALGTEKAHVQIAHCGPDAHIVSFPVNNAQIYNVFLFTHDSNEWTHGHTMTVPSSKEEILSAVENWGPHIKELASLFPEQLSKYAIFDQADHPLPYYAAGRVALAGDAAHASSPFHGAGACMGVEDALVLAELLEKVQNGSAFKEKKSNIELALKTYSDVRIERSQWLVKSSREMGDLYEWRYEDIGGDGVKCKAEWERRSRVIWDFDVQGMVDQAREAYERAVVKV

SEQ ID NO: 26898 - protein, 95 aa, Zea mays
MASSNGQTEAPAPSVPKNPAMASCRKKKTDDATFLEDLKDHMDEFIHASMDEHKTCFKKTIQKMFGMSKAVAERSAEANKAEVESALPLQTSVSQ

SEQ ID NO: 26899 - protein, 220 aa, Thermus thermophilus HB27
MGPVRFAPSILTADLARLGEAIREAEAAGVDWIHLDVMDGVFVPNLTFGPLLVEAVRRVTSLPLDVHLMIVKPERYLEDFAQAGADHITVHFEATYHPHRAVQKVKELGKKAGLAVNPGTPLEAFEPLLPDLDLALLMSVNPGFGGQRYLPTATERLRRLKAMRDRLNPACLIVVDGGINRDTVAEARRAGADVAVAGSALFNDKPVAENLKALRLALLG

SEQ ID NO: 26900 - protein, 528 aa, Zea mays
  misc_feature (382)..(382): Xaa can be any naturally occurring amino acid
  misc_feature (422)..(422): Xaa can be any naturally occurring amino acid
MAESGESSPNSAAATDDTHHEMPEAGAAAAAVHAQPRPPPPPSKVRLMVSYGGRIQPRPNDNQLAYVNGETKILSLERPLCFPDFAARLAALVGNAADVRVKYQLPGEDLDALVSVTNDEDLEHLVHEYDRLHVHRHATASSAGSSRGGSAPRLRVFLFPVQSPPPPPQPAGILEPKVEQRQWFVDALNTVLLPSSKQDPPPVPPQQQKQEQESVFAQQSPPPQAKHEAVFVQQSPPQPQTVVQMQMPPPQHVVLAAASPDYLFGLDNGFVHPPAVKVKDPAGDPPAVRESVPVELPAKNEDRHPIPNPAGDNVAVSPAEYQRQIPGLEKLQVADNAAHQPPPPAPAPAPAPSLAPTPVPAALPRNGSDDSLTRGYPLATPXPPNSSAEYYLPKFPEKPPVPPPPQSSAPPPPTYLQVQGRXGPVFFIPAPHGYFAATASPGATSYPAVYAVAPPSTAANGSAASPAASNATAYSPAPTQVAYDSNGRAIYYTSMLPQYPSAVNGMSSAGAVLGTEPVNPVAVKPTVS

SEQ ID NO: 26901 - protein, 341 aa, Streptococcus agalactiae A909
MAKIISLGEVLLRLSPPQYHTLMQANHLKCQFGGSELNVLASLAQLGHHVGLVSALPDNDLGKMARQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLSDVCFGLEPIYLAGESEDLKDELGLSRPYLDIELLEKITQKIVQEYGLDYIAFTQREMGYTNQYMLKSYLYHNNMLYQTDKTGVEVLDRVGTGDAFAAGLIHALLEKETPQRALEIAMTTFKYKHTIQGDINIMTRDDIAYLIEKETNDIKR

SEQ ID NO: 26902 - protein, 199 aa, Mycobacterium avium subsp. paratuberculosis K-10
MPGQPQTGPMVGRANIANLANTLTLLRLVLVPVFLLALFAGDGHETGFRILAFLIFAFACITDRLDGLLARNYGMATEFGAFVDPIADKTLVGSALIGLSMLGELPWWITVLILAREFGVTVLRLAVIRRGVIPASWGGKLKTVVQVFAIGLFVLPWAGTPGPFRVGAAVVMGAAIVLTVITGIDYVVSTVREVRRTAA

SEQ ID NO: 26903 - protein, 146 aa, Triticum aestivum
  misc_feature (77)..(77): Xaa can be any naturally occurring amino acid
  misc_feature (86)..(86): Xaa can be any naturally occurring amino acid
  misc_feature (94)..(94): Xaa can be any naturally occurring amino acid
  misc_feature (100)..(100): Xaa can be any naturally occurring amino acid
  misc_feature (102)..(102): Xaa can be any naturally occurring amino acid
  misc_feature (110)..(110): Xaa can be any naturally occurring amino acid
  misc_feature (113)..(114): Xaa can be any naturally occurring amino acid
  misc_feature (134)..(134): Xaa can be any naturally occurring amino acid
MANSAAPGGVRSFLQAVSTVTEETRTPLRVVQMEGLAVLKIIKHCEEFAPALVTGQLLGLDVGSVLEVTNCFPFPMXEEDDEADAXGANYQLEXKCLREXMXNNTNGWYXSCXXGSSNVELIEHYELSGDIRNXVIVKTTKIKGLQ

SEQ ID NO: 26904 - protein, 268 aa, Solanum lycopersicum
WKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYS

SEQ ID NO: 26905 - protein, 124 aa, Glycine max
  misc_feature (100)..(100): Xaa can be any naturally occurring amino acid
NTLYYKRFFPYYAFNVLGGLDSEGKGCVFTYDAVGSYERTGYSAQGTGSTLIMPVLDNQLKSPSPLLLPVRDAVTPLSESEAIDLVKDVFASATERDIYXGDKLEIVVINKAGTMREYIDLRKD

SEQ ID NO: 26906 - protein, 194 aa, Zea mays
MASSLLRSGHRLFLRRHRLPAAFSTATAEELIDVRKLPTNYDPSTFDPSSPSRPPPSDRVWRLVEEVSSLTLAETAALSSLLLRRLDIPSAPPIAILNSAAGLGGAATAGAAGEKAGAAGAAEKTVFELRLEGYDAASKIKVIKEIRSFTDLGLKEAKELVEKAPAVIKGGLSKDEAKAIVERMKAVGAKVVMD

SEQ ID NO: 26907 - protein, 286 aa, uncultured proteobacterium RedeBAC7D11
MSISETNAINISKVLTEALPYIRKFNNKVVVIKYGGNAMENKILQKNFARDLVLMKTVGIHPILIHGGGPQIDFELIKNKIKFEFKDGIRKTTLEMIKIVQKVLDNKINKDISDLIQFWGGKTIRLVGKKNSPIKAIKDSKKNLGEVGLVKSIDKKKIMTPLKAGKIPVISPIGWTSKDEPMNINGDFAACAVAASLKAEKIILLTDISGVRDLEGKKISTMSLKEAKRVLKNKKNIKGGMYPKLTGAIDCLEKGVKNAHIVDGRVPHSVLIELLTDKGVGTWISK

SEQ ID NO: 26908 - protein, 511 aa, Mycobacterium avium subsp. paratuberculosis K-10
MQDIQRADDALPTASRAERLRGVIRHDLPSSLVVFLVALPLSLGIAIASNAPVLAGLIAAIVGGIVVGALGGSPLQVSGPAAGLTVVVAGLVSDFGWGVTCFITVAAGAVQVLLGLSRVARAALAISPVVVHAMLAGIGITIALQQTHVLLGGKSKSTAWHNLIGLPGQIIGAHRPGVLLGVLVIVILVAWRWVPAKVRRVPGPLVAIVAVTVISVVFPFHVRRIDLDGSPLDALQLPDLPHGNWSGVAVGVITVALIASVESLLSAVSVDRMHNGPRTDFNRELVGQGAANMISGAVGGLPVTGVIVRSSTNVNAGARSRASAIMHGVWILLFTIPFAGLVDEIPTAALAGLLIVIGIQLLKPAHIETAMKHGDLAVYVVTAVSVIFLNLLHGVMIGLALAIALTGWRVIRAKIEAAQLDGEWRVTIEGAACTFLALPRLTRVLASVPRGATVTVAIAVHYLDHAAHQAITDWQRQQEATGGTVRIEGAVVATGRRDEPQVEAEMPGAAA

SEQ ID NO: 26909 - protein, 332 aa, Mycobacterium avium subsp. paratuberculosis K-10
MAAQMREPKVVVLGGGSWGTTVASICARRGPTLQWVRSRETADDINENHRNSRYLGNDVVLSDTLRATTDFCEAANTADVVVTGVPSHGFRGVLTELARELRPWVPVVSLVKGLEQGTNMRMSQIVEEVLPGHPAGILAGPNIAREVAEGYAAAAVLAMPDQHLATRLSGLFRTRRFRVYTTDDVVGAEMAGALKNVFAIAVGMGYSLGIALVIARALREMTKLGVAMGGSPDTFPGLAGLGDLIVTCTSQRSRNRHVGEQLGAGKPIDEIIASMNQVAEGVKAASVIMEFGLTMPIAREVDAVINHGSTVEQAYRGLIAEVPGHEVHGSGF

SEQ ID NO: 26910 - protein, 483 aa, uncultured proteobacterium RedeBAC7D11
MGKVTGFKEFNREVEPYRSPKKRVLDFKEIYTDHDESLLNTQASRCMNCGVPFCQSGEGCPVYNLIPEWNDLVYNEKWEEAFARLLKTNNFPEVTGRVCPAVCEGACVLGITETPVTIKNLEFAIADKGIESGWIKPVIPNKRTNKKIAIVGSGPAGLSAAQQLNSVGHSINVYERADRIGGLMMYGIPNMKLDKSIIDMRVDIMEEEGIRFHTNCDVGGKGKNSVSMEKLIKENDIVLLTTGATKPRDLPIKNRDGEGVYFAMEFLGQNTKSLLDSDLKDDSFINAKNKDVIVIGGGDTGNDCLGTSLRHGCKSLTNFEILPELPKERLENNPWPIFPRVYKVDYGHEESREVFGKDPREYSVSGKEFLRDKNGKLTGIKTVKVDKDFKEIKGTEQIWKADLIFLAMGFLGPEDYLNKKLKLELDERSNFKAEHNIHQTSHPKVFAAGDCRRGQSLVVWAINEGRAAAREIDRKIMGKTTLD

SEQ ID NO: 26911 - protein, 314 aa, Oryza sativa Indica Group
MPAGQPHAHEPDGGGASHRRPQSPPSLPAEVVPAFAPPESEDEESWVWSQIKAEARRDADAEPALASFLYASVALPTPPSRAPSPSTSPTSSAPPPSSPRSSTTSSWLPSPRTPPSARVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 26912 - protein, 370 aa, Sinorhizobium meliloti 1021
MNAFSPPPRLLMGPGPSNVSPEVLAAQARPTIGHLDPSFVGLMDRIKDQLRLAFRTDNRVTFPLSAPASLAMEMALVTLLEPGDTAIIAQNGVFGGRMAEIAQRAGAEVRLVSVEWGKPVDPEAVRASILEAPQAKLLAFVHAETSTGVRSDAASLCALAREAGLLSVVDTVTGLGGIPVSVDEWQADAVYAGTQKCLSAPPGLAPITFSDRAVSAVKARKTPIQSWFLDLGLMLGYWEGEGARSYHHTAPVNALYGLHESLSRLLGEGLETAWARHRAAHDRLVERLQGLGIAFVVDKEHRLPQLNTVWLPEGVKDVPERRRLLDEFGIEIGGGLGPLAGRIWRIGLMGETCRIENVDRLAEAIAAVLP

SEQ ID NO: 26913 - protein, 125 aa, Oryza sativa Indica Group
MAALASKLAQMQAKVCDAARFAAKHGCAYHRALMEKNQKYVADPPTIERCQELSKQLFYTRLASLPGRYEAFWKEADQVKNFWRNRKDLNVEHAGVAALFGIELYAWFCVGEIVGRGFTFTGYHV

SEQ ID NO: 26914 - protein, 306 aa, Clostridium perfringens SM101
MKNKIRKAIIPAAGLGTRFLPATKAQPKEMLPIVDKPTIQYIIEEAIASGIEEILIITGRSKKCIEDHFDKSVELEMELEKSGKNELLDLVRDISGMVDIHYIRQKEPRGLGHAIHCAKTFVGDEPFAILLGDDVVYNEEKPCLKQLIGCYNEYKTSVLGVQTVPESHVSKYGIVDGKHIEGKVYKVKGLVEKPSVEEAPSNVAILGRYIVTPRIFDILENTKPGKGGEIQLTDALLELMGQEAMYAYDFEGRRYDVGDKLGFLEATVEYALRRPELREGFVEYLNNLSEKESLFKKEVEKEIVTV

SEQ ID NO: 26915 - protein, 397 aa, Magnaporthe grisea 70-15
MATKAMQLEECFEHLNVNDENDHGDRLVQKSKISMSTAQISHGSSRPNLFKVALQSQSANTVTSVTLPSQAAQRKMAPPPKSREPPSPSKHKKDSVSSSVDELANEEVEASAPRVPKEFHLGMFEIGRPLGKGKFGRVYLARERTTGFICALKVLYKKELESGSVEKQVRREIEIQTNLCHPNILKMYGHFHDNKRIFLILEFAGKGELYKHLRKENRFPEWKAAQYVAQMASALKYLHRKHVIHRDIKPENILVGLHGELKISDFGWSVHAPNNRRKTLCGTLDYLPPEMIKSGNKDNTYDEKVDLWSLGVLTYEFVVGEAPFEDTPVMTQRRIARADMTIPSFVSPECRDLIKKLLVLDPVKRLSLDAVQKHPWIIKHCVKGERATNREKGRGSD

SEQ ID NO: 26916 - protein, 416 aa, Bacillus subtilis subsp. subtilis str. 168
MSGRRELCTPLRTIMTPGPVEVDPRVLRVMSTPVVGQFDPAFTGIMNETMEMLRELFQTKNRWAYPIDGTSRAGIEAVLASVIEPEDDVLIPIYGRFGYLLTEIAERYGANVHMLECEWGTVFDPEDIIREIKKVKPKIVAMVHGETSTGRIHPLKAIGEACRTEDALFIVDAVATIGGCEVKVDEWKIDAAIGGTQKCLSVPSGMAPITYNERVADVIAARKKVERGIATQADRAALSGNRPITSNYFDLSQLEDYWSERRLNHHTEATTMLYALREGVRLVLEEGLETRFERHRHHEAALAAGIKAMGLRLFGDDSCKMPVVTCVEIPGGIDGESVRDMLLAQFGIEIASSFGPLAGKIWRIGTMGYSCRKENVLFVLAGLEAVLLRHNAGIEAGKALQAALDVYENAGRQAAV

SEQ ID NO: 26917 - protein, 431 aa, Bacillus cereus ATCC 14579
MNKDITKDEHLPSESTTVQSAHLALSGETKGWKRLLPFLGPAFIASVAYIDPGNFATNIAAGSQYGYLLLWVILASNLMAVLIQTLSAKLGIATGNNLPEIARENFPKPVSIGLWIQGELVIMATDLAEFIGAALGLYLLFGIPMLPAALITAAGSFIILEFQRRGFRPLEAIITGMIFIVVIAFGIQVFYAKPELSPLLSGLFIPKFQGVDSILLAAGILGATVMPHAIYLHSALTQRRVVGTTDEQKKKIFRFEFIDIIIAMVIAGAINASMLIVAAALFFKNGLHVEDLDVAYTQFTNLVGPVSAALFGIGLLSAGLSSSSVGTMSGDIIMQGFIRMHIPLYLRRFITMIPPLVIIALGVNPTYALVMSQVVLSFGIAFALVPLIMFTSNKKIMGALVNHRITTFIAWIIAALVIVLNIFLLYQTFVG

SEQ ID NO: 26918 - protein, 506 aa, Vibrio vulnificus YJ016
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSNRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLATGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 26919 - protein, 225 aa, Arabidopsis thaliana
MDDWEAEDFQPLPSKVELKSNWDDEDVDENDIKDSWEEEDVSAPPPIVKPASEKAPKKPAVKAVEKKVKTVEAPKGTSREEPLDPIAEKLRMQRLVEEADYQSTAELFGVKTEEKSVDMLIPKSESDFLDYAELISQRLVPFEKSFHYIGLLKAVMRLSVANMKAADVKDVASSITAIANEKLKAEKEAAAGKKKSGKKKQLHVDKPDDDLVSGPYDAMDDDDFM

SEQ ID NO: 26920 - protein, 1066 aa, Ostreococcus tauri
MLRRADLLLLDEPTNHLDVGAVEWLANYLCSLEGTTIMCVSHDYEFLRKISTHIVQFDKQELHTFEGGFDGFRAARPNLVLPRMKKELVESIKDRATEMGEAIDDGSKDSDSRRRAASEANILENTAGSVVAIRAGAASTALAGGLSRRMTGSQARANGTSLGASIVFPEPGPLDGIKSKTQVVARVEDLGFAYGPNNLVLSGVYARLYLGSRVAVVGANGAGKTTLMKNIVGELEPTSGTIWKHHNLRIAYIAQHSMHHLQEHMNMSPKEYIQTRFYQGRDKEVAKMSTMALTDEEKSQQQSRGSVCEILGRAVKGGELCYEVRKVGDRPGVTHWEPKRFLKASYVTKMCKNYDEMMKAMQSGMDVRPLTSSEVYSHLMDFGISQELADGKIKRMSGGQKSRLVLAAAMWIKPHIIALDEPTNYLDNETLTALTSALKRFKGGVLTISHNASFVGDVCTDTWRVYQGKVTSSEDEARGVGASRKGGARRRRALREEDMSESTEATSEISANQDLKNVGRAITGILASRRTALDMRFEQVSMSVSGVELIKDCVLELNVGRRYGLLGANGCGKSMLLEAIARRELPVPKHVDIYHLREEAEPSERTALEAVVDHIREEVSRLQAVESDILSSKGPGDESLQGIYERLEELDPAKFEAKSAELLHNLGFDKTLMNRETKALSGGWRMRVSLARALLASPALLLLDEPTNHLDLSACVWLEDYLSKYKKCLVVISHSQDFLNGVCSHIIRITNKTLKYYTGDFDTFRRTLAEEEIIQQRQYDKEQAEIKHLKDFIASCGTYEDKMKTAKSKQKILDKMEAAGLTPSPRAEKTFEFTFPQCSKLAPPVLPFKNVSFQYPSADPSLGMLLQNLEFGVDCDSRVALVGPNGAGKSTILKLMTGDVEPSLGEVGRHHHLTIGRYHQHSVDVLDPRSTPLEFFAGTYYDMKKPNDEWRSYLGKFGVTGRYQTHPISQLSDGQKSRLVFAMLCLANPNLLLLDEPTNHLDHDCIDSLADAINKYQGGLVLVSHDFRLIDKVAREIWVCEDKSVKVWRDDIRAYKRHLARKALVA

SEQ ID NO: 26921 - protein, 227 aa, Ostreococcus tauri
MEARASQAVVDAMSNVTLGDVPRSIENFARRCATRDGEESIVSADGGRPSNGQRAILRAVSHLRLRSADDYAVCAFMLDCGQSIPLHNHPDMCVHMRVLFGRAHVRAFDFVHDNVHSELSTKEATAGNGRRHQARLVFDETVFESGRGGAFTLEPHRCNVHEIRAVTPCAILEVQTPPYAVDGGRDCHYFEEVEQASATEFLLREIGCPDTFECVRFNRHGEFDAYT

SEQ ID NO: 26922 - protein, 272 aa, Vibrio vulnificus YJ016
MAIHMKTELDIYQVDAFAREAFKGNPAGVCITEKPLDERLMQLIAAEMAVSETAFLSLETMNLRWFTPKAEVTLCGHGTLATAHIMQQQGLLKAGEEIAFDTLSGELKVKLAANKIEMDFPQSPIDFSVNIDANKLAHLGIKPEEVLCSGQFQQKDFIEITSEEALLALSPNFDALATLTGRGVVVTARSDSPIYDFISRYFAPWVGVNEDPVTGSTHCALAGYWGSKLEKDYLAGYQASARGGRIEMALLPYQRVKLIGTAVTTLKGQLLI

SEQ ID NO: 26923 - protein, 476 aa, Methanococcoides burtonii DSM 6242
MTNKLSSILEKRGPIKKIGVLGMGYVGIPAAALFADSEKFDLVLGFQRDSPSSGYKIEMLNKGDSPLKGEEPGLEDLLRKVVDANKFECTPDFSRISEVDAVALAIQTPFLDPASLQPDFSALIEGIRNVGKYLKEGMLVVLESTITPGTTDTLARQILEEESGLKAGEDFALAHAPERVMVGRLLKNIQEHDRIVGGIDDNSTKRAVELYSPVLTKGQIIPMTATAAEVTKTAENTFRDLQIAAINQLALYCEAMGINVYDVRAGIDSLKGEGITRAVLYPGAGVGGHCLTKDTYHLERGVTTSNGDLDYPENTDSLFVLARKVNDFMPDHMYYLTREALKRIGKDVRGSKVAILGWAFINDSDDARNPPSEPYRNLLIENGAEVMVHDPHVLNYPEVEIMKNIDEVIENADVVAVLTGHSDYFKLDPAYLRSLTEKKNTVIVDGRNVLDPDAFIGNGFVYKGIGRGDKNKHPII

SEQ ID NO: 26924 - protein, 200 aa, Mesembryanthemum crystallinum
MAEQGLEGSQPVDPIKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLTEFRKNQQ

SEQ ID NO: 26925 - protein, 257 aa, Gluconobacter oxydans
MYMEKLRLDGRTAVVTGGAQNIGLACVTALAEAGARVVIADLDEAMAAQSAEELCAEGLDVRSIRMDVTSMENVQAAIKTLHEQEGHLDILVACAGICISEVKAEDMTEGQWLKQVDINLNGMFRCCQAVGRIMLEQKKGAIVAIGSMSGQIVNRPQQQAAYNASKAGVHQYIRSLAAEWAPHGIRANAVAPTYIETTLTRFGMEKPELYDAWIAGTPMGRVGQPDEVASVVHFLASDAASLMTGSIVNVDAGFTVW

SEQ ID NO: 26926 - protein, 318 aa, Robiginitalea biformata HTCC2501
MKTYTDQGKQDTRSGFGAGMTELGRTNPRVVALCADLVGSLKIETFIEENPERFFQTGIAEANMMGISAGLTIGGYIPFASTFANFATGRVYDQIRQSIAYSGKNVKICASHAGITLGEDGATHQILEDIGLMKMLPGMVVINPCDFNQTKAATLAIAEYEGPVYLRFGRPKVANFTPVDQEFHIGKAVHLQEGSDVTIIATGHLVWESLEAAQRLHEQGISADVINIHTIKPLDEEAILASVAKTGCVVTAEEHNYLGGLGESVAGLLARRHPTPQEFVAVQDTFGESGTPDDLMAKYGIDNKAVEKAVLRVLERKA

SEQ ID NO: 26927 - protein, 360 aa, Coccidioides immitis RS
MGGCLSSSPGHSPDEIVDQKKRSQMIDKKLEEDSKRLRRECKILLLGSGESGKSTIVKQMKIIHQNGYTVEELSMCRLTVYKNLLECAKSLVTAMYDFNIMPTSSKVREFMEYLDEYNIDPDPNTPLDPKVGEAVTYLWNDPAVPTVLDRQNEFYLMDSAPYFFDEVKRITSPDYIPNEADVLRARTKTTGIYETRFTMGQLSIHMFDVGGQRSERKKWIHCFENVTSIIFCVALSEYDQVLLEESNQNRMMESLVLFDSVVNSRWFMRTSIVLFLNKVDLFRQKLARSPLSRYFPDYSGGNDINRAAKYLLWRFNQVNRAHLNLYPHLTQATDTSNIRLVFAAVKETILQNALKDSGIL

SEQ ID NO: 26928 - protein, 224 aa, Triticum aestivum
NAHQELIKTAKYIATPGKGILAADESTGTIGKRLASINVENVEANRQALREMLFTAPGALEYLSGVILFEETLYQTAADGTPFVDILKAGNVVPGIKVDKGTVDIAGTVGETTTQGLDSLGARCAKYYEAGARFPKGRAVVKIRARRRTRPKLRREATTPQGAGPGRGSSARKNGLGPHPGSPEIPPRTGPQRPTRAGPARHGTAELARAPNGCPNRTIQVVPP

SEQ ID NO: 26929 - protein, 381 aa, Triticum aestivum
MAPRGGHAAASSGSEDEEEEAEAGFSRSYFLAKEKEPSSAKKRARAAAAVGKLSNLNLVDEQVLRASLAEIPPKHEKEVEALTRSYKDQYRNWLFELRCGFGLLMYGFGSKKLLLEDFASTTLTDFTVIVVNGYLPSINLKQVLATIAEMFWEQKKLKRKRHSGTRSQQSQNFASQSMDDIISFLNNQTSEDGVDGVCLLIHNIDGPALRDAESQQCLAQVSCCPQIHIVASVDHVNAPLLWDKKMVHTQFKWSWYHVPTFAPYKVECVFYPLILASGGHAQTTKTALVVLQSLTPNAQSVFRVLAEYQLANEKEEGMPVSSLYTKCRERFLVSSQVTLNSHLTEFKDHDLIKIKKHSDGQDCLHIPLVPDALGKLLQELA

SEQ ID NO: 26930 - protein, 159 aa, Staphylococcus aureus subsp. aureus Mu50
MKITILAVGKLKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 26931 - protein, 241 aa, Triticum aestivum
MAQRWRSKARRDPDLDDAGSPSPARPRAPPSDDEDEEGNEDLTLEIVARARRREAAGGQPGFAEVLSLSSDEEVDEDAVVELGEADPSRRKDKKKKKQRRKERRKKQRKEDDAAAVKEEPQVAGTQEGNTGTVESVPTEDGVDAPVSDNTVLRKLLRIPRYFDPGETILETCFNCGEEGHVAVNCPMEKRKKPCFVCGLFGHNAKQCTQGQECFICKKEVIWRKIAPDSPQRITQQTTHCV

SEQ ID NO: 26932 - protein, 216 aa, Lactococcus lactis subsp. lactis Il1403
MKNKIAPSILSADFGNFARDVKRLESAGADLVHIDVMDGHFVDNLTFGAGVVSALRVQTHLFFDVHMMVENPEKYVEDFAKAGADSMSIHVEATHHIHGALQKIKNAGMKASVVINPGTPVEAIKTVLPLVDMVLVMTVNPGFGGQKFIPEMMDKVRELAQIRTDKKLDFEIEVDGGIDDQTIKVAKAAGANVFVAGSFIFNGEVEKNIEKLRVNL

SEQ ID NO: 26933 - protein, 400 aa, Aspergillus nidulans FGSC A4
MADEQKPVTAQATNAEAEKDVQNVLAELKGEAEVPVNGTEKEEAKEASADKSEEAEEARIVAAAAKLGEKSEKSENGNQAEDRGRANRRRNESKFDPSTQKETDDPVEIRKQVEFYFSDSNLPMDKFLLSKVGGSKNNPVPLELLHSFKRMRRFQPFSAIVEALKNSETLELTDNDTAVRRKVPLPETVKDTHDPTVVKVFEDKAMARSIYAKGFGEETPTTQLDIEAFFAPYGPINAIRLRRTNEKYFKGSVFVEFASEEKQKAFLELDPMPKWKDQELIIKSKKDYCDEKVREIEAGRVKPSGGRGRGGARGRGGRGGRGGRGGRRDNNRDWRERRDADQKQGFKNGQDEQPERREVQKDARYSGVPVVQSTADAGQKRTREDEASAEHPAKKVDTKE

SEQ ID NO: 26934 - protein, 98 aa, Zea mays
IGTSLYDEYGANIVKDLMAKAEKNGVKITLPVDFVTADKFDENAETGQATVASGIPAGWMGLDCGTESSKKYAEAVSRAKQIVWNGPVVVFEWEAFAR

SEQ ID NO: 26935 - protein, 133 aa, Brassica napus
  misc_feature (130)..(130): Xaa can be any naturally occurring amino acid
MSSDSSSWARALVQISPYTFSAIGIAVSIGVSVLGAAWGIFITGSSLIGAAIKAPRITSKNLISVIFCEAVAIYGVIVAIILQTKLESVPTSQMYDPESLRAGYAIFASGLIVGFANLVCGVCVGIIGSXCAL

SEQ ID NO: 26936 - protein, 134 aa, Crocosphaera watsonii WH 8501
MFFKSALSRILALVLVAVVTLTGCGNSSSGLSGNYSEDTLAVIETLTTALDLPNDAENKQEIKSLAKEQINDYISRYRRNGESGGLRSFTTMQTALNSLAGYYTSYGNRPLPEKLKKRLKQEFKQAEVAIKRGI

SEQ ID NO: 26937 - protein, 1075 aa, Mycobacterium avium subsp. paratuberculosis K-10
MTASLLVANRGEIALRIIRTATELGMRTVAVYAADDAHSPHVHAADEAMPLPGSGPPAYLNQAALLAVAENTGATLIHPGYGFLSENAEFAKACAAASHTFVGPDGRVLELLGNKTAARRAAIAAGVPTLAATDGPSGVEDIEAFFAAHPGGIMIKALAGGGGRGMRKVHNAAQIAGAYQRCAAEARLGFGDPALFAEALLGDARHIEVQVVAAPAGHQTHALAVGDRDCSMQRRYQKLIEIAPAQGLSEELRRALHQAAVRLCARVGLRGLATVEFLVSGERFVFLEVNPRIQVEHTVTEQTTGLDLVAVQLAIAGGESYYRLGLPAGIASDGTEVIGEPAAQRGIAIQLRVNAETFGADFSVLPSAGTLTAFCPPSGPGVRVDTYGRPGLVVSPQYDSLLAKVIVAVHGSSWRAAMRKADTALSEFGVEGVATNIGFLRRLLAEQRLETGWVNTDFVDEKLPELAAAALTHQPGPQPGAVELYPGEDALRAQLAGTVVEVAPEGADYPAGAQLVVLEAMKMQHVLAAPDALRTVRVLVTPGQVVGTGDPLLVFTRTTGGDDGESETAATDLDLTRADLDEVIERHARTLDEGRPDAVAKRHRQGRRTARENIDDLVDPGSFVEYGALAIAAQRSRRSEEDLIANTPADGLVAGLATVGADRFGPAAAQAVVASYDYTVLAGTQGMRNHAKTDRVFDLAARKRLPVVLFAEGGGGRPGDTDVGGAAGLDVPTFRMLAGLRGRVPLVSVVSGRCFAGNAALAGVCDVIIATPDANIGMGGPAMIEGGGLGVYPPEAIGPIAVQRRNGVVGLVARDEAHAVSLAKQYLSYFQGRLDRWQAPDPRVARHVVPQNRLRAYDVHRAIEAIVDVGSVLELRPDYGVGIVTALVRVEGVPYGLIANSTHHLGGAIDAEAADKAGDFLALCESFGLPVISLCDTPGFMVGPDAETQAAVRRFGRMFVLGARLTVPLGMIILRKGYGLGAMAMAGGSFRAPQFTVAWPTGEIGGMGLESAVRLGYRKELAAVTDPAERQNLFDRLVAAAYQHGKALRAATTFELDDVIDPAASRAWITRLSGG

SEQ ID NO: 26938 - protein, 298 aa, Brassica napus
MDSPFKPDVLKGKVALITGGGSGIGFEISSQFGKHGASIAIMGRRKQVLDAAVSDLRSLGIPAVGFEGDVRKPEDARRVVESTFNHFGKVDILVNAAAGNFLAAAEDLSTNGFRTVLDIDAVGTFNMCREALKYLKKGGPGRDSSSGGGSILNISATLHYTASWYQIHVSAAKAAVDATTRNLALEWGTDYEIRVNGIAPGPIGGTPGMSKLVPDEIQNKTRELMPLYKLGEKWDIAMAALYLSGDTGKYVNGLTMVVDGGLWLSKPRHLAKEAVKELSRVVEKRSRAKPVGLPTSKL

SEQ ID NO: 26939 - protein, 207 aa, Clostridium perfringens SM101
MKIYFTRHGETLWNLEHRFQGWKDSELTENGVKRAELLGKKFNDIKIDKIFTSPIKRAKRTAYLIKGDKDIEVEEVEGLKEISFGKWEGMTTEEIKSHDEYVNELDNLFNKPFSYKSFEGENIKDFTERLFKTVDDIIKNNKDKDILIVTHGMCVRYLIGYFKNEFEESKIIDYPIFHQASYNEVEWNGENFEVITLNNIDHYEYDK

SEQ ID NO: 26940 - protein, 392 aa, Thermotoga sp. RQ2
MSKKALLALEDGSFFFGQSLGAEGETFGELVFNTGMTGYQEVLTDPSYTGQIVVMTYPEIGIYGVNDEDVESDGIKVAGFVVYRSVDTPSNWRATMSFPDYLKKYNIVAIEGVDTRALTRKIRVKGAMKGAISTVDLDPDSLVKRVKESPSIVGRDLAGLVSPKEVIVENPEGDFSVVVLDSGVKWGILRDLKRVGAKVMRVPYSVDIDDIKKLNPDGVLISNGPGDPAALLKTVRLIKDLLKEEIPLAGICLGHQLLGLAVGGRTYKMKFGHRGINHPVKDLRTGRVLITTHNHGFAVDPKSFGLPELGSEDQDANVLTKNLQKISALEGISPQGIKVEITHISLNDGTMEGMRLVDYPAFSVQYHPEASPGPHDAKYFFEEFKRLIKEVR

SEQ ID NO: 26941 - protein, 125 aa, Zea mays
MAPLGSKLAQLQSKACEATRIVAKHGCSYHKTLMEKNKHYVVDPPTIDKCKDLSKQLFYTRLASLPGRYESFWKEVDGAKLLWKNRSSLKGEDAGVAAMFGIELYAWFCLGEIVGRGFTVTGYHV

SEQ ID NO: 26942 - protein, 304 aa, Methanococcoides burtonii DSM 6242
MYNLYCTYMTGKRENVLIEALPYIREFHDSVMVIKVGGHAMVDPQVMSDIVQDIVLLRFVGIHPVIVHGGGPEITEKMDRMGKKSEFIGGLRITDDETMEIARMVLVGNINTRIVSLISKHGGKGVGLSGKDGNMILAKKKPTQKILIEDIEHDVDLGWVGDTEIINPEIINIVTANGYIPVISPIAMDSEGNALNINADTVAGDLADALNAKKLILMTDVPGVLRDQTDISTRISRIGVDEVEQLIEDGVLSGGMIPKMRSAKASVEGGVDRVHVIDGSISHSVLLELFTDQGIGTMVYKDTK

SEQ ID NO: 26943 - protein, 308 aa, Tropheryma whipplei str. Twist
MAKRCSRGQFPSERPYSSIMTPKNAYGHLVPGDISAARWVDPKIARPNYVGKKRVPRYTGSDIYNKDEIERVRAAGSIASQTLDYLAEHIRAGITTDELDRLAHEFITSKGAYPSPLGYQGFPKSICTSINEVICHGIPDNTVLEDCDIVNVDVTAFFEGMHGDTNRTFIIGNAPEATKNLVKNTEEALHVAIKAVAPGRRVNVIGLTIERLAKRFNYGVVREFTGHGVGRAFHTGLVIPHYDATPYYDRILKPGMIFTIEPMLNLGTRHWNMWEDGWTAVTKDLLPSAQFEHTIVVTQNGAEILTLS

SEQ ID NO: 26944 - protein, 304 aa, Methanococcoides burtonii DSM 6242
MVKVEKFIPNAIDRIKEQAKGKTIIALSGGVDSSVCAVLAYQAIKDDLIPIYIDTGLMRKGETERIKEIFADMNLQTIDAKDRFLDALVGIKDPEEKRKVVGETFIRVFEEEAREINAQYLIQGTIYPDRIESDGGIKSHHNVGGLPEHIDFKGIIEPIDDLYKDEVREVAWALDLPEEICERMPFPGPGLSVRIIGEVTEEKVDVVREANAIVEEELLEQFKPWQTFAAVIGKGTGVKGDVRVHGWIIAVRAVGSRDGMTAEALELPWETLMKIESRISGEIASVARVLYDLSPKPPATIEFE

SEQ ID NO: 26945 - protein, 525 aa, Salmonella enterica subsp. enterica serovar Typhi str. CT18
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEGSNEREFGYAQVEVLTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 26946 - protein, 303 aa, Bacillus cereus ATCC 14579
MKRWQMEWLLVSVALVWGANYTIGKYGVAYMSSIQFNSLRFLVASPVLLLITFLMERSLRIDRKDWLRLVAVGIVGTTMYQTMFMLSVKYTSATNASLLIAMSPIFTGILAVLHKQERFSMKVQIGSIVAFIGAAFVLLTGHTGGTTYEYAWLGNIIGLVAAIAWGWYPILAQPLITKYSAMRVTSWSTLIGIVPLVVYCLFNVNTLTWPVDMPSWGSLAYSIVFATIFGLAMWYVGISKIGSTKVMVYMYLVPLFAVIFAAVTIGEQINMMQLVGGLIIFIGLYVVKKGGIQKPALNLKKVS

SEQ ID NO: 26947 - protein, 364 aa, Coccidioides immitis RS
MAEFVRAQIFGTTFEITTRYTDLQPVGMGAFGLVCSARDQLTNQAVAVKKIMKPFSTPVLAKRTYRELKLLKHLRHENVISLSDIFISPLEDIYFVTELLGTDLHRLLTSRPLEKQFIQYFLYQILRGLKYVHSAGVVHRDLKPSNILINENCDLKICDFGLARVQDPQMTGYVSTRYYRAPEIMLTWQKYDVEVDVWSAGCIFAEMLSGRPLFPGKDHVNQFSIITELLGSPPDDVIKTICSANTLQFVQSLPKRERQPLSEKFKGAEPLAVDLLERMLVFDPKKRITAAEGLAHEYLAPYHDPTDEPVAETQFDWSFNDAELPIDSWKVMMYSEILDYHNVDQDSQGIHGTPLNTEAQRVPM

SEQ ID NO: 26948 - protein, 290 aa, Saccharomyces cerevisiae
MLRRQARERREYLYRKAQELQDSQLQQKRQIIKQALAQGKPLPKELAEDESLQKDFRYDQSLKESEEADDLQVDDEYAATSGIMDPRIIVTTSRDPSTRLSQFAKEIKLLFPNAVRLNRGNYVMPNLVDACKKSGTTDLVVLHEHRGVPTSLTISHFPHGPTAQFSLHNVVMRHDIINAGNQSEVNPHLIFDNFTTALGKRVVCILKHLFNAGPKKDSERVITFANRGDFISVRQHVYVRTREGVEIAEVGPRFEMRLFELRLGTLENKDADVEWQLRRFIRTANKKDYL

SEQ ID NO: 26949 - protein, 151 aa, Ipomoea nil
MSTVRLPSTCMFRSAPVTQPKSAFVKSPSSITSVKRVSKSFGLKADRYRVTASAVYKGKLVCTKMAEYEFDVPADTYILDSAEAAGVELPYSCRAGACSTCARGKTVTGSVDQSDGSFLDDNQMKRDMSVTCCLYPTSDCVIHTHKESDLY

SEQ ID NO: 26950 - protein, 469 aa, Prosthecochloris vibrioformis
MQQSESSSAQFDVAVIGSGPGGYEAALHAARHGMKVCLVEKRSLGGVCVNWGCIPTKALLRSAEVYDLAKNPSEFGVNVSELSFDLAQAVKRSRKVSLKSSKGVEFMLKKAKVEVWRGEAVLTGSKGVKVTAEDGSERSLEAANIIVATGAQPRVIPGLEPDGKKIITSREALILKDVPESMIVVGGGAIGVEMAWFYAKAGAKVTIVELMPRLLPAEEAEVSEALKRSFEKVDITVQCGAKLGNVAISEFGVNADLLAEGKEPQKIEASCMLVAVGVTGVIDGLGLDAAGIETERGFIRTDELCRTSASGIYAIGDVRGGMLLAHKASAEAAIAVEAIAGKLPEPLSEPLIPRCVYAQPSVASVGLTEEAAIAAGYKVLVGRSQFAASGKANAYGQLEGFVKLVFNAETGKMLGGHLIGHDAVELIGELGLACRYGVTAEGLVGTVHAHPTLSETVREAAFSALPNKG

SEQ ID NO: 26951 - protein, 619 aa, Candida albicans SC5314
MRSLSIFSLVFLFFSTLITAKTHTWYYKTGWVNANPDGGFERPMIGFNDSWPLPTLRVKKGDTVNLYLINGFDDRNTSLHFHGLFQHGTNQMDGPEMVTQCPIPPGETFLYNFTVDDQVGSYWYHSHTSGQYGDGMRGVFIIEDDDFPYDYDEEVILTLGEHYHDFSDDLHKNFMSRYNPTGAEPIPSNILFNETRNNTWKVEPGKTYFVRIINIGRFVSQYVWMEDHEFTIVEVDGIYVEKNTTDLIYITVAQRYGVLITTKNSTDKNYAFMNRVDIDMLDVIPDELELNGTNYIEYNSKADKPEPYLLDSIDDYFDDFYLKPLSKEKLLDDADYTITVDVQMDNLGNGVNYAFFNNITYTTPRVPTLLSVLSAGDDASNELVYGTNTNSFVLQSGDVVDIVLNNLDTGKHPFHLHGHVFQLIERHEEIPETEDPVGYNASDHADWPEYPMLRDTVYVRPQSYIVMRFKADNPGVWLFHCHIEWHLDQGLAIQLIEDPQGIQKNTSQHITDNHKQICEKVGVSWEGNAAANSKDYLNLKGENVQHKRLPTGFTARGIVALVFSCIAGVLGLATIAYYGMNDIADVEERVARDLDVDFDEEDNEIVNEGSSSSGSNSKH

SEQ ID NO: 26952 - protein, 277 aa, Rhizobium etli
EFASFYRSMGVDVTVVEVMPTIMPVEDAEITAIARKQLEKRGLKIFTSAKVTKVEKGAGSITAHVETSDGKVQQITADRMISAVGVQGNIENLGLEALGVLTDRRWLVADGYGKTNVAGIYAIGDVAGPPIVAHKAEHEGVVCVEKIAGVPNVHPTDKGKVPGCTYCNPQVASVGLTEAKAKELGSDIRVGRFSFAANRKAIALGEDQGMVKVIFDKKTGELLGAHMVGAEVTELIQGFVVAMNLETTEEELMHTIFPHPTVSETMKEAVLDAYGRV

SEQ ID NO: 26953 - protein, 701 aa, Coccidioides immitis RS
MIEPFTAHLLGEEIYIPLGNYLTRHLNSVYETSLSHSEEALLAFYIREWSRYTTAAKYINHLFLYLNRHWVKREVDEGKKGIFDVYTLHLVKWREDFFKKVHESVMTAVLNLVEKQRNGETIEQSQIKNIVDSFVSLGLDDNDTSKTTLVVYQYYFERPFIEATRAYYESESRRFVAENSVVEYMKKAESRLEEERGRVDLYLHPDITKNLMDTCLSVLVSAHSSLLRDEFQSLLDAERQDDLARMYRLLSRIKDGLDPLRNKFETHVRKAGLAAVDKIAASSDNVEPKVYIDALLQVHSKYKNMVDVAFAGESEFVRSLDNACREFVNRNALCHTSSTKSPELLARYTDSLLKKGLKTPEESEYEELLAQIMTVFKYIEDKDVFQKFYSRMLAKRLVHVSSVSDDAETSMISKLKEACGFEYTNKLQRMFQDIQISKDLNASYKDWAASTFDEEDRKKMVDPHFQILGTGFWPLNPPTTQFIPPAEILKTTERFKSFYCDKHSGRKLTWLWQLCKGEIKANYIKNTKVPYTFQVSTYQMGILLLYNEHDTLDYGEIEKATSLSPEILDPNLGILVKAKVLLPSPEDGKPRAGTSYSLNYNFKAKKIKVNLNIQVKSEQKTESEDTHKTVEEDRKLLLQSAIVRIMKSRKKMKHVQLVQEVIQQVKARFPPKVPDIKKNIEALMEKEYIERLDGDELAYIA

SEQ ID NO: 26954 - protein, 454 aa, Rhodobacter capsulatus
MAEFDVIIIGGGPGGYVCAIRCAQLGLKTACVEGRGALGGTCLNVGCIPSKALLHATHELHEVHENFEKMGLMGAKVKVDWAKIDGNTKGIEFLFKKNKVTYLRGWGSIPAPGQVKVGDEVHTAKNIVIATGSESSGLPGIEIDEQTVVTSTGALSLAKVPKSMVVIGAGVIGLELGSVYARLGAEVTVVEYLDAITPGMDAEVAKGLQRILTRQGLKFVLGAAVQGVDKAKGKNTVRYTLRKDESAHAIEAEVVLVATGRKPFTKGLGLEALGVEMLPRGQVKADSHWATNVPGLYAIGDAIVGPMLAHKAEDEGMAVAEVIAGKHGHVNYDVIPGVIYTTPEVAAVGKTEDALKQEGRAYKVGKFSFMGNGRAKAVFQAEGFVKILADAATDRILGAHIIGPSAGDMIHEICVAMEFGASAQDLALTCHAHPTYSEAVREAALACGDGAIHA

SEQ ID NO: 26955 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 26956 - protein, 310 aa, Erwinia chrysanthemi str. 3937
MTTKNIAIIGECMIELSRKARISIRGFGGDTLNTAVYISRQVKPDALDVHYVTALGTDSFSSEMMASWQKEGVKTDLIQRLDNKLPGLYFIETDATGERTFYYWRNDAAARYWLESPDADTISQQLAQFDYIYLSGISLAILNQASRARLLTVLRACRANGGKVIFDNNYRPRLWQSKEETRQAYSDMLACTDIAFLTLDDEDMLWGELPVDEVLKRTHGAGVMEVVIKRGADACLVSIQGEALLEVPAIKLPKEKVVDTTAAGDSFSAGYLSVRLNGGSAQDAAKRGHLTASTVIQYRGAIIPLEAMPA

SEQ ID NO: 26957 - protein, 307 aa, Thermoplasma acidophilum DSM 1728
MNMSKRDILSVLDMEKDLSEIIDLSIELKKNRYRSYESLRNKVLGLIFEKPSTRTRTSLEVAIDQLGGHAVYLNPSEMQLGRGETISDTGHVLSRFLDAIAYRAYDHRNVVELARSTSIPVINALDDVEHPLQIVADFMTIKEKKGRFTNLKFSYIGDGNNMANSLMLGAAILGTDMYVASPKGFEPKQEFVEKARSIAKQHGSSITITNDPVEAARDADVIYTDVWISMGEESKKGEKEKAFKDFQINEKLVSNAKRDYIFMHCLPAHRGLEVTDGVADSINSVIFDEAENRLHSEKGVLYKLLSY

SEQ ID NO: 26958 - protein, 318 aa, Vitis vinifera
MNDLATNHDGIRTVRADNRCDFSGSSDLCICVVTWNMNGQVSYKDIEQLVGSDREFDLLVVGLQEAPRNNISQLLQAALVETHILLGKAIMQSLQLYVFGQKMNSELFINELKVDKHAVGGFGGLIRRKKGAVAVNIIYKGIRMLFICCHLSAHAGNVEDRNSQYRHISRSLFSKNQNPYARPVQVTVWLGDLNYRVQGIDTHPARNLVQKNLHRLLTRKDQLLQEAERGQIFSGYCEGTLAFKPTYKYNIGSSNYDTSYKVRVPSWTDRILFKIEDSGKISATLHSYQSIDGIHSSDHKPVKAHLCLQASKQSPLMP

SEQ ID NO: 26959 - protein, 422 aa, Synechococcus sp. WH 5701
MSWHPHLWHPTTQVARADPPLRAVAGRGAVLELDDGRELIDAISSWWVTLHGHGEPSIAAAVAEQALRLEQVIFANFRHPPAERLAERLSAASGLERLFFSDDGSTAVEVALKMAWQWWRNQGSERRQLIAFEGAYHGDTFGAMALGERSLFSAPFEPLLSPVARAPWPATWWDDPDVEVKEAEALAALERLLELPTAAVILEPLVQGASGMAMVRERFLRELEQRVRQAGALLIADEVMTGFGRTGALFACGRAGIRPDLMALSKGLTGGFLPMGVTLASERIYRGFISDDPSHTLYHGHSFTANPLGCAAANASLDLLLHQPALHEGFEARHRPHLQALSGHPLVQRPRLCGTIAAFDLAVERPGYLHPAGRQLQRHALEAGVFLRPLGHVVYLLPPLCLSDRQLQHCYTVIRSGLDQLS

SEQ ID NO: 26960 - protein, 474 aa, Kineococcus radiotolerans SRS30216
MSNALGATTSAGPTVFVVYGATGDLAKRLVMPGFAALAAADLLPEKWILIGSGRRAQPVDAYREHVRAGLQEFGKVGDEVVDSILPGLRFAGGGFTADDPGELLDAVRDARAEIGEDAQLVHYLALPPSTFQDYTRAIAAHGLAEGSRVVYEKPYGTSPESFEELDQLVQSVFDEQQVFRIDHFLGKEATQQLHVLRFANRMIEQLWSNEHVAQVQIDVPEVLGVDDRATFYDETGATLDMLVTHLLQVAAEVALDPPADWTSDALAQAREDVLAKFRPLDPAEVVLGQGSGYQEIEDVREGSTTDTFVAAKVWVDTERWRGVPFVLRTGKKLAESHQHVTLVFKRPSNSPQKDADAAPETLTFTLSGNGSVFAGVTARRPGVSDDLVPGKLYLDLAELPNAEPLPPYAALLRDVLIGDRALFTTSDGLRDAWRVACPLLAHRPELLPYEPGTWGPDAAEEIAAPYGWLTEQHR

SEQ ID NO: 26961 - protein, 406 aa, Bacillus subtilis subsp. subtilis str. 168
MNITDIREQFPILHQQVNGHDLVYLDSAATSQKPRAVIETLDKYYNQYNSNVHRGVHTLGTRATDGYEGAREKVRKFINAKSMAEIIFTKGTTTSLNMVALSYARANLKPGDEVVITYMEHHANIIPWQQAVKATGATLKYIPLQEDGTISLEDVRETVTSNTKIVAVSHVSNVLGTVNPIKEMAKIAHDNGAVIVVDGAQSTPHMKIDVQDLDCDFFALSSHKMCGPTGVGVLYGKKALLENMEPAEFGGEMIDFVGLYESTWKELPWKFEAGTPIIAGAIGLGAAIDFLEEIGLDEISRHEHKLAAYALERFRQLDGVTVYGPEERAGLVTFNLDDVHPHDVATVLDAEGIAVRAGHHCAQPLMKWLDVTATARASFYLYNTEEEIDKLVEALQKTKEYFTNVF

SEQ ID NO: 26962 - protein, 561 aa, Ralstonia metallidurans CH34
MTHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVAAGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 26963 - protein, 344 aa, Zea mays
MYLYIPTSPPFPSRCRPTPTFLETPPGAIFRPLPACSPTPGGRTVFWSPLLFSGECAGSLTSDERSAMLLMLHETLPFVRPTSSCRDPKLSEKSASAFHGKLGCSAVCSSAEGHRVQKPHIVHSYKVSFTRTSQHLCKSLNERTTRHCLHRFHVNASPDDDDFRSSRNIAISLFKRYKNVIDRGGGENLNEFVSAGVTAYALGCTDEGLRKELMDIEDSGLEIEGLGSLGGTSLKFKVHSFEIRECILWLSIVFVTILCTPQLTVIRWSPNPPVSADVLHQWKGFCALIANAYYVKGMAWLPVKTLQLEQMAVTGSSEKPSVVASRMQLVFSTLEVVSPQWPRV

SEQ ID NO: 26964 - protein, 440 aa, Mycobacterium avium subsp. paratuberculosis K-10
MRAGKVVEAQPHPHAALRRSTLPGGLRVVTEYLPAVRSASVGVWVGVGSRDEGATVAGAAHFLEHLLFKSTPTRTAVDIAQAMDAVGGELNAFTAKEHTCYYAHVLDADLELAVDLVADVVLNGRCAAEDVELERDVVLEEIAMRDDDPEDALGDMFLGALFGDHPVGRPVIGTARSVASMTRTQLHSFHVRRYTPERMVVAVAGNVDHDEVVAMVREHFGPHLVRGRQPIAPRKGAGRVNGRPGLLLGTRDAEQTHVSLGVRTPGRGWQHRWALSVLHTALGGGLSSRLFQEIRELRGLAYSVYSTVDIFADSGALSVYAACQPERFAEVMAVTSGVLESVARDGITESECRIAKGSLRGGLVLGLEDSGSRMSRLGRNELNYGRHRSIEHTLAQIDRVSVDEVNAIARRLLTQHYGAAVLGPYGTKRSLPQQLRAMVR

SEQ ID NO: 26965 - protein, 418 aa, Ostreococcus tauri
MSHERSASGDKMIEAGEKLERAYSPSLRSGEHAEVGCRDSMEDAVVLDDNVRVKGAEDVVAFYGVFDGHGGRAMAEFLRDNLMKNVVENDHFISNPELALKEAFYRTDEDFYATAGPSDTSGSTGLAACVIGGKLYIANAGDCRAVLSRKGKAIDLSIDQKPSSQSEMERIKSAGGFVEDGYVNGLLGVSRAFGDWHIEGLKGRGGKPGPLTVDPEIEKTRLTEEDEFLILACDGLWDVFSSQNAVDMARASLRQHNDPTSTARELASEALRRHSSDNVSVVIVCLTPEPPKKETFIRTSPSLLRSLSIDAISQVSRAMAEDANAPPVPQAFAPKRVHSLRDLSHVRSCSGDSDDSLAAEIASQPSAEQVSQVLESIAAINVQNNVQTGALGLERMNSSSVGLEPMSELDTLDEEEAT

SEQ ID NO: 26966 - protein, 433 aa, Methanococcoides burtonii DSM 6242
MNDVSSEKSIGYLSAVSIGIGGMVGGGIFAVLGLAVEIGKGGTPIAFGLAGIVALITSYSYAKLSVRYPSEGGTVEFLNQAFGSGLVTGGLNILLWLSYVVMLSLYAYAFGSYGSTFFPDSMQAVLRHVLTSIIIVSLTVVNIVGAKVVGKLETWIVGFKVAILLIFIGVGIWSVKSQPFQPTISSNPLQLVAGGMIIFLAYEGFELIANTAKDVKNPGKTLPCAYYSAVVFVIVLYVLIAFITVETVSIDSIIQAKDYALAVAAKPFLGNFGFNLIAVAALLSTASAINATLYGASRVSFTIAKDGELPEILEEKIWNRPIEGLLITSALTLIVANTFNLASISIMGSAGFLLIFGAVNASNACLYQKTASYRWISITGIIVCSIALFTLIWYTLNNSPKDIFILAFMLCSAFAIEAIYRRFTGRYIKKIHE

SEQ ID NO: 26967 - protein, 267 aa, Triticum aestivum
  misc_feature (176)..(176): Xaa can be any naturally occurring amino acid
  misc_feature (198)..(198): Xaa can be any naturally occurring amino acid
  misc_feature (215)..(215): Xaa can be any naturally occurring amino acid
NKFVQKSRLVPVRNSRDIVDPRVRKETFGDLLHLSESEAMPVFPSPEDLRGKIIISTKPPKEYLETKSSKEEAQNGSAEESVWGDEIPDNKAQVATARQVSEKDNYRYVEEDEEMEKKVQLGVNGEYKSLISISLTRRKHDMDQDLKVDPEKVSRMSLGEAAYEKATITHGSEILXVTRRTLLGFPKNDRITSSNFQXPLMGWRNGAQMHAQTCXGPRKELWVTQSTLTETVVLCFCIKSDFSLNTTFTFYLLFYSPVHPPIPALTS

SEQ ID NO: 26968 - protein, 465 aa, Silicibacter pomeroyi DSS-3
MDGTFNENDLSRVVEADRAHIWHHLIQHKPFETNDPRIIVEGKGMRVWDQNGKEHLDAVSGGVWTVNVGYGRESICKAVYDQLMKLCYFANSAGSIPGALYAEKLISKMPGMSRVYYTNSGSEANEKAFKMVRQIAHKKYGGKKTKILYRDRDYHGSTLAAMSAGGQDERNAQYGPFAPDFVKVPHCMEYRKEELGLGHLSGAEFGRAAADLIEEVILREGPETVGALCLEPVTAGGGVITPPEGYWERVQEICKQYDVLLHIDEVVCGIGRTGTWFGYQQYGIKPDFVTMAKGVASGYAAIACMVTTEEVFDLFKDNTDDPLNYFRDISTFGGCTAGPAAALENMRIIEDEDLLGNCTAMGERMLGNLHALMEKHAVIGDVRGKGLFLGAELVANRETKEPVSEKQAQAVVADCMAQGVIIGVTNRSIPGRNNTLCFSPALIATAEDIDAITDAVDQALTRVFG

SEQ ID NO: 26969 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 26970 - protein, 441 aa, Robiginitalea biformata HTCC2501
MEKRTFLKRLGQLTAASPFIFLPDGALAGRHSPSGRPREIPGQQGAGAPIQARTVSGGGENGFWERVRSDYDLKPDYINLESGYYNIIPRPTLEAYLENIRMVNREGAYYMRTVQWENKARVAARLAGMLGCTPGELILTRNTTESLDMVIGGYPWQPGDEAVFAEQDYGAMQMQFGLVAERFGVINRVLSLPMHPASDEEIVALYESAITPRTRLLMVCHMVNITGQILPVRKICDMAHRHGVEVLVDGAHCVGHFPVDIPALGCDYYGSSLHKWLAAPLGAGMLYIRREHIPKIWPLLAEHPREPDDISRLNHTGTHPVHTDLAIDAAMDYLEHIGIKRKAARLRELQRAWTEPLRAVRGVRVNTPESPERSCAIANVGVEGLPPAGLATALLEDFGIYSVAIDGAGVQGCRITPNVFNTPEEMAHLVAAVSEIARRAR

SEQ ID NO: 26971 - protein, 271 aa, Coccidioides immitis RS
MRLFLIPISTRRTLLYCQKTTGGVATQLSVIDRITNKAAVTWVQWEEAEQGWKKALTTYGHRVLQKIPYEEWGLKSVPPLSAKREAQELKSHSPVELLYPGNVIHQSRILGTLRKLATERQDLHRRRMWWSLGVAPLTAPIALIPLIPNIPFFYLAYRGWSHWRALNGSKHLEFLLDNHLVNPTSLPGLEDLYSRHQGLLPKLPPDETPVVDEKSGSNQQPQDDPPDETILLDISDGKDLAKMLQAPELHAEVERAVTQVRHLLNLKKQPK

SEQ ID NO: 26972 - protein, 396 aa, Wolinella succinogenes DSM 1740
MKQFAQLLRPTSFEDLIGQEHLFGANAPLRRLIEHGSLPHAFFYGPPGTGKTSAAKIIAKRLDRPFALFNATTFKIEELRSYLKEYKNALLKPLLFIDEVHRLSKNQQEVLLPLMENHEAIIIGASTENPYFAMTGAIRSRSMLFEFKPLGKKELEILLERVCENHSILLDNSARDYLLRSSEGDARAMLNLLDCAYSLGESPLSLETLKSFRPVSLHEGSSEGDTHYNLASAMIKSIRGSDENAAIYYLARLIEGGENPEFIARRLVILASEDIGNANPQALNLATSTLLSVAKIGYPEARIILAQCIIYLSASPKSNSAYKAINEALEFVRSKERLEIPPHIKSFHEGYRYPHDFGGWVEQRYLERPLSFVKWIPVGFEKTLKEWLEKIRSIGG

SEQ ID NO: 26973 - protein, 207 aa, Hypocrea lixii
VAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKS

SEQ ID NO: 26974 - protein, 325 aa, Mercurialis annua
RVLSSSATISVAHPGIGWGGNGAFGLFPAFYEFSCPQANDIVMSVLQEAISREPRMAASLLRLHFHDCFVQGCDASVLLDDSATVVSEKNSGPNKNSLRGFDVIDEMKNKLEEVCPQTVSCADILALAARGSTLLSGGPNWELPLGRRDSKTASLSGSNKLIPPPNSTIGNLIAFFKRQGLNVVDLVALSGAHTIGVARCVTFKQRLYNQNGNNEPDETLEKTYYRGLKSACPKSGGDNNISPLDFGSPVRFDNTYFKLILWGKGLLTSDEVLYTGTPTDYDLVKTYAEDEQLFFDQFAKSMIKMSNIRPLTGYSGEVRRLCSVN

SEQ ID NO: 26975 - protein, 209 aa, Triticum aestivum
  misc_feature (28)..(28): Xaa can be any naturally occurring amino acid
QKAGGEGVMSSVIMQCLRIASVKAADIXSKIKREVDDYTTEKALQKVKRTPALVAKKVNVPDVTMEESTHSALENQASKAPNDGQQIIKGDDDHQNIKRIPPLTVDRTVKHKQTSTFVGGPSNWDPYSKGVSLSSLRISQFPDPPAIPNDGKHEDTKPMLTESNPEVKSVLNSGTAGESDEVKESRSPKSLIDAVKPKHRRKKKQHGNS

SEQ ID NO: 26976 - protein, 393 aa, Pediococcus pentosaceus ATCC 25745
MPELDSALQNQTRPALSAISRSAIRQFDQQVSDIPGILKLTLGEPDLNTPEHVKQVLINAITNNASHYAPSAGLLRLRQAVSKYLLNSTNIRYNPASEILITIGATEAIFATMQTILSVGDEVIIPTPTFPLYMAIAKAIDATVIEIDTSDTDFVLTADALKQALQAHPNAKMLVLNYPTNPTGATYSKSKLTELAQVIQNSKLFVLADEIYGELSYDNKHYSIAELLPSRTILINGISKSYAMTGYRIGFLAAPATLTSNILKLHGFMVTTAPTSIMEGAIEALLHGQDDVAKMCEQYRLRRDYLVKELNQLNFQVRSPAGTFYLFAKIPINLIQNSNQLALQIAHQAKLAVIPGKVFGAGGEGYLRFSYAASMSNLHEAVRRLTKFVQEEK

SEQ ID NO: 26977 - protein, 263 aa, Populus trichocarpa
MACSATSTSFISSIAAAKSMATPLSKTLTLPNSFSGTRKSIQSPVLRSISLTRGSHSAKSFVVKASSELPLVGNVAPDFEAEAVFDQEFIKVKLSEYIGNKYVVLFFYPLDFTFVCPTEITAFSDRYEEFKQINTEVLGVSVDSVFSHLAWVQTDRKSGGLGDLKYPLISDVTKSISKSYGVLIPDQGVALRGLFIIDKEGVIQHSTINNLAIGRSVDETKRTLQALQYVQENPDEVCPAGWKPGDKSMKPDPRQSKDYFAAL

SEQ ID NO: 26978 - protein, 437 aa, Mannheimia succiniciproducens MBEL55E
MINIPSLIQAQRNFFAKGATKSLSFRKEQLLRLKALLEENTQAIIEALKTDLNKPADQVMLAEISPLIHEIDYMLENLDRLAAPKDVESPETLSFFGMGEYHSQIIYEPYGVTLNISPWNYPIQLSISPIIGAIAAGNTVVLKPSEFTAATSALLNRLVAQYFVPEFFVVIEGDVAVNQALLAEKFDYIFFTGSVPVGRIVMAAASKHLTPVTLELGGKSPFIVDKSANLEQAAESLIFGKTFNSGQTCIAPDYLLVQQDVKAEFVAILKQKLQQKFDDNPFENYAKVVSERHYLRIKSFLNDGKIVAGGLFNDETHQMLMTVLDGVTWESPVMQDEIFGSVLPMLTFNGFDEAIERILAQPKPLALYCFTETEENATAVLSQVSFGGGAVNSCFLHFFNHNLPFGGVGDSGMGSYHGDRSFYELSHEKAVVTRKIV

SEQ ID NO: 26979 - protein, 336 aa, Acholeplasma laidlawii
MSKEYEIIIVGGGPGGYVAAIKAAQYGAKVALVEKEVVGGICLNHGCIPTKTFLKSAKVFNTVKKSMDFGVSTSGEVGFDWSKIVSRKDGVVKQLTNGVAFLLKKNGVDVYNGFGDIKSANEVVVNGESLKTKNVIIATGSSAVVPPIPGVKEAYEKGIVVTSRELLNVKNYPKSIVIVGGGVIGVEFATVFNSFGSKVTIIEMMDGILPTMDDDIRVAYAKTLKRDGIEILTKAEVKKVDDHKVTYSLDGKETTIEGDLILMSVGTRANSKGLEHLGLEMDRANIKTNEYLQTNVPGVYAIGDVNGKFMLAHVAEHEGITAVQHILKIGHAKMNY

SEQ ID NO: 26980 - protein, 120 aa, Oryza sativa Indica Group
QRESGSTMDVVAAQTKAIAERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 26981 - protein, 602 aa, Physcomitrella patens
MQGAMQTKMWRGELISTSTHFIGGTRLQPKLNQDARKPTKSENCIVRVSMEREVKAKAAVSPPAVAADRLTPRVQERDGYYVLKEEFRQGINPQEKIKLGKEPMKFFIENEIEELAKTPFAELDSSKPGKDDIDVRLKWLGLFHRRKHQYGRFMMRFKLPNGITNSTQTRFLAETISKYGKEGCADLTTRQNWQIRGIMLEDVPSLLKGLESVGLSSLQSGMDNVRNAVGNPLAGIDPDEIVDTIPICQALNDYIINRGKGNTEITNLPRKWNVCVVGTHDLFEHPHINDLAYVPATKNGVFGFNILVGGFFSSKRCAEAIPMDAWVPTDDVVPLCKAILETYRDLGTRGNRQKTRMMWLIDEMGVEEFRAEVERRMPSGTIRRAGQDLIDPSWKRRSFFGVNPQKQAGLNYVGLHVPVGRLHAPEMFELARIADEYGNGEIRITVEQNLILPNIPTEKIDKLMQEPLLQKYSPNPTPLLANLVACTGSQFCGQAIAETKALSLQLTQQLEDTMETTRPIRLHFTGCPNTCAQIQVADIGFMGTMARDENRKPVEGFDIYLGGRIGSDSHLGELVVPGVPATKLLPVVQELMIQHFGAKRKP

SEQ ID NO: 26982 - protein, 255 aa, Thermotoga sp. RQ2
MTIGIVGVGNMGSIFAEKFSKEAERILLVEKDSEKLSRFNAPPYEIADLEKVREADLIVLAVKPQDAPIVLSALKGFDGILLSIVAGLKIEEIRKYGIHKVARIMPNVAVRVGEGVLATAFSADMSSEERELVKSLLEKLGFVVEIEEKLFSAVTALTGSGPAFIFVVVEAFLDAALKMGIPLDTAKELVYRLFKGSAELLIETGEHPALWKHRVSSPAGTTVEGLITMERFAVRSGVIESLISSYRRALELEEK

SEQ ID NO: 26983 - protein, 143 aa, Salmonella enterica subsp. enterica serovar Typhi str. CT18
MAIERTFSIIKPNAVAKNVIGSIFARFEAAGFKIVGTKMLHLTVEQARGFYAEHDGKPFFDGLVEFMTSGPIVVSVLESENAVQRHRDLLGATNPANALAGTLRADYADSLTENGTHGSDSLESAQREIAFFFGEGEVCPRTR

SEQ ID NO: 26984 - protein, 462 aa, Streptococcus suis 89/1591
MAIEIIMPKLGVDMQEGEIIEWKKQEGDFVNEGDVILEMMSDKTSMELEAEESGVLLKIVHGNGATVPVTEVIAYIGAEGETVEAGASSAPAVEPAAAIEEVPAGRTPVIVAPATAAKPQGSGKVRATPAARKLARELGIDLGLVPGTGANGRVHKVDVEDFKGAAPKATPLAARIAADQGVDLSTLTGSGVNGKIVKNDVLAVLAPVAVETAAPVPKAEEKPAKELPEGVEIIKMSPMRKAISKGMVNSYLTAPTFTLNYDIDMTNLMALRKQVLEPIMNKTGLKVTFTDLIGLAVVRTLMKEEHRYMNASLINDAQEIELHKFVNLGIAVGLDDGLVVPVVHGADKMSLSDFVVASKDVIKKAQSGKLKGAEMSGSTFSITNLGMFGTKTFNPIINQPNSAILGVASTVQTPVVIDGEIKIRPIMALCLTIDHRIIDGMNGAKFMVDLKNLLENPLELLI

SEQ ID NO: 26985 - protein, 423 aa, Rhodococcus sp. RHA1
MTTTTDVISIDAGPLDDALAQLTGAVEKLGYGPGMHQLLAKPRREMSVSIPLRRDNGDVEVLSGYRVQHNFSRGPAKGGLRFSPHVSLDEVRALAMWMTWKCALLDVPYGGAKGGITIDPTQYSMGELSRVTRRYTSEILPIIGPEKDIPAPDIGTDEQTMAWMMDTFSANVGYTVPSVVTGKPVSLGGSLGRSSATSKGVVHVALAALEYRGLTPSFATAAVQGFGKVGAGSAQFLAEAGVKVVAVGDQYGSIHNGNGLDIPALQAHVAATGTVRGFADSEPIDAAALLELEVDLLVPAAVEGVINSDNASNIRASIVVEGANGPTTAAADKILAARNVLVVPDILANAGGVIVSYFEWVQGNQAYWWTANEVDERLETRMIQGWRCVLETSIRRGLSLREAATVTAVERVADAHLTRGLYP

SEQ ID NO: 26986 - protein, 99 aa, Glycine max
  misc_feature (51)..(51): Xaa can be any naturally occurring amino acid
ASSMISSPAVTTVNLAGAGMVAPFTGLKSLAGLPTKKTYYDITSLAYTGGXLHCMHVWPPVGRKKFDTLFYLPDLDYAQLAYVLKYLLANGWIPCYEFE

SEQ ID NO: 26987 - protein, 586 aa, Streptococcus suis 89/1591
MAIEIIMPKLGVDMQEGEIIEWKKQEGDFVNEGDVILEMMSDKTSMELEAEESGVLLKIVHGNGATVPVTEVIAYLGAEGESVEVGSAPAPAEVAQATADLKAAGLEVPAAPAAAPQAPKAELAADEYDMVVVGGGPAGYYAAIRGAQLGGKIAIVEKSEFGGTCLNKGCIPTKTYLKNAEILDGLKIAAERGINLASTNYTVDMDKTVDFKNKVVKTLTGGVQGLLKANKVTIFNGLGQVNPDKTVVIGDKVIKGRSIILATGSKVSRINIPGIDSKLVLTSDDILDLREIPKSLTVMGGGVVGVELGLVYASYGTEVTVVEMADRIIPGMDREVSVELQKVLSKKGMKFLTSVGVSEIVEANNQLTIKLNDGSEIISEKALLSIGRVPQLAGLENLHLELDRGRIKVNAYQETSIPGIYAPGDVNGTKMLAHAAYRMGEVAAENAIHGNHHKAKLDFTPAAVYTHPEIAMVGLTEDQAIEKYGKENILIGRNSFTGNGRAIASNEAHGFVKVIAEKKYHEILGVHIIGPVAAEMINEAATIMESELTVDDVAASIHGHPTFSEVMYEAFLDVLGVAIHNPPKRK

SEQ ID NO: 26988 - protein, 753 aa, Oryza sativa Japonica Group
MEAQADAGGDDLAAMREQCRSLEEAIGFRRETQMGLVASLQRLVPDLVPSLDRSLRIIAAFNDRPFVPTPNPDGGHGKSPAALKPHHRRALPDPARSTRRKTSPGSSPASVAAAPGGLDAVRTMVAVCLLELVPFAEIDAAALARRLQAESSSASEAERTALADLAAELGGSAASAVVLALRRIAEDTGGVQIEEAMIGGKSMTMVWAIDRNKLLKELPESATLPLLQPPPAPQMPPSETDAGSAMIPRTPQQQQPQPDMWPHSMPPIFPRPRGMTMQGMQRVPGVPPGLMPLQRPFMGPAGVITMGGGVGPSPNQQKQKSEEDELKDLELLLNKKTYREKQNTKTGEELLDLIHRPTAKETAVAAKSHTVSPVVVNELAVADLGFEPRGLNVKTIAYKEMGDTRSKSSKIYSMFKTKGGSQLKEYCTNLTKEDCRRQSGSFVACDKVHFRRIIAPHTDTNLGDCSFLDTCRHTKTCKYVHYELDQTPDIPPMMAGALAPPRQIRLQRAEYCSEVELGEAQWINCDIRNFRMDILGQFGVIMADPPWDIHMELPYGTMADDEMRTLNVPALQTDGLIFLWVTGRAMELGRECLELWGYKRVEEIIWVKTNQLQRIIRTGRTGHWLNHSKEHCLVGIKGNPLVNRNIDTDVIVAEVRETSRKPDEMYPMLERISPRTRKLELFARMHNAHAGWLSLGNQLNGVRLVDEGLRARYKAAYPDSEVQPPSPPRASAPIDGDQGTSQKPTVSDGERPA

SEQ ID NO: 26989 - protein, 424 aa, Rhodococcus sp. RHA1
MANLSPALKQATPVVVDHALGSWIYGTDGVDYLDFTTGIGVTSTGHCHPKVVEAAREQVGKIIHAQYTTVMHKPLLALTDKLGEVLPTGLDSVFYANSGSEAVEAAIRLARMATGRPNIVVFQGGFHGRTVAAASLTTAGTKFSAGFSPLMSGVHMAPFPYAYRYGLDEEAAVEFALRELDYLFKTRTAPNDTAAFLIEPALGDGGYLPTPPAFMEGLRERADQFGIKLIFDEVQAGVGRTGKFWGHQHSTATPDILITAKGIASGFPISAIAASTETMSKAWPGSQGGTYGGNAVAAAAGVATLQVVEEEGLVENAHVRGEQLQAGLKSVQERFPIIGDVRGLGLMQGIEFTTADGTPDADTAAAVQQETTRQQLLTLTCGPAGNVVRLIPALVVTEDEITLGVERFEAAVAAVVGAVAVGAS

SEQ ID NO: 26990 - protein, 559 aa, Vibrio campbellii AND4
MLKKLFIRQAGNTLLNTPLLNKGSAFSLEERKSFNLTGLLPANIESIDEQASRAYEQFSLFSSSMDKHIYLRNIQDTNETLYYKLINQHIEEMMPIIYTPTVGDACQKFSQIYRRNRGLFLSFDDKDELEELLNNAPNTDVKVIVITDGERILGLGDQGIGGMGIPIGKLALYTACGGINPEHTLPIVLDVGTNNSALLSDPMYMGWRHPRISGEQYYDFVDDCLKAIRQRWPDALIQFEDFAQTNAMPLLTRYQDKFCCFNDDIQGTASVTVGTLLAAANVMGKKLSDQKVVFAGAGSAGCGIAEAVVAQMMAEGISEQQARNQVFMVDRWGMLEQGMTGLLDFQKNLSQPVSMRKTWGIQANNEISLLDVIQHAKPDVLIGVTGVPGLFNQAIIESMATGCERPVVMPLSNPTSRVEAKPSDIITWTKGKAIVATGSPFPDVIFEGQRYPIAQCNNSYIFPGVGLGVISASAKRVTNEMLQQASITLALMSPMLEGKNSLLPPLSDIQAVSRKIALEVAKKAVEQGKANDRTEERLQERIDEEFWSAQYCEYRRIAS

SEQ ID NO: 26991 - protein, 238 aa, Oryza sativa
  misc_feature (124)..(124): Xaa can be any naturally occurring amino acid
  misc_feature (233)..(233): Xaa can be any naturally occurring amino acid
MAHGGGGRAKVTPNLAMDEEGTRVLNITVLQRLDPAVEDILITAGHVTLYDFDTNLNQWSRKDVEGSLFVVKRNAQPRFQFVVMNRRNTDNLVEDLLGDFEYQLQVPYIMYRNAAQEVIGIWFXVAGQLNQSFGSTPLSSHAPTSISISQPPAVHHLLPSQTSSVISPDVHGGTGAVVNRSASLLNPSLFSPLTSSQTTMARTNPVAPTAPTSHPRITQQTHSAPLLQPFPLXTASPS

SEQ ID NO: 26992 - protein, 509 aa, Robiginitalea biformata HTCC2501
MQNNVLILDFGSQYTQLIARRVRELNIFCEIKPYNNLPGDLDGYKAVILSGSPFSTRSDDAPHPDLSRIKGHKPILAICYGAQYIAHFNGGNVAPSKTREYGRAKLAHVAQDPFLKDVPVGSQVWMSHSDTIQQLPDGAVLLASTHDVPNAAFKMPDERIYGIQFHPEVYHTTAGSLILRNFLVDIAGLEQTWTPAAFVETTVAELKEKIGTEKVILGLSGGVDSTVAAMLLHRAIGKHLHCIFVNNGLLRKNEFEEVLHQYKDMGLNIKGVDASARFLDALEGESDPEKKRKIIGRVFIEVFDDEAHLVEDAKWLGQGTIYPDVIESVSATGGPSATIKSHHNVGGLPDFMKLKVVEPLKMLFKDEVRRVGASLDIPAERLGRHPFPGPGLAIRILGDITREKVAILQEVDHIFINGLREWGLYDKIWQAGAMLLPVNSVGVMGDERTYEKCVALRAVESTDGMTADWVNLPYEFLQKTSNDIINKVPGVNRVVYDISSKPPATIEWE

SEQ ID NO: 26993 - protein, 475 aa, Streptococcus agalactiae
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVLDMK

SEQ ID NO: 26994 - protein, 397 aa, Mesorhizobium sp. BNC1
MRALVWHGKHDVRVETVDDPKIVNPRDAIIKITSTAICGSDLHLYDGVIPAIRPGDILGHEFMGEVVEVGKGNSRLSKGDRVVVPFVIACGKCFFCQKQQYSACDNSNPAEKADMSEMLYGHHMAGLFGYSHLTGGYAGGQAEYVRVPYSDIGPIVVPDDLDDDEVLFLSDILPTGWMAAENCEIEEGDTVAVWGCGPVGLFAIQSALIMGAAQVIAIDHYPHRLELASRIGAKVINYKNSRVYEALMDMTGGIGPDAVIDAVGMESHGFAPDNLYDYAKQTLKLETDRPHVLRQAIYACRKGGRVSVPGVYGGFVDKFPVGAFMQKGLTLRTGQTHVQKYLSSLLDMIRERKIDTTFLISHRLSLEAGPEGYRKFAFEQNETTKVVLKPGWENANG

SEQ ID NO: 26995 - protein, 398 aa, Streptococcus agalactiae
MAKLTVKDVDLKVKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 26996 - protein, 249 aa, Zea mays
MSEMYPLKAVKVMHTVALRTESSLYNPTTSPSLVASAQGLQNEDFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQPFLCFCASCQGDNLGSGCGDPADWARNTPAVPRITTIREKCTNHDNVPAASFGFPARLQTRASPPRFCFDSGGEKIEPPV

SEQ ID NO: 26997 - protein, 438 aa, Arabidopsis thaliana
MVRKKVPEWLNSTMWSTPPPPSSYDDGLLRHSPVTKMKEEAESISVAPRLNSAPPPSSNTSVPSPSHRPRNGNSISGGSGEYGHSVGPSAEDFSRQAHVSAELSKKVINMKELRSLALQSLPDSPGIRSTVWKLLLGYLPPERSLWSTELKQKRSQYKHYKDELLTSPVKITWKMVRSKGFDNYDLKSESRCMLARSRITDEDHPLSLGKASIWNTYFQDTETIEQIDRDVKRTHPDIPFFSGESSFARSNQESMKNILLVFAKLNQGIRYVQGMNEILAPIFYVFRNDPDEDSSSHAEADAFFCFVELLSGFRDFYCQQLDNSVVGIRSAITRLSQLVRKHDEELWRHLEITTKVNPQFYAFRWITLLLTQEFSFFDSLHIWDALLSDPEGPLLTGDMLCDAGTGEEEANRWGFHVEYEVTSTLSNYKHQSSLVCSQ

SEQ ID NO: 26998 - protein, 603 aa, Mannheimia succiniciproducens MBEL55E
MVTEGANYLVSIVTFLGAAIIVVPLFKKIGLGPVLGYLAAGLAIGPFGLALFTDSTTIIHIAELGVVMFLFLVGLEIQPKQLWGLRKYIFGMGSLQVLGATGALTAIGLLYNFSLQFSFIAASGFVLTSTAIVMQTLSYRNDMTSDPSRRIIAVLLFEDLLIVPLLALVAILSPAQTADSLQSHSLWQHIIVSFAGLALLIVAGIWLLDPLFRLVAKTKIRELMTAVALFVVLGSALLMEATGLSMAMGAFLAGVLLSNSSFRHQLEVDIDPFKGLLLGLFFLGVGMSLDLTHVLNHWKMIVSALFLMMITKGIIIYAVARATGSTKLQSLDRAVLMAQGGEFAFVLFSSAALQGVISAEVHANMTAIVVLSMALTPLFIVIYQKWIAPKFAVREVLENDVIEEQNDIILIGLGRFGQIVNHLLRASGFQPTIIDKDAKLVSGMKKRGIRSYFGDACHPDLLHRAGIETVKLVIVAIDNTKQATKIVQHIRQINPKAKIIARAYDRHHVFELAQAGANVQIRETFDSALRTGKQALTTLGIEQEKVHRIGNMFFGKDRHSVKLMADVYDPKKPMFTNADMLKIAFEQDEELKLEIQKILDEEI

SEQ ID NO: 26999 - protein, 237 aa, Synechococcus sp. WH 5701
MAELQDRMKLAVATAAVDQIRDGMVLGLGSGSTAALMIRELGARLRRGELSAITGVTTSFQGEVLAAELGIPLQSLNAVSRIDLAIDGADEVDPAFQLIKGGGACHVQEKLVARRADRFVVVVDSSKLVKRLNLEFLLPVEVLPGAWRQVKAELEAMGATADLRMAVKKAGPVVTDQGNLVLDLKFAGGITDPAALEQAINNLPGVLENGLFVGLTDQVLVGEIVDGEPRVRDLERI

SEQ ID NO: 27000 - protein, 459 aa, Pediococcus pentosaceus ATCC 25745
MVKVVKFGGSSLANAAQYQKVIEILRADPERRIVVVSAPGKRFKDDVKVTDLLIKYANASGENVKVARQAVLDRYQEIADAYHVSDSDFEQINVHLIDLANLHHANKACRLAHFKAAGERLNAILMALVLKKFNVTARFVDPKQLGIKAHGDYNNAILDQHSYAQIEAVCSNLLDEAEYLVVPGFYAYNQNGEVCTFSRGGSDITGAILARGFQAQLYENFTDVDSIYSADPKIIAQPHPIREMTYREMRELAYAGFSVFHDEAIIPAIEAQVPIVIKNTDHPNLPGTVIEPEQNYASDLEITGVASSSRFAALYIHKYLLNREVGFTLKLLKILYRYDISYEHMPSGIDDLTIIFNQNQITDEILPSLLSDIREELHTDQLEWIDDYAILMVVGEGMRDKVGVVDRIVNALARKQIGIQMINQGASRISTMLGVHQNQVNQAVREIYREFFKNKGRAD

SEQ ID NO: 27001 - protein, 362 aa, Carboxydothermus hydrogenoformans Z-2901
MPKGILILEDGSCYEGEIYGYVGENYGEVVFNTGMTGYQEILTDPSYAGQIVVMTYPLIGNYGFIPEDKEREKSFVRGLVVRELCDFPSNWRQKERLEHFLNEEKIVTLAGVDTREITKKLRLYGVMKGIISAFPEKRAEYQEKVKLVPDISGQKLAYQVAGDEVLHYPGQKPRVVLVDYGAKNSILQSLLKRGAEVFVVPPLMPAEQILALAPQGVVLSNGPGDPADLQESIFIIRQLIGKLPILGICLGHQLLALAHGAQTYKLKFGHRGSNHPVIETESKRVFITSHNHGFAVREESLIGTGLEIWFRNLNDNTIEGLRSRYSKILSVQFHPEAAPGPNDADFIFDLFLEMIDKGDSYA

SEQ ID NO: 27002 - protein, 210 aa, Oryza sativa Indica Group
MSDGKDSLDLSGLGAAVPNAKELSAEDKANLVESIKNTLQGLAARHTDVLESLEPKVRKRVEVLREIQSQHDDLEAKFFEERAALEAKYQKMYEPLYSKRYEIVNGVVEVDGVTKEAADETPAEQKEEKGVPEFWLNAMKNHEILSEEAAQDEDFEGIMDDEDDDDEDDDDDEDEDDEDDDEDDEDEKKGGRVPSGEGQQGERPAECKQQ

SEQ ID NO: 27003 - protein, 417 aa, Oryza sativa Japonica Group
MGRKRALLVGINYPGTKAELKGCHNDVDRMHRCLVDRFGFDEDDIRVLLDRDSSGTQPTGANIRRALAQLVGDARPGDFLFFHYSGHGTRLPAETGQNDDTGYDECIVPSDMNLITDQDFRELVQKVPNGCLFTIVSDSCHSGGLLDSAKEQIGNSTRQNQTQSREREEPSDSGSGFRSFLKETVRDVFESEGIHLPRSRHSQSHYGGEDQYETYAQPTDGHTKNRSLPLSTLIEMLKEKTGKDDIDVGSIRMTLFNIFGDDASPKVKKFMKVMLGKFQQGQSGEQGGLMGMVGSLAQEFLKVKLEGNEEEAFKPAIEQEVHSVDEVYAGTKTWAPNNGILISGCQSNQTSADATTPQGSSYGALSNAIQTILADKRGNVSNKDLVMKARSLLAKQGYTQQPGLYCSDDHVHVSFIC

SEQ ID NO: 27004 - protein, 596 aa, Oryza sativa Japonica Group
MLDTKYREEIDGSRRNVAFPWMHRSRLGLGGIAAAATAAGNGGATAGNVHRAAYIRKQRDHRSGLYRPWRGHHRKQVNLHDEEDREDAEVTGRHGLDQQSTGAMTTASAKCPRRKHKFWLLPDSGKDENGTETDGNHLYRFRFYIFFLNQKPRIRKRNQIYRNRNRTGANTEMIRCSQSQILSLSPKKSSLSLLPALHDCTQLLPMASVAATTFPSMARPAARGIVAGAAASTVPLPRAGVASPCPTARSLGFAARGTDPRLAIHVSSRRRAASASAGSRLARAVATMAKKSVGDLAAADLEGKRVLLRADLNVPLDASQNITDDTRVIAAIPTIKHLIGNGAKVILCSHLVQKADDVIGPEVEKSVSVLPNGSVLLLENVRFYKEEEKNDPEFAKKLASLADLYELDYLVGAVSNPKRPFAAIVGGSKVSSKIGVIESLLEKCDILLLGGGMIFTFYKAQGFPVGASLVEDDKLELATSLLAKAKEKGVSLMLPTDVIVADKFAPEANCQTVIWNGPMGVFEFEKFAVGTEAIAKKLAELSGKGVTTIIGGKDSVAAVEKVGVANVMSHISTGGGASLELLEGKELPGVVALDEA

SEQ ID NO: 27005 - protein, 131 aa, Populus trichocarpa
MGNSTLQHYFTLLIVLFTIFLAFSPRIQAQVDETSLKAMGDALEWPMSMYFDESSELDGGLVDLDDGEETSRRSLLWTRTHYYISYGALSANRIPCPARSGRSYYSHNCFKSRIPVNPYSRGCSRITRCRR

SEQ ID NO: 27006 - protein, 494 aa, Rhodococcus sp. RHA1
MTTATAFAPTTGTQAVPTGLLIDGTWQGAADGRTFEVENPATGEVLSVIADGGPADADAALAAAVAAQESWARTAPRARSEILRRAYDLVMARQDWLAEIMTSEMGKPLAEAKGEVAYAAEFLRWFSEEAVRIGGDHTTTGDGANRIIVTREPVGPCVLITPWNFPLAMGTRKIAPAVAAGCTMVLKPAAQTPLTSLALAAIMQEAGLPDGVLNVVNTTNAGSVVEPWMSSGKARKISFTGSTAVGKLLLKQAADAVMRSSMELGGNAPFIVCADADIDTAVDGAIAAKMRNMGEACTAANRLYVHRSIADVFSERLAARMADMQVGNGLDEGVQVGPLIDAAGRDKVQTLVDDALGRGAKALTGGAVPAGAGYFYPPTVLTDVSTDSDLMTTEIFGPVAPVVPFDDENEVIRIANDTDWGLVGYVFSQDIDRAFDLSERLEVGMVGVNTGIVSNPAAPFGGVKQSGLGREGGKLGIDEFLEYKYLAVPRRRGA

SEQ ID NO: 27007 - protein, 313 aa, Thermotoga maritima MSB8
MSVNLKGRSLLTLLDFSPEEIRYLLDISKQVKMENRSKLRTERFKGMTLAMIFEKRSTRTRLAFETAFAEEGGHPIFLSPNDIHLGAKESLEDTARVLGRMVDAIMFRGYKQETVEKLAEYSGVPVYNGLTDEFHPTQALADLMTIEENFGRLKGVKVVFMGDTRNNVATSLMIACAKMGMNFVACGPEELKPRSDVFKRCQEIVKETDGSVSFTSNLEEALAGADVVYTDVWASMGEEDKEKERMALLKPYQVNERVMEMTGKSETIFMHCLPAVKGQEVTYEVIEGKQSRVWDEAENRKHTIKAVMIATLL

SEQ ID NO: 27008 - protein, 339 aa, Pisum sativum
MVQEKKLVDEVSGWLRIYDDGSVDRTWTGPPEVNFMIEPVAPHEEFIDGVATRDVTMSTTTNDNFIHRARLYLPEKTPTENEKLPILIHFHGGGFCITEPDCFMYYKVYTRFVKSTRSICVSPFLRRAPEHRLPAAIEDGFATLRWLQSVAKGDAHDPWLEKHGDFNRVFLIGDSSGGNLVHEVSARASSTDLRPVRLAGAIPIHPGYVRSERSRSENEMPQSPFLTLDMLDKFLSLSLPIGSNKDHPITCPMGEAAPPLAGFKLPPFLLCVAEKDLLRDPQMEYYEAMKKDNKEVDLFVSKNMTHSFYLNKIAVDMDPTVSAELNALMARVKDFIEKH

SEQ ID NO: 27009 - protein, 470 aa, Rhodococcus sp. RHA1
MRSARNDGEKNPQGTTAGRPGHTLHKGGLRQRHLTMIALGGIIGASLFVGSGSVIHTAGPAAVLSYALGGVLVIFVMRMLGEMATAKPTLGSFMEYAREALGERAGFIVGWLYWYFWVGVVAFEAVVGGKLLGGWFNAPDWVFALVLMFILTATNLLSARSFGETEFWLASIKVATIIVFLSVGALFVLGLWPGSQLSVANIGQHGFIVNGGFSILQGVVVVIFSYFGAEIVTMAAAESEQPAKAVAKATNTVLWRILLFYVGSVALLLMITPWTEIPSNSSPFAAAFDKFGLPAAGQIMNVVVLTAALSVLNSGLYTASRMLFALANRGWAPGWARDCNSRGVPWKAILLSTIVGYVAVAMNYVSPDQVFSFIMNSAGAVALFVYVIIALSQLSLRSRMTDDEKAALGLKMWLHPWLGIITVVGIVVIIFSMSLIESTRTQLWLSLISLGVLLVAYSITQRVRHRRARK

SEQ ID NO: 27010 - protein, 128 aa, Salmonella enterica subsp. enterica serovar Typhi str. CT18
MAYSEKVIDHYENPRNVGSFDNNDDNVGSGMVGAPACGDVMKLQIKVNDEGIIEDARFKTYGCGSAIASSSLVTEWVKGKSLDEAQAIKNTDIADELELPPVKIHCSILAEDAIKAAIADYKSKREAK

SEQ ID NO: 27011 - protein, 920 aa, Ostreococcus tauri
MAYEDDGEEPDDRWGYDGRGDGGQGRDPRGPLPDGLPPGASESYYGLDAQYQTARTRRLLRGAMPAAAQSEPVRQKQQMRRSGGGTPRATAASMDLQRQQQVLVNSQFEVELEAEVAVGASSRPMTTMMQRVREKFDASLDAIGDVIPDGIPLLGGGSDFTARAQRERDLNARLAEARYYAELEQQKRIKAEQAFKQSHQKWLDAQAATRQVRAQATETATKLVELEERLFREDIFDNHPVVSKVTELENLVLRDVEEEKTADQLKNELARLEMNAMQRVKELENQVNDLQLELETRPSVPQALVARLEALESAMVSGSSYKADGSTESASSLQENIASVGDAFAEVRDSLRVEMQKVQSELQSIHPLMDHGAGRIDILFAKVTALESSMDAVSEGAASQIGRLAAQIDRLEKALAESAGVELKPFPQVRDLEESEPMTDDFTEETVKFIEDVMVPVEEVEEEVEDELFGDASSSVDESATDFMQLFTESQVVTDAIPVAEPFVEPAPVEEEHDIARESGVMPRIAIGREVMLQGFHWESHNHDWYSIVSERLEVMNRAGFTQVWLPPPADSLAPQGYMPRQLYSLNSKYGSEDGLRNLISNCKEHDVLPVLDAVLNHRCATHQGAGGKWNRWEGTGMDWGEWAIDNRNPQFGGMGNHPTGDEFSGAPNIDHTNDTVREDYSKWLRWLKDDVGFGGVRFDFSKGYDGRFAGEYIKAMDPEFAVGEYWDTLAYGAGLEYDQDAHRQRIVNWIDAAGGNTTAFDFTTKGILQEACGRSEFWRLIDSKGRAPGVIGLWPARAVTFIDNHDTGSTQGHWPFPNDKVSMGYAYILTHPGTPCVLWDHFFDWGEHLRENIETLMDVRKRSGIHSRSKLQIVAATDGLYAAIVDGKVAVKLGGDNWSPAGDGWERVAGDHDWCVWQR

SEQ ID NO: 27012 - protein, 273 aa, Ostreococcus tauri
MSVDDRETVNKEIEALEATQLSDRTCENEGIFGFYDVSYVSVGKNQVGNPAGGRFRSPLGRFLFKTIGLEQNLFAPNRIENRVAFTVLGCLPGEVTLEGTFGAVDGLNDGRTVKADFDPPGISVAGGPKLRIGPKSSVVLSTTYLDESVRLGKGSRGSLFVFTRKSTEQHARDLRRWGVGGLAIAIMLLTALGLGIFGVHQFKTTKSILYPATVVASSLISLLMAYVLRDGGIVAEDADLAQVGELTQEQKDFLTKGRSDGQAKGENVFSSQT

SEQ ID NO: 27013 - protein, 326 aa, Zea mays
  misc_feature (87)..(87): Xaa can be any naturally occurring amino acid
MEAWRSLLASFVLAVLAAQALVAVVESRTGPVEQASEGDDVKKPDCVPGMDPRSFPGTGGGHGITPVTPSHGGSSSPTPSHGGGGRXVPTPSHGGTLPFPSHGGSGSGSSPTSPSTGGGAYGGSPSTPGGGAYGGSPPSTPSGGGAYGGSPSTPSGGGAYGGGSPSPAHGAGGAYGSSPTPAYGDSPLHGGIGTSSPTTFVPMDPHSFGTCDYWRSHPMEIWSAVGGRFPSTSSSMGHFFGAAAGSVGGADVMSIQDAVGNTRADGTGALLREGAAALLNSMTRAGFPYTTEQVRDAFAAAAAAGSDGAAALEYPSRGPKLTRTQL

SEQ ID NO: 27014 - protein, 408 aa, Gibberella zeae
MRFKLADSLSLITVQLILATSTLALSNPGSSSQKHSPNPSAPSPKGISVPFFATLERLSRLVDIAYCIGTTGVRKPFNCVSRCNDFPSLSLINAWNTGPLLSDSCGYIAVDHGVAQHGDSGDLTAGEPAIVVAFRGTYSIANTIVDLSTVPQEYVPYPSPDHGGSEPPNEPEHTCTNCTVHMGFLQSWKNTRQFVLPQLRQLRLQYPSYPIQLVGHSLGGSVACLAALELKVSLGWENVIVTTFGESRVGNEGLARFVDEVFYLNDDNNPEGREFRRVTHKEDPVPLLPLSEWGYKSHAGEVYITKQELTPSESDIYMCIGDNDPKCIAGADDSLWMTTRRLFHARNLWTASDKLAEPNGFPSRFKLWQLLFAHRDYFWRLGLCVPGGDPADWGRGRYQGLGPDTEEL

SEQ ID NO: 27015 - protein, 328 aa, Vibrio vulnificus YJ016
MSRGFVAVIIAAITLRRHPMNHINRVAIIGECMVELKKVNGELQQGFGGDTLNTAVYLSRLTQQSGVSTSYVTGLGQDPFSREMLAAWQDEGINTDMVYLSQDKLPGIYAIETADNGERSFFYWRNDSAAKYWLRDRAILTLAKELCQHQMIYLSGISLAILSQDCREALIKLLALCRSDGVKIAFDNNFRPALWSNVADAQAFYQQILQVTDMAFLTFDDEMLLWGDTHEDQAIERTKGFGVSEIVIKRGGDECFVVTEAGRHAVAPLKIDHVVDTTAAGDSFSAGYLAKRILGGDCQQAAVAGHTVAGHVIQHRGAIIPREAMPTI

SEQ ID NO: 27016 - protein, 278 aa, Borrelia burgdorferi B31
MKGIILAAGYGTRFLPITKTIPKEMLPILNKPAIDYIIQEFIDSGIKDILLISSRRKKVLEDYFDREIELENIFLKENKKDELEKIRSKKINISFIRQKEMLGTGNALLYAKPWINREPVVVAYPDDLCIGNPPLSLQLIKLYEKTGKNIISIIENPENINRYGVIDLYKDEIHVKNIIEKPKIGSEPSNKASIGRFLYNYEFFEHLEEGFKLHKKGEYYHIYALKKLMDQKKVLYKNIEGKRIDIGTLEGYLEAIINSAKKDKKLMGIIKKGINEND

SEQ ID NO: 27017 - protein, 231 aa, Triticum aestivum
DEGRGGGRRPGGRGDGGGDGGNRIDALGRLLTRVLRHMAPELRLNMRSDGYVRVRDLLRLNLETFAKVPLNSHTVDEIREAVRRDNAQRFGLLEEDGELLIRANQGHTVTTVTSESLLKPILSADEVSVCVHGTYRKNVDSILKYGLKRMARLHVHFSSGLPSDGGVISGMRSGANILIYLNVRKALQDGMKLYISDNKVILTEGFDGVVPVKYFEKIETWPGRAPIPFQR

SEQ ID NO: 27018 - protein, 385 aa, Thermus thermophilus HB27
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGKQALFNLFQAILDPGDEVIVLSPYWVSYPEMVRFAGGVVVEVETLPEEGFVPDPERVRRAITPRTKALVVNSPNNPTGAVYPKEVLEALAKLAVEHDFYLVSDEIYEHLLYEGEHFSPGRVAPEHTLTVNGAAKAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLERA

SEQ ID NO: 27019 - protein, 523 aa, Saccharomyces cerevisiae YJM789
MTKEEIADKKRKVVDEEVIEKKKSKKHKKDKKDKKEKKDKKHKKHKKEKKGEKEVEVPEKESEKKPEPTSAVASEFYVQSEALTSLPQSDIDEYFKENEIAVEDPLNLALRPLLSFDYLSLDSSIQAEISKFPKPTPIQAVAWPYLLSGKDVVGVAETGSGKTFAFGVPAISHLMNDQKKRGIQVLVISPTRELASQIYDNLIVLTDKVGMQCCCVYGGVPKDEQRIQLKKSQVVVATPGRLLDLLQEGSVDLSQVNYLVLDEADRMLEKGFEEDIKNIIRETDASKRQTLMFTATWPKEVRELASTFMNNPIKVSIGNTDQLTANKRITQIVEVVDPRGKERKLLELLKKYHSGPKKNEKVLIFALYKKEAARVERNLKYNGYNIAAIHGDLSQQQRTQALNEFKSGKSNLLLATDVAARGLDIPNVKTVINLTFPLTVEDYVHRIGRTGRAGQTGTAHTLFTEQEKHLAGGLVNVLNGANQPVPEDLIKFGTHTKKKEHSAYGSFFKDVDLTKKPKKITFD

SEQ ID NO: 27020 - protein, 292 aa, Bacillus halodurans C-125
MKIGYLGPRGTFTEMAVQTLFDDKNVLKPYRTIPDCMDSVANGDMDAAVVPVENAIEGSVNVTLDYLIHKQRLEIVADIVVPISQHFLVHPNQRDNEIKKILSHPHAVAQCHEFLRSSYPGVEIEYMTSTAAAAQWVADHPNEPVAAIANEQAATSYQLDMLEKDIHDYDENRTRFAVLAKGKLSLPPYQVEPYTKKTTMMVTLSSDFSGALHQVLSAFAWRKLNLTKIESRPMKTGLGNYFFIIDVDCEADDVLIPGVMQELEALGCGVELLGSYPCFFHTSLKLTEASSV

SEQ ID NO: 27021 - protein, 359 aa, Arabidopsis thaliana
MTMMSDISQDLLEEILSRVPITSLRAVKSTCKRWKDLLNDPSFSKKYGGKRDNEFLAIMTSGSRASLMSVNLHGPRDNKDLEDPFIKQIGELNQDQIFKVFHCDGLLLCITNEDNTRLVVWNPYLAQTRCIQPIDKFYIYDWYCLGYDKDKNHKILVVYSPMFGRIEYEIYSFLSKSWIVLSFPTDWQISRDECLSLKGNTYFIAYKKMEVEEVGFQEFLLCFDFTNERFGPLLPLPFQCYNQTSLVLSTVQEEQLAVLCKRCDAYETKIWITTKIEPNAVSWSYFLKFDFKVDISGGSFFVDVEEKVAVLFCINREKEKGINNKTYMIGEDGYYKEVDLGESNWCPSMCSYVPSCVQV

SEQ ID NO: 27022 - protein, 383 aa, Thermus thermophilus HB27
MSGSLLLLFVFLSAFLAPPLSRLLRMPVPVGELVIGLLLGHFLAQGVALPEILGFLADFGFLLLMFLAGLEVDFNLLRQLERRHFVFYALYVVGMFLGAGLLAGLLGVGLAQALILALVSIGLMVATLRDMGILGRAFAKRVLILGVLGEVASLFGLTAMEKAAHYQGLLSLLKEVGIIALFFLLLFLAFRLAGLFLWWYPEVGRRLVYEEDPSAMGIRLSLALMFAAAVMSGLVGLESVLGAFLAGMILSYFLQKKHDLEAKLSAMGYGFLIPIFFIRTGMGIDLSGLDGRLLLEVGQALLLMLLIRLLPAPFLLLGGFRLREAFLAALLLAYPFTLMIAGTEIARSAHLLDERAALVLLLAAALSSLLFPWTAKMLLRFLR

SEQ ID NO: 27023 - protein, 444 aa, Pediococcus pentosaceus ATCC 25745
MTESYQFDVLYLGAGHGAFDGAVPLANSGKKVAIVEADKIGGTCPNRGCNAKITLDNPVQLLRHQERLDGIVNGDLKLDWTANVEHEHEVIDGLPDMITGLLDSVDIEIIHGRGKFVDAHTIEVDQQRYTADKIVIATGLRPHHLDVMGSELTHDSTDFMNLKHLPENIVIIGAGYIGMEFATIANAAGANVTVLLRHNRALRKFNQDYVKQVIADLEKRGVKFIYNAQVDRFEEDGSHFTVSYNDHETLTTDWILDATGRIPNIENIGLDEVGVSYNANGIEVNDHLQTNIDNIYASGDVLDKEQPKLTPTAIFESSYLTQLFTGKTTDAINYPAIPTIVFTSPQIAQVGMSVEEAQQNPDYTIKTNHLPDGWFRQVDKETIGNNTLIYDQDHHLVGAAEVSEHAADAINVLLPAIEFQYTAEQLGRIVPLFPTLGADVWSQI

SEQ ID NO: 27024 - protein, 312 aa, Kineococcus radiotolerans SRS30216
MREIVLFSGSAHPELARAVAGELGIELSPTRTSRFSNDCLEVQLEANCRQRDVYIVQPLVPPVQEALVELLLMVDAAKHASAGRVTAVVPHYAYARSDKKDTGRISIGGRLVADLLETAGADHVLAVTLHSPQVHGFFRVPVDHLHALHQLATHFAGEDLSNAVVVSPDLGYAKPAAAFARLLGCSVAAGAKQRFPDDRVVIADIIGEVTGKDVIVIDDEIAKGSTVFELVARLKELRVRSVRVVCTHGIFAGDALDRLIKHPDIDEVVCTDTVPLRGGPRPGLSVISIAPALATAIRHIHEGESVSALFQH

SEQ ID NO: 27025 - protein, 267 aa, Salmonella enterica subsp. enterica serovar Typhi str. CT18
MHPMLTIAVRAARKAGNVIAKNYETPDAAEASQKGSNDFVTNVDKAAEAVIIDTIRKSYPQHTIITEESGEHVGTDQDVQWVIDPLDGTTNFIKRLPHFSVSIAVHIKGRTEVAVVYDPMRNELFTATRGQGAQLNGYRLRGSTARDLDGTILATGFPFKAKQYATTYINIIGKLFTECADFRRTGSAALDLAYVAAGRVDGFFEIGLRPWDFAAGELLVREAGGIVSDFTGGHNYMMTGNIVAGNPRVVKAMLANMRDELSDALKR

SEQ ID NO: 27026 - protein, 340 aa, Clostridium difficile 630
MNNISLKGKSFLTLKDFTKEEIRYLLTLSSYLKTKKKVGIKGDLLQGKNIALLFEKTSTRTRCSFEVAAHDEGAHVTYLGPNDCHMGKKESVSDTAKVLGRFYDGIEFRGFKQETVESLAKYSGVPVWNGLTDEYHPTQILADFLTVIENVDKDLNKVKFVYVGDARNNMGNSLMIGCAKMGIHFVALAPKELWPNEELVKEMKEIAKKSKGDIMLTENIDDVKGADVIYTDVWVSMGEEEQYEARINQLKDYQVNMDMIKKTKNENVIFLHCLPAFHDLETKVAQEIYEKFGLSELEVTNEVFNSKYSKVFEEAENRMHTIKAVMVSTMTDVNMNNNLI

SEQ ID NO: 27027 - protein, 409 aa, Rhodococcus sp. RHA1
MLPRNREFATETTTLPIVNWSVHQMARKTPQADVTHCITVIPGDGIGREVVPAAITVLDAVSAQYGFGLFWDEKNWGSGFYKRYRRMMPIDALDQIARTDAVLLGAVGDPDISDSETLWGMLIPIRRQFDQYVNLRPIRSLPGARSPWSSGADIDFVVVRENVEGEYSEVGGRSYRGTDHESAYQQAIFTRHGIGRLTHYACRLASQRRGRVTSATKSDGLIHTMTFWDEIVQEVAAQHPELQLNSAHIDALAASILTDPEQFDVIVASNLFGDILSGIAAAVVGSVGVSPSANLNPERRYPSMFEPVHGSAPDLVGRGIANPTGAIWAGSMMLEHLGHRQAAEAVVDALTAVIAAGTCTPDLGGTATTSDFTAAVVAELQDGRQSLIIAPSKRAAEFGRVCPRRFADT

SEQ ID NO: 27028 - protein, 395 aa, Clostridium difficile 630
MNNDNTISKWNEYFIDTYNQPNFVIDYGEGSCFFDTNGNKYIDFTSGYGVSSLGYSNSNLKNALKEQVDKLLHTSNLYFNEPVLCSGEKIINSSGMAKVYFCNSGTEANETAFKIARKYSSDKYGNGRGTIISLKDSFHGRTMMSLMATGMDKYHKYFYPLPEGFKYVERNNIEDLKNNLDSTVCAIILEAIQGEGGVNVLEKDYVLEIVKICQEKDIVVIFDEVQCGIGRTGKLFGYEYFDVKPDIVTVAKGLGAGIPVGGVLVNKKLSKVLGKGDQGTTFGGNLLAMVAASVVLDEISKDGFYNEVLEKGNYIRKSIESFNNKVVLKTKGIGLMIGIETNIESSIIEEKARKKGLLILTAGKNVLRFLPPLTISYKEIDEALEILKDILLEIN

SEQ ID NO: 27029 - protein, 286 aa, Clostridium difficile 630
MINIEKANTLIEALPYIEKHQGKTIVVKYGGSAMKKDGLKESVMEDLVLMSYVGINIVLVHGGGAEINKMLAKVDIESKFVNGLRYTDEETMEIVKMVLAGKVNKDLVNKIHTKGGKAVGLCGIDNNMILCDPYKNYELGFVGEIKKVNVELIESCLKSGYISVIATIGVGDDGETYNINGDTAASAIAKELNADKLILLTDVPGLLREPDEEKSLITEVILEDVDKLFEEGIITGGMIPKIEGCVDALNNGVNRVHILDGRVPHSIITELFTDSGIGTLIRKENE

SEQ ID NO: 27030 - protein, 413 aa, Bordetella pertussis Tohama I
MNMPAPAATRRDRIEDELGAHNYQPLDVVLARGSGVWLYDTAGRRYLDCLSAYSAVNQGHCHPRILAAMVEQAQRLTLTSRAFRHDQLAPLYEDLARLTGAHKVLPMNSGAEAVETALKAVRKWGYEARGVPAGQAEIIVCANNFHGRTLGIVGFSTDPDARGGYGPFAPGFTVVPFGDFAALQAAVTPRTVAFLVEPIQGEAGVILPPPGYFRQVRKLCSERDIVLILDEIQTGLGRTGAFLAEAHEGIEADVTLIGKALSGGFYPVSAVLSNQAVLGIFQPGQHGSTFGGNPLACAVARAALRVLHDEGMIDNAREQGAYFMQRLRALPGPVREVRGRGLMLALELEPDAGPARAYCERLMARGMLVKDTHGQTLRLSPPLIVTREQIDWACAQLAHVLAHSAPGSSGGPS

SEQ ID NO: 27031 - protein, 322 aa, Spinacia oleracea
MAVVSTSLASQITNPNSAVSTQFSGLRRSFLKLENSVSTQSSFFQNVDSHLRLSSSSRRCPRGVVAMAGSGKFFVGGNWKCNGTKESITKLVSDLNSATLEADVDVVVAPPFVYIDQVKSSLTGRVEISAQNCWIGKGGAFTGEISVEQLKDLGCQWVILGHSERRHVIGEQNEFIGKKAAYALNQGVGVIACIGELLEEREAGKTFDVCYQQLKAFADALPSWDNVVVAYEPVWAIGTGKVASPDQAQEVHVAVRDWLKKNVSEEVASKTRIIYGGSVNGGNCAELAKQEDIDGFLVGGASLKGPEFATIVNSVTAKKVAA

SEQ ID NO: 27032 - protein, 250 aa, Gracilaria gracilis
NWKCNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 27033 - protein, 433 aa, Haemophilus influenzae R2846
MKSGDLNKYDLVKNTLVLVLAGGRGSRLHELTDKRAKPALYFGGNRRIIDFALSNCINSDLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDIEEDKKRFRISSTGKVILVTPKMLKKLEGHEIEEDGHLD

SEQ ID NO: 27034 - protein, 195 aa, Lactuca sativa
IQVAAQNCWVKKGGAFTGEVSAEMLANLGVPWVILGHSERRALLNETNEFVGDKVAYALSQGLKVIACVGETLEQREAGTTMEVVAAQTKAIADKISSWDNVVLAYEPVWAIGTGKVASPAQAQEVHAGLRKWFCDNVSAEVSASTRIIYGGSVSGSNCKELGGQTDVDGFLVGGASLKPEFIDIIKAAEVKKSA

SEQ ID NO: 27035 - protein, 360 aa, Saccharomyces cerevisiae
MLNRTIAKRTLATAAQAERTLPKKYGGRFTVTLIPGDGVGKEITDSVRTIFEAENIPIDWETINIKQTDHKEGVYEAVESLKRNKIGLKGLWHTPADQTGHGSLNVALRKQLDIYANVALFKSLKGVKTRIPDIDLIVIRENTEGEFSGLEHESVPGVVESLKVMTRPKTERIARFAFDFAKKYNRKSVTAVHKANIMKLGDGLFRNIITEIGQKEYPDIDVSSIIVDNASMQAVAKPHQFDVLVTPSMYGTILGNIGAALIGGPGLVAGANFGRDYAVFEPGSRHVGLDIKGQNVANPTAMILSSTLMLNHLGLNEYATRISKAVHETIAEGKHTTRDIGGSSSTTDFTNEIINKLSTM

SEQ ID NO: 27036 - protein, 467 aa, Oryza sativa Japonica Group
MRAATRGDVLDRRCHDIVPRVMPHYRAWMSRYGKVFVSWSGATPALCVGDYAMVKQILSDRTGLYGKPEPEPSILALIGNGLIFIGGDDWARHRRVVHPAFAMDKLKMMAKTMADCAREVIREWEARATADGERRVQVEVGGQLQELTADVISHTAFGSSYREGKEVFVAQRELQSIAFSAINSTRFPGSQYIPTKTNLRRRHLAKKVRGTLMAIIRERQAAAAKEDSGHGNDLLGLMLEANATDACGSGGEKSMTMDEIVDECKTFFFAGHDTTSHLLTWAMFLLGTHPEWQHRLREEVLRECGGGGDTEALPNGDALNKLKLMTMVLYETLRLYGPVSLMARTATADAELGGVRVPKGTMTMIPMAILHRDADVWGAGAGEFDPLRFRGGVNKAAAHAGALLAFSLGQRSCIGQDFAMMEAKTTLAMILRRFAFEVSPEYVHAPLDLLTLQPKCGLPMVLKLLDQ

SEQ ID NO: 27037 - protein, 242 aa, Mycoplasma flocculare
MKKIIIGNWKMNKTVHETRDFIQKFDIFYSKNLGKIKDNLDFAIAPSFTSLALISTSKIDKLKVAAQNLSQFDSGAFTGEISAKMLQDLAVHYVIIGHSERREIFKEIGEDLTNKILQAQKYNLIPVFCVGESLSEFEANETEKVIIGQINEVKSVLNFEKAIIAYEPIWAIGTGKTATAQIAEQVCKLIKNNFGKNIRVIYGGSVNSKNINELLLQKNIDGALVGKASLDPEEFVKILANI

SEQ ID NO: 27038 - protein, 150 aa, Mycoplasma pirum
MKKRIIIGNWKTNKTQKEVKEFFKILNASLKNKNICCTFGVAPVAIHLELAKSLAPKQMIIAAQDANYISSGAFTGTISWSQLKDIKIKYVIVGHSERRMYYNETDDIVNKKVKNLLENKMIPILCIGGNIEEFNNKKTYQVCATQLKKA

SEQ ID NO: 27039 - protein, 154 aa, Bacillus amyloliquefaciens
MNIIQGNLVGTGLKIGIVVGRFNEFITSKLLSGAEDTLIRHGVESNDIDVAWVPGAFEIPFAAKKMAETKKYDAVITLGTVIRGATTHYDYVCNEAAKGIAQAGTATGVPVIFGIVTTETIEQAIERAGTKAGNKGADCAVSAIEMANLNRSFE

SEQ ID NO: 27040 - protein, 630 aa, Mesorhizobium sp. BNC1
MQFDVAALGRIAVDLYGEQKGTSLEDTATFRRYVGGSSGNLAIGCARLGLKTAMISSTGEDPMGRYIRAELAKAGVDNTCVTANPQRRTALAFLGMQRADAIALDFYRDRAADMAVGFGDREAEKVRQSRLLALTGTHMSEPGTADALRKAVETAREAAGKVVLDIDFRKALWEQSPGGIEGVVSSINDLLDKINIVVGNEEEFLRLGGSNDIVEALKKVRGNTSALLVLKLGAEGSIAFAGEIPPRSEWRPVPGFKVYVLNVVGAGDAFLAGFLSLWLQGEPVNACLRRGNLNGALVVSRHACSDAMPFLAEIETIEDESAVDLIAKGSELERLHAVLKRPRVERGLTALAFDHRVPFAQLIAETGRSKADAIAFKKLIARAAKEVAGERGLANPGVLIDQHYGTDVMEALTEDGWWVGRPVEETGSRPLRFEAEDSLEETISAWNPKHVAKVLVWYHPGDDIALKNEQQASLKRLQACCRGRGQEWMLEVILPLDLERSDALLIAAVGELYAAGLKPDWLKLSGFETADAWDQLESMVKSFDPYCRGVILLGLSQPIEDLRIPIELAAQQPFCQGFAVGRSIFMDPARKWFAGISTDEETVNEIKGNYAKVVDMWSSTKQSTSIAEVA

SEQ ID NO: 27041 - protein, 190 aa, Lactococcus lactis subsp. lactis Il1403
MKEKIPNQLTMARIFMIPIFVILFYLPEGAHFNGFVSQDHSSVMWVIAAIVFAVASFTDWLDGYLARKWHVVSNFGKFADPLADKMLNMVAFVVLVGLHVVPMWAVAIIICRELAVTGLRLLLVEQGGVVMAAAMPGKIKTATQMLSVIFLFIGNPLYIGTILFYVCVLFTIYSGYDYFAKNMQVFRNAD

SEQ ID NO: 27042 - protein, 254 aa, Petunia x hybrida
MGRKFFVGGNWKCNGTAEEVKKILATLNAADVPSQDVVEVVVSPPYVFLPLVKNELRPDFHVAAQNCWVKKGGAFTGEVSAEMLVNLSIPWVILGHSERRALLGESNEFVGDKVAYALSQGLKVIACVGETLEERESGSTMDVVAAQTKAIADRVKDWTNVVVAYEPVWAIGTGKVASPAQAQEVHAELRKWLAANVSPEVAASTRIIYGGSVNGANCKELGGQPDVDGFLVGGASLKPEFIDIIKAAEVKRNA

SEQ ID NO: 27043 - protein, 257 aa, Mesorhizobium sp. BNC1
MEVLSGKVALVTGAARGLGEAIAVELAAQGARVALLDVLDELGAEVAENIKKSSGNAYYRNCDIRDTEEVRSAVDEVYSTYGKLDVLVNNAAVSTAPTSIPELSEETWNNIFNVNVSSIYRFCRFVLPRMQEAGGGAVINMSSVHQSHSLTGWTAYAATKGAIISMSRQLAAEWGRFNIRVNTVSPGAIDATMTRQILDRDPTGRQEAAFRHMHALERLGRSEEVGKTVAFLASDGAGFITGEDILVDGGLTKLCRL

SEQ ID NO: 27044 - protein, 491 aa, Yersinia pseudotuberculosis IP 32953
MNTVQVAQACDLVIFGAKGDLARRKLLPSLYQLEKAGHIHPDTRIIGVGRAEWDKDAYTAVVKEALDTFMKEPLDDELWQKLSSRLDFCNLDVNDSKHFTKLGKMLDQKHRTTINYFAMPPSTFGAICKGLGEAGLNKEPSRVVMEKPLGTDLASSRVINDQVAEYFNECQVYRIDHYLGKETVLNLLALRFANSLFASNWDNRTIDHVQITVAEEVGIEGRWGYFDQAGQMRDMIQNHLLQILTMIAMSPPADLSTDRIRDEKVKVLRSLRRIDHTNVRETTVRGQYTAGFVQGNKVPGYLEEEGANKNSNTETFVSIRVDIDDWRWAGVPFYLRTGKRLPSKCSEVVVYFKNPALNLFRESYQQLPQNKLTIRLQPDEGIEIEVLNKVPGLEHKHRLQTTKLDLSFSKTFNEQHIADAYERLLLETMRGIQALFVRRDEVEEAWKWVDSIMNAWAADNEAPKPYQSGTWGPVASVAMITRDGRSWNEFE

SEQ ID NO: 27045 - protein, 476 aa, Vitis vinifera
MLMLMNGYWLMGVADIPGLPLIGNLLQLKEKKPHKTFARWAETYGPIFSIRTGASTMIVLNSSEVAKEAMVTRFSSISTRKLSNALKILTFDKCMVATSDYNDFHKMVKGFILRNVLGAPAQKRHRCHRDTLIENISKYLHAHVKTSPLEPVVLKKIFESEIFGLALKQALGKDIESIYVEELGTTLSREEIFAVLVVDPMAGAIEVDWRDFFPYLSWIPNKSMEMKIQRMDFRRGALMKALIGEQKKRIGSGEEKNCYIDFLLSEATTLTEKQIAMLIWETIIEISDTTLVTSEWAMYELAKDPNRQEILYREIRKFCGSNKVTEENLSKLPYLNSVFHETLRKYSPAPIVPVRYAHEDTQLGGYHIPAGSQIAINIYGCNMNKKQWENPEEWKPERFLDEKYDLMDLHKTMAFGGGKRVCAGALQAMLIACTSIGRFVQEFEWKLMGGEEENVDTVALTSQKLHPMQAIIKARE

SEQ ID NO: 27046 - protein, 161 aa, Musa balbisiana
SSMMVSSAATVSRASPAQSSMVAPFTGLKSTSAFPITRKANADLSHLPSNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 27047 - protein, 156 aa, Spiroplasma citri
MDIKILAIGSLDKKYLVIGCETFLERIKHYAKLEIIELKEVNNKTEQVTINEQTALVIKKLLDYPEYYKILLASQGQILTSEQIAAYITEVKDFKKAKLLFIIGGSHGFNNNELLPKVNFHLSFGAITLPHQLCRLVLLEQIYRSFKIINNEIYHK

SEQ ID NO: 27048 - protein, 141 aa, Triticum aestivum
MATVLSSLRLPFSVCPAAPSAPMASRVALPPSSTAARGMRLRAQATYKVKLITPEGEVDLEVPDDVYILDHAEEEGIDLPYSCRAGSCSSCAGKVVSGQLDQSDQSFLDDDQIEAGWVLTCAAYPTSDLVIETHKEEELTA

SEQ ID NO: 27049 - protein, 466 aa, Pseudomonas fluorescens PfO-1
MSNYDVVILGGGPGGYNAAIRAGQLGLKAACVEGRATLGGTCLNVGCMPSKALLHASELYEAALGAEFANLGIEVKPTLNLAQMMKQKDESVSGLTKGIEFLFRKNKVDWIKGWGHIDGPGKVSVTGDQGSRIELTAKDIVIATGSEPTPLPGVEIDNKRILDSTGALSLSEVPKHLVVIGAGVIGLELGSVWRRLGAQVTVVEYLDRICPGVDGEAGKTLQRSLSKQGISFKLSSKVTSATSSANGVQLSVEPAAGGSAEILEADYVLVAIGRRPYTQGLGLENVGLSTDKRGMLANKQHRTEAPGVWVIGDVTSGPMLAHKAEDEAMACIEQIVGKAGEVNYDLIPNVIYTRPELASVGKTEEQLKAEGRAYKVGKFPFTANSRAKINHETEGFAKVIADERTDEVLGVHLVGPSVSEMIGEFCVAMEFSASAEDIALTCHPHPTRSEALRQAAMNVEGMATQM

SEQ ID NO: 27050 - protein, 645 aa, Sulfitobacter sp. EE-36
MEGFLFQASIYLAAAVIAVPIASRLGLGSVLGYLAAGILIGPAFGLVGSETKDLQHFAEFGVVMMLFLIGLELEPRALWNMRHRLLGLGGMQVVLSAAALMGIAMAYDQPMGVAIAIGLTLSLSSTAIVLQTLSEKGLMQTAGGRSVFSVLLTQDIAVIPILAFLPLLVAQLPAQMRPDGSISVNPEDAAHGAEAASGHGPAAAGHGAETAQAAISLVQGLPGWAITLVTLGAIAGIIITGVFFTRPVFRFIHAAKLREMYTALALLIVVGISFLMMLVGLSPALGAFLAGVVLASSEFRHELETDLEPFKGLLLGLFFITVGAGINFDLLFADTIIIVGMALLVILVKGLILYGLGTLFKLQGRDRWLFALGLAQAGEFGFVLVSFSVATGVMPNDVAETLLLVVALSMLITPLLFITYDQISKRMDTKSGPIVADEIDEQGTVIIAGVGRFGQIVNRLVQASGFRTVVLDHNPETIAVMRRFGFKAFLGDPTRADILRKAGLRDAKVLVVALDDPKSALQLIAYARKERPDLHIVTRAHDRTDVYQQYQAGANDIVREMFDSSLRAGRYVLENLGLSDYEAAEAQRMFYSHDRASVRELAALWRPDIPPSENKAYVARAKELQKDLETAFLNRIDQEDKTQGS

SEQ ID NO: 27051 - protein, 525 aa, Trametes sp. AH28-2
MGKLQSFVNVVALSLSLSRGVLGAIGPVTDLTISNADVTPDGFTRAAVVANGVFPGPLITGNKGDNFQINVIDNLTNATMLKTTTIHWHGLFQHGTNWADGPAFVNQCPIASGNSFLYDFTVPDQAGTFWYHSHLSTQYCDGLRGPLVVYDPSDPYASMYDVDDDTTVITLSDWYHTAAKLGPAFPPNADSVLINGLGRFAGGNASDLAVITVEQNKRYRFRLVSLSCDPNFTFSIDGHNMTIIEVDGVNHEPLEVDSIQIFASQRYSFVLNATQSVDNYWIRAIPNTGTIDTTGGLNSAILRYSGADIVDPTANATTSVIPLVETDLVPLDSPAAPGDPVVGGVDLAMNLDFSFNGTNFFINNETLIPPTVPVLLQILSGAQSASDLLPTGSVYTLPLNSTIELSFPITTVNGVTNAPGAPHPFHLHGHAFSVVRSAGSSDYNYVNPVRRDTVSTGNPGDNVTIRFTTDNAGPWFLHCHIDFHLEAGFAIVFAEDTPDTASVNPVPTAWSDLCPTYDALDPSDH

SEQ ID NO: 27052 - protein, 311 aa, Pediococcus pentosaceus ATCC 25745
MLMNNLKAQPVIISTDPGIDDAVAISLALFSNDIDVKLICPIAGNVSLEKTTHNTQKLLTFFNKEIPIVPGSPSPLLRQKQNASNVHGESGMDGFDFPIPKITPDVSRTAVQAMHETVSNSTVPVTLMGLGPLTDIALYLHLYPQDSKNIHEIVLMGGALGRGNLGVLSEFNFGVDPEAAKIVFNSNISIRIVPMEIGRQAKIMPATSEKIKNLGKTGKMFYSLFSHYRGGSFDKGLNMYDVLALGLILKPEIFEMKSTYVAIETQGAFTAGASLIDLKGYLGENSNAEVAINVDTKQFEDWFTKMISKTI

SEQ ID NO: 27053 - protein, 414 aa, Thermus thermophilus HB27
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDTALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 27054 - protein, 234 aa, Zea mays
  misc_feature (82)..(82): Xaa can be any naturally occurring amino acid
GPIASRKFFVGGNWKCNGTGEDVKKIVTVLNEAEVPSEDVVEVVVSPPFVFLQQVKGLLRLDFAVAAQNCWVRKGGAFTGEXQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKP

SEQ ID NO: 27055 - protein, 443 aa, Salmonella enterica subsp. enterica serovar Typhi str. CT18
MSSVKKIGLFACTGVVAGNMMGSGIALLPANLASIGGIAIWGWVISIIGAMSLAYVYARLATKNPQQGGPIAYAGEISPAFGFQTGVLYYHANWIGNLAIGITAVSYLSTFFPALNNPIPAGIACIAIVWLFTFINMLGGAWVSRLTTIGLFLVLIPVVLTAVAGWHWFAIATYHANWNTSTTTDSHAIVKSILLCLWAFVGVESAAVSTGMVKNPKRTVPLATMLGTALAGIIYIAATQVIAGMFPASVMASSGAPFAISTSTILGGWAAPLVSAFTAFACLTSLGSWMMLVGQAGVRAANDGNFPKIYGEMDKNGIPKKGLLLAAVKMTALMILITIMNSSGGKASDLFGELTGIAVLLTMLPYFYSCVDLIRFEGFNIRNSVSLICSVLGCAFCFIALMGASSFELSGTFIVSLIILMFYGRKMHQRQNNDSDNNTAEAL

SEQ ID NO: 27056 - protein, 557 aa, Moritella marina
MRQKTATITRRDKSFTGHYVPVKPTPIKDPEYVAHSKNLFSELGFADSMAESADFVRMFSGDMSGVPVPMRQVGWASGYALSIYGTEYTQQCPFQTGNGYGDGRAISVLETLIKGQRWEMQLKGGGRTPYCRGADGRAVLRSSIREFLAQDHMHALGVPTSRSLSLYVSKTETVKRPWYSQGSRSENPDMLISEAVAISTRVAPSFIRVGQLELFARRSRSNEHPKAMEELEKIVLHLIDREYADVIDTQLATPEKIVLLAREFRGRLTSMVANWIRVGFCQGNFNSDNCAAGGFTLDYGPFGFCDVFNPYYQPWTGGGNHFSFMNQPNAAQRNFDMFCSALRPLLVSHQQDLLAFDEIQSEFLAVMDTKMKAMWATKLGLINLKTESDKALCNVLIKELQTLMMQAPVDYTIFFRELSSIPDDIGPLKKSFYSNLYNDAADDPDTLALEKYWIEWLEKWQMLLNSTCDAKGISSRASEDIAMQMKLVNPKYVLREWFVMPAYQQATAGDYSLIQELQAVMTQPYAEQSKELEDKYYRLKPLEFFEVGGLSHLSCSS

SEQ ID NO: 27057 - protein, 365 aa, Medicago sativa
MGSTGETQITPTHISDEEANLFAMQLASASVLPMILKSALELDLLEIIAKAGPGAQISPIEIASQLPTTNPDAPVMLDRMLRLLACYIILTCSVRTQQDGKVQRLYGLATVAKYLVKNEDGVSISALNLMNQDKVLMESWYHLKDAVLDGGIPFNKAYGMTAFEYHGTDPRFNKVFNKGMSDHSTITMKKILETYTGFEGLKSLVDVGGGTGAVINTIVSKYPTIKGINFDLPHVIEDAPSYPGVEHVGGDMFVSIPKADAVFMKWICHDWSDEHCLKFLKNCYEALPDNGKVIVAECILPVAPDSSLATKGVVHIDVIMLAHNPGGKERTQKEFEDLAKGAGFQGFKVHCNAFNTYIMEFLKKV

SEQ ID NO: 27058 - protein, 257 aa, Stellaria longipes
MGRKFFVGGNWKCNGTQESVSKIVDTLNEPTIAANDVVTVVVSPPYVFLPDENAELKHEIQVAAQNCWVKKGGAFTGEVSAQMLANLGITWVILGHSERRTLLGESNEFVGKKAAYAQSEGLGVIACIGELLEEREAGKTFDVCFKQLKSFARFPAKPWDNVVVAYEPVWAIGTGKVASPEQAQEVHVAVRDWLKTNVSEEVASKTRIIYGGSVNGGNSLALAAQEDVDGFLVGGASLKGPEFATIINSVTAKKVAA

SEQ ID NO: 27059 - protein, 222 aa, Oryza sativa Japonica Group
MATASSLFLASPVATAPTARARSTPSASPARPSLRLRRPSTFAAAAVQAEHQPAVAAAPKPPALPFRVGHGFDLHRLEPGLPLIIGGIDIPHDRGCDAHSDGDVLLHCVVDAILGALGLPDIGQIFPDSDPRWKGADSSVFMREAVKLMHEAGYELGNLDATLILQKPKISPFKETIRSNLCDLLGADPSVVNLKAKTHEKVDSLGENRSIAAHTVVLLMRK

SEQ ID NO: 27060 - protein, 367 aa, Triticum aestivum
MERVLTALMDLVVPPASMVMLAFAWPTLSFLRALEWALKALTKEDMRGKVVLVTGASSAIGEQVAYEYARRGANLVLVARREHRLFAVRENARALGAGHVLVVAADVVREDDCGRLVADTISYFGQLDHLVNTVSLGHDFLFEEAGDTAAFPHLMDINFWGNVYPTYAALPYLRQSHGRVVVNASVDTWLPMPRMSLYSAAKAAVVDFYETLRYEVKDEVGITVATHGWIGGEPGAGTGIGTSRQWTKADTTPPLPAPGGQAVEEYARAVVDGACRGDARVRRPGWYDVFHVFRAFAPDVLGWTFRLLLSTAPAPPTVAGTGRRALVVAPVGAPAAALPAPPVRPLIEYPAAVAGRRPAAAQLHKLE

SEQ ID NO: 27061 - protein, 530 aa, Burkholderia pseudomallei K96243
MTDLATKPTPAASHGTLPRILPVILAGGSGTRLWPLSREHHPKQLIDLIADESPLSATARRLTGIANAELADALLLVCGEQHRFTSAAQVSARGLDARILLEPAARNTAPALTLAALEALAHHGDPVLAAMPADHAVSDTRAFQETIALAARYAQDGAIVTLGVLPRRAETGYGYIKVGAPLAGANGDTGGYAIDSFVEKPHQELAQQYLQSGDYWWNSGIFVVRASTWLAAIRALQPDMHAACEAAWRGGTSEGAFFKADAAAFAACPSDSIDYAVMERLTGARALGIPGVIVPLTAGWSDVGSWDAIWELLPKDEAGNVARGEVLFEGTEDSFARSEGRLVACVGLKDVVVVETPDAVLVANKHRVQDVKTVVARLKSGRHEQVRDHRKVQRPWGYYDSIDRGERFQVKRIVVDPGKQLSLQMHYHRAEHWIVVRGTAKVTRGDETFLLSENESTYIAVGAVHRLENPGRIPLEIIEVQSGDYLGEDDIVRFDDRYGRASTQHAPDAAKPADAERAPAAGPARALGAQ

SEQ ID NO: 27062 - protein, 354 aa, Pyrococcus furiosus DSM 3638
MDGSGGGFPPSGVPAAARNFIWVVTMHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 27063 - protein, 463 aa, Robiginitalea biformata HTCC2501
MSSFDVLVLGSGPGGYVTAIRASQLGFKTAIVEKESLGGVCLNWGCIPTKALLKSAQVFEYLQHAGDYGLSVEGADKDFGAVVKRSRSVADGMSKGVQFLMKKNKIEVLQGYGTLKPGKKVSVKDADGKETTYEASHIIIATGARSRELPSLPQDGKKIIGYREAMTLEKQPKKMIVVGSGAIGIEFAYFYNAMGTEVTVVEFLPNIVPVEDEEVSKQLERSFKKAGVKVMTSSEVTKVDTSGDGVKATVKTSKGEQTLEADIVLSAVGIKTNIENIGLEDVGIATDRDKIMVNDYYQTNIPGYYAIGDVTPGPALAHVASAEGILCVEKIAGMHVEPLDYGNIPGCTYCMPEVASVGMTEAQAREAGYDVKVGKFPFSASGKAKASGNPDGFVKVIFDAKYGEWLGCHMIGAGVTDMIAEAVVGRKLETTGHEILKAVHPHPTMSEAVMEAVADAYDEVIHL

SEQ ID NO: 27064 - protein, 335 aa, Borrelia burgdorferi B31
MLMNRKISIAPMVNITDEHFRYLIRLLSKKVTLYTPMISAKSIIMGDVKKIVKQNPLESPIAIQIATNSKNDALKAIQILEKHFNFDEYNLNVGCPSLKIQNANCGACLMGNANQVGEILKTMKENTNKPISIKHRLGIRPLSSDYKNESYSEVKNFVKIISDFGIKNFIVHARIAILKGFSPKNNRNIPKLRHEFVYKLKKENKNLFIEINGGINNSEQIKKHLSFVDSVMIGRSAFENPYFIANASREFLNETDEILTRKDILMQMVEYIKEYENYLSINILFKHLMGIVFSKEGAKKFRQNLTAPFPKNLKKHEILLKAIETLPEKILNSNS

SEQ ID NO: 27065 - protein, 163 aa, Nocardioides sp. JS614
MLEFDVLVEIPKGQRNKYEVDHESGRIRLDRTLFTSTQYPADYGYIENTLGLDGDPLDAMVILQEPTFPGCLIRCRAIGMFRMTDEAGGDDKVLCVPATDPRLEHLRDISHVSKFDRLEIQHFFEVYKDLEPGKSVEGAEWVGRTEAEAEVHASFARLKEEGH

SEQ ID NO: 27066 - protein, 326 aa, Lactococcus lactis subsp. lactis Il1403
MTVLVLGGAGYVGSHAVDMLLKRGYDVAVVDNLVTGHRESVPANVRFYEGDVRDQAFLADVFEKENIEGIMHFCAYSLVGESMQKPLMYFNNNVGGAQVILETMEEFGVKHIVFSSTAATFGIPEKSPISEKTPQKPINPYGESKLIMEKMMKWQSQATDMTYVALRYFNVAGAKDDGSIGEAHKNETHLIPIILQTALGQREFITIYGDDYHTPDGTCIRDYIDMEDLIEAHIKALEYLKAGGQSDQFNLGSSKGYSNLEVLETARKVTGKEIPSQMGERRAGDPDELVADSTKAGEILGWKAQNDLEHIITNAWKWHQSHPKGY

SEQ ID NO: 27067 - protein, 161 aa, Musa balbisiana
SSMMVSSAATVSRASPAQSSMVAPFTGLKSTSAFPITRKANADLSHLPSNGGRVQCMKVWPIEGKKRFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 27068 - protein, 398 aa, Carboxydothermus hydrogenoformans Z-2901
MEYKELIEKESKYLMQTYRRKPVYLVSGKGSYVYDDAGNKYLDLVAGIAVNTLGYAHPKLTAAVETAVKTLHHTSNLFYTRPQVELAQKLVENSPFDRVFFANSGAEAVEGAIKLARKYWWQKGEEKYEIISAVNSFHGRTMGALSATGQEKYQKPFRPLVPGFVYVPYNDLNALEKALTSKTAAVILEPVQGESGVNPADPAYLQKVAELCREKNILLIFDEVQTGVGRTGKLFAFEHFGVVPDIITLAKGLAGGVPIGAVLAKEEVAKAFEPGDHASTFGGNPLACTAALAVLEEVLAPGFLEEVLDKGKLFYTLLADAPGIKEVRGYGLMLGIELNFPGAGRVSEILLAKGVLINNVGEWILRIVPPLIITREEIREASEKILLAVKEAGVDGAL

SEQ ID NO: 27069 - protein, 341 aa, Oryza sativa
  misc_feature (71)..(71): Xaa can be any naturally occurring amino acid
  misc_feature (95)..(95): Xaa can be any naturally occurring amino acid
MLVQPPNAVAVRATAAGKEPLFSFGVIADVQYADIPDGRSFLGVPRYYRHSLTVLQRAVRSWNAHNHKHPXVAGGGVRFCVNFGDIVDGFCPKDXRSLAAVQAVVAEFDRFHGPAYHMLGNHCLYNLPRSKLVSLLRMPSGRAYYDFSPFPGYRFVVLDAYDFSAVGWPRGHPVAAAARRFLDERNPNADKNSPSGLAGVDRRFVMFNGAVGEAQLRWLDGVLRGAARRREAAVVCSHLPLHPGAASPSGLMWNYEEVMRVVHRHGCVAACLAGHDHRGGYGVDARGVHHRTLEAALECPPGTDAFGRVDVYPDGLTLVGAGRMGSTDMRLQLHSPVTELS

SEQ ID NO: 27070 - protein, 399 aa, Lactococcus lactis subsp. lactis Il1403
MSIVVENSTVLSALTEKFAEVFGDTKEVEYFFSPGRINLIGEHTDYNGGYVFPASITIGTTGLARLREDKKVKLYSENFPKLGVIEFDLDEVEKKDGELWSNYVKGMIVMLKGAGYEIDKGFELLIKGEIPTASGLSSSASLELLVGVVLDDLFNLNVPRLELVQLGQKTENDYIGVNSGILDQFAIGFGEVKKAILLDCNTLKYEMVPVELRDYDIVIMNTNKPRALTESKYNERFAETREALKRMQTRLDIQSLGELSNEEFDANTDLIGDETLIKRARHAVYENNRTKIAQKAFVAGNLTKFGELLNASHASLKDDYEVTGLELDTLAETAQKQAGVLGARMTGAGFGGCAIALVAHDNVSAFEKAVGQVYEEVVGYPASFYVAQIGSGSTKLDVE

SEQ ID NO: 27071 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSRWIPCLEFSHEGFVWRENHRSPGYYDGRYWTMWKLPMFGCTDAVQVVKELEECKKEYPKAFIRIIGFDN

SEQ ID NO: 27072 - protein, 510 aa, Sulfitobacter sp. EE-36
MKDILEQLETRRDDARLGGGQKRIDAQHARGKLTARERIDLLLDDGSFEEFDMFVTHRCTDFGMEQQKPAGDGVVTGWGTINGRLVYVFSQDFTVFGGSLSQTHAQKICKIQDMAIQNGAPVIGINDSGGARIQEGVDSLAGYAEVFQRNIEASGVIPQISVIMGPCAGGAVYSPAMTDFIFMVKDTSYMFVTGPDVVKTVTNEQVTAEELGGATTHTRKSSVADGAFENDVEALAEVRRLVDFLPANNRDLPPVRPFFDEPDRIEASLDTLVPSNANTPYDMKELIHKLADEGDFYEIQEDFAKNILTGFIRIEGRTVGVVANQPMVLAGCLDIDSSRKAARFVRFCDAFEIPILTLVDVPGFLPGTGQEYGGVIKHGAKLLFAYGEATVPMVTVITRKAYGGAYDVMASKHLRSDFNYAWPTAEIAVMGAKGATEIIHRADLNDPEKIARHTADYEERFANPFVAAERGFIDEVIQPRTTRKRIARAFASLRNKKAAMPWKKHNNIPL

SEQ ID NO: 27073 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSKWIPCLEFCPKGFVWRENHRSPGYYDGRYWTMWKLPMFGCTDAVQVAKELEECKKEYPDAFIRIIGFDN

SEQ ID NO: 27074 - protein, 328 aa, Staphylococcus aureus subsp. aureus Mu50
MKENFWSELPRPFFILAPMEDVTDIVFRHVVSEAARPDVFFTEFTNTESFCHPEGIHSVRGRLTFSEDEHPMVAHIWGDKPEQFRETSIQLAKMGFKGIDLNMGCPVANVAKKGKGSGLILRPDVAAEIIQATKAGGLPVSVKTRLGYYEIDEWKDWLKHVFEQDIANLSIHLRTRKEMSKVDAHWELIEAIKNLRDEIAPNTLLTINGDIPDRKTGLELAEKYGIDGVMIGRGIFHNPFAFEKEPREHTSKELLDLLRLHLSLFNKYEKDEIRQFKSLRRFFKIYVRGIRGASELRHQLMNTQSIAEARALLDEFEAQMDEDVKIEL

SEQ ID NO: 27075 - protein, 276 aa, Triticum aestivum
  misc_feature (19)..(19): Xaa can be any naturally occurring amino acid
  misc_feature (31)..(31): Xaa can be any naturally occurring amino acid
KEEKLCVLPSEASAMGILXLIMLCGLYVIHXVWAAAEAYSAPSIVLTSRSHNGLHVYDDFRESYAWLRHNTEVDDKVASWWDYGYQTTAMANRTVIVDNNTWNNTHIATVGTAMSSPEKGAWEIFNSLDVKYVLVVFGGLSGYPSDDINKFLWMVRIGGGEFPHIKEQDYLRDGNYRVDAQGTPTMLNCLMYKLCYYRFAETDGKGFDRARRYEIGRKHFKLTHFEEVFTTQHWMVRIYKLKPQKNRVRGKLKLKLKYSSKTSLMRKGAGKKNPWQ

SEQ ID NO: 27076 - protein, 300 aa, Streptococcus pyogenes SSI-1
MMTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 27077 - protein, 342 aa, Thermus thermophilus HB27
MLDPRLSVAPMVDRTDRHFRFLVRQVSLGVRLYTEMTVDQAVLRGNRERLLAFRPEEHPIALQLAGSDPKSLAEAARIGEAFGYDEINLNLGCPSEKAQEGGYGACLLLDLARVQEILKAMGEAVRVPVTVKMRLGLEGKETYRGLAQSVEAMAEAGVKVFVVHARSALLALSTKANREIPPLRHDWVHRLKRDFPQLTFVTNGGIRSLEEALFHLKRVDGVMLGRAVYEDPFVLEEADRRVFGLPRRPSRLEVARRMRAYLEEEVLKGTPPWAVLRHMLNLFRGRPKGRLWRRLLSEGRSLQALDQALRLMEEEVGEEGEKEKPGPRGQREAAPGLAREGV

SEQ ID NO: 27078 - protein, 561 aa, Kineococcus radiotolerans SRS30216
MTPAPAPDTSTTTVGGYLGRRLEQLGVGHVFGLPGDFNLALLDEVLAATGLRWVGSSNELNAGYAADGYARLRRGPAAVVTTFGVGELSAVNALAGSYAEDVPVVHVVGLPPTTAMSRGALLHHSLADGDFGHFVRIAAEVTASAVVVRAQGATTAIDQALLTAVGTSKPVYLGVPADVAVHPVPAAPLSRPLRVLRSDAGAAEEFRTALAQFLGDAPEVTVLAGPRLHRRNLEDLVRAIAAQNGVRVATQSASKAMLDESHPANLGVYAGEFTRSARTRRAVDGARPLVLAGVLMSDFLTGSFSHAFDPEASVDLQLDHARIAGTAFYGLYLEESLRILEEVLDARSPRPGPLPRQEVPALAPHVPAEPDGPLTHADLWPLLQRWLNPGTLLVAEAGTSFYGALELTTPDGCDLLGQPVWSSIGYTLPATLGAMLARPGRETVLVIGDGSAQLTIQELGRILAEGLTPTILLVNNSGYTVERAIRSPEAVYQDVVAWDWTKLPAALGSPGTPTYRAATPADLVEVLGKVRADPDHAAFVELLLPRDDAPDSLVQLARSVR

SEQ ID NO: 27079 - protein, 149 aa, Zea mays
  misc_feature (102)..(102): Xaa can be any naturally occurring amino acid
ARNSARADPGLLLPRANLTFWRDGSIVRERNAMLPTISSKDWLDIDFGIAEGVDFIAVSFVKSAEVIRHLKSYIAARSRGSDMAVIAKIESIDSLKNLGEIXRASEAPCSQGDMGAQIPGAVPRSARSSVSALTSVMRSSLLESMIEYP

SEQ ID NO: 27080 - protein, 410 aa, Glycine max
  misc_feature (199)..(199): Xaa can be any naturally occurring amino acid
MQPQRLRQHAMLQPSLYHHPALLTPPQIEPILSGNLPPGFDSSSCRSVYVGNIHPQVTDSLLQELFSTAGALEGCKLIRKEKSSYGFVDYFDRSSAAFAIVTLNGRNIFGQPIKVNWAYASSQREDTSGHFNIFVGDLSPEVTDATLYACFSVYPSCSDARVMWDQKTGRSRGFGFVSFRNQQDAQSAINDLTGKWLGXSQIRYNWATKGASASDEKQSSDSKIVVELINGSSEEGQETTNDDTPEKNPQYTTVYVGNLAPEVTSVDLHQHFHSLNAGIIEDVRVQRDKGFGFVRYSTHAEAALAIQMGNARILFGKPIKCSWGSKPTPLGTASTPLLPPSANVPGFSLAGLAAYERQMALSKMGGAHTLMHQQGQHALKHVDMGMGATGTGFDARFQNVATTQHLVYYQ

SEQ ID NO: 27081 - protein, 281 aa, Oryza sativa Indica Group
MAATLSQLDDGIVRGMAIGAVFTDYAGKINCLDFHRKEDLLVTSSEDDSIRLYNITSATLLKTTYHRKHGADRVCFTHHPSSILCSSRYNLESAESLRYLSLYDNRCLRYFKGHKDRVVSLCMSPVNDSFMSGSLDHSVRIWDLRVNACQGPFDTFLVGGDTAEVSDIKFSNDGKSMLLTTTNNHIYVLDAYGGDKRCGFSLESSPNVATEAAFTPDGQYVISGSGDGTLHAWNINTIQEIACWNSHIGPITALKWAPRRAMFATASTALTFWIPNNSSSN

SEQ ID NO: 27082 - protein, 481 aa, Pseudomonas sp. HR199
MSILGLNGAPVGAEQLGSALDRMKKAHLEQGPANLELRLSRLDRAIAMLLENREAIADAVSADFGNRSREQTLLCDIAGSVASLKDSREHVAKWMEPEHHKAMFPGAEARVEFQPLGVVGVISPWNFPIVLAFGPLAGIFAAGNRAMLKPSELTPRTSALLAELIARYFDETELTTVLGDAEVGALFSAQPFDHLIFTGGTAVAKHIMRAAADNLVPVTLELGGKSPVIVSRSADMADVAQRVLTVKTFNAGQICLAPDYVLLPEESLDSFVAEATRFVAAMYPSLLDNPDYTSIINARNFDRLHRYLTDAQAKGGRVIEINPAAEELGDSGIRKIAPTLIVNVSDEMLVLNEEIFGPLLPIKTYRDFDSAIDYVNSKQRPLASYFFGEDAVEREQVLKRTVSGAVVVNDVMSHVMMDTLPFGGVGHSGMGAYHGIYGFRTFSHAKPVLVQSPVGESNLAMRAPYGEAIHGLLSVLLSTEC

SEQ ID NO: 27083 - protein, 457 aa, Rhodococcus sp. DK17
MSYYATTSPLTGQRVQEFPRATDHEISDALTSSDAAYRQWRTSSLEERADVLRALAKLWHERADELAPILTLEMGKPIPQARGEVALCANIFEYYAEHGPTFMEDEVLEIAGGGEAIVRTEPIGPLVGIMPWNFPYYQVVRFAAPNIMLGNTLLLKHSRNCPQSALAIETLFVEAGLPEGVYVNVFADNAQVARMVADPRVRGVSLTGSERAGSAVGEIAGRHMKKFVLELGGSDPFIVLDDTDLDTTVAAAVNNRMANAGQACTASKRLIVLDDVYDRFLDKFTEAMRNIVPGDPTDPATTFGPLSSRSCVDEIAEQVDDALAKGAKLLTGGCRGEGPGAFYEATVLAGVTPQMRVYSEELFGPVAVVYKVATEAEAIALANESPFGLAAAIFTSDRNQARRVAEDLEVGMAWINGTSKSAPDLPFGGVKRSGVGRELGRYGFNEFANKKLVRTVR

SEQ ID NO: 27084 - protein, 199 aa, Zea mays
MRDAVVVMAVPGGGGGGGGSASSAAAAPCAACKLLRRRCAAGCVFAPYFPPGEPHKFANVHKVFGASNVSKLLQEIPAQHRGDAVSSLVYEANARVRDPVYGCVGAISSLQEQVEALQAQLALAQAEMVRLRMTNDYIVHRLKAASRAGGGGSSYAGSPSSMSSPKTAEPEAHCKATPELLDMVVDQPGMDDAHFWSSY

SEQ ID NO: 27085 - protein, 173 aa, Triticum aestivum
  misc_feature (27)..(27): Xaa can be any naturally occurring amino acid
  misc_feature (34)..(34): Xaa can be any naturally occurring amino acid
  misc_feature (53)..(53): Xaa can be any naturally occurring amino acid
MAQRDKKVEEPTEVHLHAAEITLCANXSCGFPGXNPATKDLCQDCFLASSSSXSPSAASPQSPSSSPAAFPLFDKPRPAAAASPLQAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 27086 - protein, 309 aa, Debaryomyces hansenii CBS767
MVELTDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGADMVKRFLNQLVKGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPSEETWPDVSYLPDFKSTFPKWSKKNLAEFVPTLDEDGIDLLEQMLVYDPSGRISAKRALIHPYFQEDGENYDSYPRSVNMG

SEQ ID NO: 27087 - protein, 358 aa, Zea mays
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 27088 - protein, 211 aa, Triticum aestivum
MSQEDSTSAQSRPAPKLNERILSSLSRRAVAAHPWHDLEIGPGAPAVFNVVVEITKGSKVKYELDKKTGLIKVDRVLYSSVVYPHNYRFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTAREAIQYSRDLYAQYILQSLRQ

SEQ ID NO: 27089 - protein, 128 aa, Nocardioides sp. JS614
MTERPTDELSVTGIACYGHHGVFDFERREGQTFVVDLVLGVDTAPAAASDDLQDTVDYGSLVASVQAAVEKDPVDLIETLAQRIAGVCLLDGRVEWARVTVHKPDAPIEATFADVTLTITRRREGTRD

SEQ ID NO: 27090 - protein, 368 aa, Borrelia burgdorferi B31
MRLNAGIVGLPNVGKSTLFSSLTSSNVEIANYPFCTIEPNIGIVEIPDERLLKISECIIPRKIIPAVMEFVDIAGLVKGASTGEGLGNKFLANIREVSLIVHVVRCFEEKEVIHINDDINPEKDITTINVELCLSDLETVQKSLQKQEKNAKSTDKKISESSKAIVLMLKRLEDHLSNMNPAVEFKFDDFEYNFIRSLNLLTFKKVLYVCNVDENSLSGNKYTDIVKNIALKEGNDFLILCAKIEAELAQIKDISYKNEMLKLFGINDSGLGNLIKKAYYTLGLRTYFTAGLQEVRAWTFKQGMRAPKAAGIIHSDFERGFIKAEVYSCEDLFKFQSVQKLKEKGLVRIEGKEYIVRDGDVIFFKFNV

SEQ ID NO: 27091 - protein, 438 aa, Ustilago maydis 521
MASQAGGPSDSLSALRTSKLSTVVLDNHSSSGISSNIRLHPLPILNISEHLVRTRLQSEDAQLTVYGVLLGTQQGRDIDIQNSFEIRLDAASSTSLAPIINHAFLRSRQAQYKQVFPTLDLLGWYTVGEVPTPQDLEVHKQLLAYNETPLLVQLHQTVASFENAEANGELPIRVYESVVELVQGETTNFFVPAGYKIETGEAERIAVDYASKAGAESGGDHDSMLAGMQAQHSAITKLNDRIRQVLTYLEAVKDGQAGWDHQALRQIQTVVANLPQTVLPELQEELLRVSVMLLDLGLSMYRRSSHHVDSVSITFRVADSRSLLLYGIQEHNDVLLTNYLSVLTESLHTMNELSDKFEVVQAAGKEDGVNAGILGTSKSGAQGRRGGPVLRSVHSLSHDRLWEKLGMDTRKARVDAAECLIAGQVTKISAGFYIKDYT

SEQ ID NO: 27092 - protein, 363 aa, Yersinia pseudotuberculosis IP 32953
MTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLILLLRFSLGKDDAADAIERAINQALEQGYRTADLAGDGHAIGTHEMGDIIAKFVVEGV

SEQ ID NO: 27093 - protein, 1162 aa, Candida albicans SC5314
MSHIDGDDHMTKDLIDSLESKDNDLSLVTSNTQIPDVEVANLTHDADEINQLFDTATNNVLPESNKKDKPIDTQDLHEDDPKAVPKTTSNGESTSNSNSVSPKLLPNDGKSTPKIQKELRRKSTFVPVTSNSKSLEPSEDDNNNNNNNNNNSRISAYARLDFENFTFFVQTLQVVLGRKSNDETLQQNVDVHLSSKKAISRRHAKIFYNFGTQRFEISILGRNGAFVDNVFVEKGLTIPLTDGNKIQIGDIPFKFVLPSNEPNEENNNQDSSEKQFNPSDAINLRSNLYSKSSSPQSSPKRKSQPSKKVKKEPVSASNTPKDIKPTPPVPTTAISPTTSSSSPTASISTSTNAATAATTTTPATTTAARKNSINRRNSLLKIRRLSNARRKSLAANDEINELLKDLGVTSIDEINEEDSELLDAQIQSLLDEDNENLGGIEDSLMKLAEFNESAIDDDDDEEEGNENSQADLDRLEKTMEHDAIDDEIKAIDSNLTLLDDEISKLTPLINDTNQGLLEEKETKKKQLEEEKRKKQLQQLQHKNSLAKFPRRSAPLMGKPASIQPPASSSIYSRINGLDKIGKTVSPRPPPPKLIAPVLRVTAEPSAIRSRPPLRAITVSDSSYIATFSYPKTIEEPSKYPKPKVKKEHHKKHSKKVYSLDEIPEPYRSKPNISFQIMITNVLKTEAARNGLIINEITEAIKEVYPYYKYCTDGWQFSINHCIKFTKIYKRLQKRGSEWLYAMDELYINERENIRIKQREIAKAKAKAEALRQEEIRQRQRLEAQKSLPHNIVGRNFASPYANTRVPPNQYNQFSQSSSSSSSSATTTTNGQYGSTTMVGGTSPQAGSIRAQLAAVRGNGNTPATTSTTPSLPAMNDPKTKKSLEYLQKELFTLYKARKLTYDTQTATSLITKAVATTIAQVNSIGAKAGAGDNALVFLVERAPEKVSKILDIALTKSIKEYEGIASKSPSQPATPGMRPAQLTTTSQSAATPTTTPQISNLQSLPVKPPISTPLPQVPQQQVSGVNIPGPIATPNIGVTSGVGNLGTTSIGTPTPTQIQSPATSVIPAMQSPQKPVSTPIPTSVPVPLPVPSAPLARPPSFGKPPGAGSSLSRPKAFGKPPGAGSSLSRPPTFLSNKPSYKRELEDDEEEGEQATNKIAKTE

SEQ ID NO: 27094 - protein, 428 aa, Carboxydothermus hydrogenoformans Z-2901
MSEIREVIAREILDSRGNPTVEVDVILEDGTWGRAAVPSGASTGAFEAVELRDNDPQRYLGKGVTQAVENVNSIIGPEILGFDALDQVGIDEYLIELDGTPNKGKLGANAILGVSMAVAKAAANYLGLPLYRYLGGTNARVLPAPMMNILNGGKHADNNVDIQEFMIMPLGASSFSEALRMGAEVFHNLKKVLKGKGYNTAVGDEGGFAPNLKSNEEAIEVIVEAIEKAGYTPGKDIYIALDVAATELYKDGFYVLEGEGVKKSAAEMVEYYEKLCAKYPIISIEDGMSEEDWDGWKLLTERLGKKIQLVGDDLFVTNVERLQKGIDLGVANSILIKLNQIGTITETLNTIELARQNGYTTIISHRSGETEDTTLADLAVAVNAGMIKTGAPSRTDRVAKYNQLLRIEEELDYTAIYKGLKAFYNIKA

SEQ ID NO: 27095 - protein, 527 aa, Borrelia burgdorferi B31
MEEYLNFMNNNKETKLKDLENQEFDLIIIGGGATGLGIAVDAITRGYKAILIEKFDYAKGTSSRSSKLIHGGVRYLAQWNISLVKEALREKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMMEKLNKSEEWKNEQIKNFLEISKKYLI

SEQ ID NO: 27096 - protein, 108 aa, Triticum aestivum
NVALFDLVELLQTGERTANIMKHLFPVPKPESKRLITFANRDDYISFRHHIYEKHGGPKSIDLKEVGPRFELRLYQIKRGTMDQSEAQNEFVLRPYMNTAKKQKSLGV

SEQ ID NO: 27097 - protein, 175 aa, Mycobacterium smegmatis str. MC2 155
MTSPIQTATATLHTNRGDIKIALFGNHAPKTVNNFVGLAQGTKDYSTENASGGTSGPFYDGAVFHRVIDGFMIQGGDPTGTGRGGPGYKFEDEFHPELQFDKPYLLAMANAGPGTNGSQFFITVGKTPHLNRRHTIFGEVVDEESQKVVDAIASTPTDRSDRPTEPVVIESITIA

SEQ ID NO: 27098 - protein, 291 aa, Xanthomonas oryzae pv. oryzae KACC10331
MSSALFDHWIARTERNLEAGLPSATCAPHRLHAAMRHAVLGGGKRMRPLLVYASGALFGAAEDQLDTPAVAVELIHTYSLVHDDLPAMDDDALRRGQPTVHIAFDEATAILAGDALQTRAFELLAAASASAELRVGWMQSLATAAGAAGMCGGQALDIDATGQLQPLQDLQRMHALKTGALIRASVHMGALTGGAATADQQRLDEFADALGLAFQVRDDILDVESSSAQLGKTAGKDAAQSKSTYPALLGMDGAKAKLAELATRMHDVLQPYGQPGETLASLGRFAVDRAH

SEQ ID NO: 27099 - protein, 475 aa, Zea mays
MEPLLCAAVWAVTLAVAMAWAYRWWSHPKANGQLPPGSLGFPLLGETLQFFAPNPTCDVSPFVKDRLDRYGNIFKTSIVGRSVVVSADLLNYYVFQQEGKLFESWYPDTFTEIFGRDNVGSLHGFLYKYLKTLVLRLYGQENLRAVLLAETHRACRASLASWATRPSVELKDAISTMIFDLTAKKLISYEPSKSSEDLRKNFVAFIRGLISFPVDIPGTAYHECMQGRKKAMKVLRTMMRERMPHPGRQNEDFFDVLIEELRREKPVMTEAIALDLMFVLLFASFETTALALTLGIKLLAQNPRVLRALTEEHEAIVSSRKDRDAGLTWAEYKSMTFTSQVTLEIVRLANIVPGIFRKALQDIEFKGYTIPAGWGVMVCPPAVHLNPEIYEDPLAFNPWRWQDKVEITGGTKHFMAFGGGLRFCVGTDLSKVLMATFIHCLVTKYSWRTIRGGNIVRTPGLSFPDGFHVQLFPKN

SEQ ID NO: 27100 - protein, 341 aa, Mycobacterium smegmatis str. MC2 155
MATRSIPAALPDYERMMAMLTGFWVTQIVRAAAVFNLADHLASGTDTAVAIASAEATDVDATRRLLRACATLGLVTSADGEHFAGTSLLSTLRKDEPNSLRGMVLSHTAPGHWLPWGLLPDAIRSGERQIKAAHGTETYFDYLAENLEQAGHFTEAMSNLSAAAAVEVAEVLDTRGVDYALDVGGANGELVRALMRANPELRGGVFDLPHVVADAVEAAHRDGLQGRFTARGGDFFESVPPADLYTLKYILHDWDDESCVRILKTCRAALQDGGRIVVIDHLVGDLDAADTTTMMDVNMLVMTGGRERDIAEFDALFAAAGLRRTEVGRAGQFAIIETVAV

SEQ ID NO: 27101 - protein, 348 aa, Zea mays
MAGILAWAADVVGGAGGSDDEADDDARAAASAAMTPAQRLRAADLDARAASLRRAIQDLRLRVPPPHVAQRLPHLHADSLASSAALALQLNAHSSTKEQTQQREVTLQEENAAYEKAISECKQKIQEKQMEATQLLSNLEEMEVTEHNLKTQLENALKELEAAQHKASTATSGTAENALLEAKSVTDLKSKDLEEKKRELELLDNKVQTLEKEWSVVEEESLKKPTPAQREKVLERQLHSLIEQLTAKQAQAEILATDVHSKEKELERLNHLHRNLYGGANETGAPRSRLSRGLLSGPEDYYYDPKAGRKPYQAGARTEGQNRLMILRSAIVLYVLLLHVIVFIKISV

SEQ ID NO: 27102 - protein, 373 aa, Pediococcus pentosaceus ATCC 25745
MKIKAAVVDQQNSDFKIKDDIELAEMGPDDIQVHMVASGICHSDEALRVGDAIIDYPIVLGHEGSGIVEKVGPEVTQFKPGDHVILSFYACGNCDNCLRGIPTQCRNYAANNLSGVRPDGSSHFTENGKHVADMFDQSSFTSTTVVRERNAVKIDDDIDLRKVGPLGCGYVTGSGTVLNTLQPRPGDTIAVFGTGAVGLAAMMAGKISGCTKVIGIDIVDSRLALAKELGATDIINSKNVDVVEEVKKLTGGLGVNWAVDTTGITKVMEDSIKVLTQGGTTATIAVTPNHIDLDTWNDLCVDDKKIVGVNMGDSIPQIDIPRLIEFYKAGMFDFDKTEKFFNFDEINEANAASRSGEVIKPVLIIDPDYVPGK

SEQ ID NO: 27103 - protein, 397 aa, Clostridium difficile 630
MSIIVQKYGGSSVADTEKIKSIAENIIERRKENPQMVIVVSAMGKSTDEYITLAKELSNEPSKRELDALMSTGEMISASLLSIALNALGCKAISYNAYQLNIKTSGLHGKSQIDDINVNRIKNSLDEGNVVIVTGFQGINEDGDVTTLGRGGSDTSAVALAVKLNGKCEIYTDVDGIYFTDPRKYSKASKLDEIEYEEMLELASLGAQVMHSRSIELAQKYGVEIYVGRTCGTEKGTYIRGGKDMKLEDKVITGLATSDDDSSITIKDFKAENISSLFEDIATIGISVDMISQTAPILDKISVSFTVPKEELGECKKIVSKYTDEEHVVIDNNITKFSLVGLGMKNTSGVAAKVFKIFNENGIMIKLITTSEIRITCAINSDDKQVAIEKIAEVFNI

SEQ ID NO: 27104 - protein, 750 aa, Oryza sativa Indica Group
MDPCTGSMNPARARGRGQPLRVYGPGPCTESDRILFVSSRLPRESFPPLKPIAAAAGASLSFWSNIIAQNPRLELLLGRLILESEEGMSGPLDRFARPCLVPCKALLFVILPKRLSHLSVAGFEGFTHNDEKKEIRSDADNSEGEKKTKIGSFKKKAINAGNKFRHSLRRRSKKKNEPRGSIEDIRDVQDLQAVDAFRQCLVDEDLLPQQHDDYHTMLRFLKARKFDVEKAKSMWSDMLKWRKEFGADNIEEFDYTEADEVMKYYPQFYHGVDKEGRPIYIELIGKVDANKLMQVTTIERYVKYHVKEFERCFQMRFPACSIAAKRPIDSSTTILDVQGVGLKNFSKAARDLITRLQKIDNDNYPETLRRMYIINAGQGFKMLWSTVKSFLDPKTASKIHVLGSKYQNKLLEIIDENELPEFFGGKCKCEAFGGCKKSDKGPWKDPNIIKRVLNGEANYGRQIVTISSTDGKIIRYAGPQYPTRKGSDGSAESGSEVEDGASPMASRNLITNPLLTPVHEEASCHASKLAAHGFTSASPSIIEESIPVVDKVVDDGWGSPRASSSPSRSLPITFDGLWTQVITWLTVLIVSLFAMVSSVPSRMAKRFSSQSTDHDHSYVEYPQEAEYKEEFRPPSPAPSYTEKDVLSSMVRRLGELEEKVQALETKPSEMPFEKEELLNAAVRRVDALEAELISTKKVYVKILLPYKKKVMKYFNFHEQALYEALMRQDELLAYIDKQDMIKFRKKKFCF

SEQ ID NO: 27105 - protein, 330 aa, Sorghum bicolor
MGEGTFGQVLECWDKERKEMVAIKIIRGIKKYRDAAMIEIGMLEQLGKYDESRSSCVQIRNWFDYRNHICIVFERLGPSLYDFLKKNNYRSFPIALVREIAKQLLECIAFMHELRLIHTDLKPENILLVSPEYIKVPDYKVSSRSPKEGSYYKRLPKSSAIKVIDFGSTTYDQQDQSYVVSTRHYRAPEVILGLGWSYPCDIWSVGCILVELCTGEALFQTHENLEHLAMMERVLGPLPYHMLKRADRHSDKYIRKGRLNWPEGCTSRESMKAVMKLSRLQNLVMQNVDQAAGDFIDLLQGLLKYDSADRLTAEEALRHPFFTEGFGQRR

SEQ ID NO: 27106 - protein, 609 aa, Pseudomonas syringae pv. tomato
MESRTSRRTFVKGLAAAGVLGGLGLWRSPSWAASGSPALSVLSGTEFDLSIGEMPVNITGRRRTAMAINGGLPGPLLRWKEGDTVTLRVRNRLDAATSIHWHGIILPPNMDGVPGLSFAGIEPGGVYVYQFKVQQNGTYWYHSHSGFQEQVGVYGPLVIEAKEPEPFKYDSEHVVMLTDWTDEDPVSLMRTLKKQSDYYNFHKRTVGDFVNDVADKGWAATVADRKMWAEMKMNPTDLADVSGATYTYLLNGQAPNMNWTGLFRPGEKLRLRFINGSAMTYFDIRIPGLKMTVVASDGQFVNPVEVDELRIAVAETFDVIVEPTAEAYTVFAQSMDRTGYARGTLAVREGLVAQVPPLDPRPLVTMDDMGMGGMDHGSMDGMSGMDSGADDGMQTMSSMGGDSMPAMDHSKMSTMQGMDHGAMSGMDHGAMGGMVMQSHPASENDNPLVDMQAMSPTAKLNDPGLGLRNNGRKVLTYADLKSTFEDPDGREPSRTIELHLTGHMEKFAWSFDGIKFADAQPLILKYGERVRIVLVNDTMMTHPIHLHGMWSDLEDEDGNFRVRKHTIDMPPGSKRSYRVTADALGRWAYHCHLLYHMEMGMFREVRVEE

SEQ ID NO: 27107 - protein, 469 aa, Bacillus subtilis subsp. subtilis str. 168
MEQTKKWGFWLLTAFVVGNMVGSGIFSLPSSLASIASPFGATSAWLLTGAGVLMIALVFGHLSIRKPELTAGPQSYARALFSDPKKGNAAGFTMVWGYWVASWISNVAIITSLAGYLTSFFPILVDKREMFSIGGQEVTLGQLLTFAVCTILLWGTHAILVASINGASKLNFVTTLSKVLGFVFFIVAGLFVFQTSLFGHFYFPVQGENGTSIGIGGQVHNAAISTLWAFVGIESAVILSGRARSQRDVKRATITGLLIALSIYIIVTLITMGVLPHDKLVGSEKPFVDVLYAIVGNAGSVIMALLAILCLFGTMLGWILLGSEVPYQAAKAGDFPAFFAKTNKKGSPVIALIITNVMSQVFIFSVISRTISDAFTFLTTAATLAYLIPYLVSAIYSLKVVIKGETYDQLKGSRVRDGLIAILACAYSVFVIVTGTADLTTFILGIGLFFVGLIVYPFVSNKFQKEKQA

SEQ ID NO: 27108 - protein, 628 aa, Salmonella enterica subsp. enterica serovar Paratyphi B str.
MAIEIKVPDIGTDEVEITEILVKVGDKVEAEQSLITVEGDKASMEVPSPQAGVVKEIKVSVGDKTETGALIMIFDSADGAADAAPAKAEEKKEAAPAAAPAAAAAKDVHVPDIGSDEVEVTEVMVKVGDTVEAEQSLITVEGDKASMEVPAPFAGTVKEIKVNTGDKVSTGSLIMVFEVAGAAPAAAPAKAEAAPAAAAPAATGVKDVNVPDIGGDEVEVTEVMVKVGDKVAAEQSLITVEGDKASMEVPAPFAGTVKEIKISTGDKVKTGSLIMVFEVEGAAPAAAPAKQEAAAPAPAAKAEKPAAPAAKAEGKSEFAENDAYVHATPLIRRLAREFGVNLAKVKGTGRKGRILREDVQAYVKDAIKRAEAAPAAAGGGIPGMLPWPKVDFSKFGEVEEVELGRIQKISGANLSRNWVMIPHVTHFDKTDITDLEAFRKQQNAEAEKRKLDVKYTPVVFIMKAVAAALEQMPRFNSSLSEDGQRLTLKKYINIGVAVDTPNGLVVPVFKDVNKKSVTELSRELTTISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM

SEQ ID NO: 27109 - protein, 415 aa, Saccharomyces cerevisiae
SLSSKLSVQDLDLKDKRVFIRVDFNVPLDGKKITSNQRIVAALPTIKYVLEHHPRYVVLASHLGQPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 27110 - protein, 474 aa, Salmonella enterica subsp. enterica serovar Paratyphi B str.
MSTEIKTQVVVLGAGPAGYSAAFRCADLGLETVIVERYSTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEIFEGSITDLPNPKAKKK

SEQ ID NO: 27111 - protein, 229 aa, Oryza sativa Japonica Group
MGSTRLLVLLAAASLLLATAVPAARAQEETDHEEEFTYISGDEKGPEHWGKLKPEWAQCGAGEMQSPIDLSHERVKLVRDLGYLDDSYRAAEASIVNRGHDIMVRFDGDAGSVVINGTAYYLRQLHWHSPTEHSVDGRRYDMELHMVHESAEKKAAVIGLLYEVGRPDRFLQKMEPYLKMIADKEGRLARRGWSGRLSRGFAPCRGISSTFSGKLCMMKWRTTRGPFRR

SEQ ID NO: 27112 - protein, 506 aa, Magnetospirillum magnetotacticum MS-1
MLYASPNTSGAKVQYKAKYDNFIGGKWVAPVKGEYFDVITPINGKAYTKAARSGAEDIELALDAAHAAADAWGKTPPAERANILLKIADRLEANLELLAYAETVDNGKPIRETLAADIPLSVDHFRYFAGCLRAQEGGMSDIDENTVAYHFHEPLGVVGQIIPWNFPILMAAWKLAPALGAGNCVVLKPAESTPISILILAELIADLLPPGVLNIVNGYGREAGMPLASSKRIAKIAFTGSTSTGRVIAQAAANNLIPATLELGGKSPNIFFPDVAQADDGFFDKAIEGLVLFAFNQGEVCTCPSRALIHESIYDKFMDRVLGRVAAIKQGSPLDTDTMIGAQASKEQMTKIMSYLDLGKQEGAQLLIGGERAYLGGELNDGYYIQPTLFKGHNKMRIFQEEIFGPVLAVTTFKDEAHALELANDTLYGLGAGVWSRNGNVAYRMGRAIKAGRVWTNCYHAYPAHAAFGGYKESGIGRETHKVMLDHYQQTKNLLVSYSESKLGFF

SEQ ID NO: 27113 - protein, 275 aa, Oryza sativa Japonica Group
MHSSTRARLLLAAAVLLLSAAPAARAQETDDERKFGYVPGTENGPGNWSRLDPRWAKCNTGNMQSPIDLSHERLMRNLGYLDYSYLPAEASMVNRGHDIEVKFMGNAGRVVINGKAYKLKQLHWHTPSEHTVNGRRYDMELHLVHDDGNSNTAVIGNLYQIGNPDPFLLMLEPFIRRIADTKDKSEPIGVVDPQLAKSPDAVYYRYMGSLTTPPCTEGVIWTVFKRVFLLAQTVAQYQLDLLREAVADGYENNARPLQKVNNRNISIFIPDPKKD

SEQ ID NO: 27114 - protein, 172 aa, Triticum aestivum
  misc_feature (58)..(58): Xaa can be any naturally occurring amino acid
  misc_feature (83)..(83): Xaa can be any naturally occurring amino acid
  misc_feature (93)..(93): Xaa can be any naturally occurring amino acid
  misc_feature (139)..(139): Xaa can be any naturally occurring amino acid
  misc_feature (159)..(159): Xaa can be any naturally occurring amino acid
MEHKETGCQSREGPILCVNNCGFFGSAATMNMCSKCHKEMAMKQEQAKLAASSFDSIXNGGRCPRKNTLLLGSTAVAVAHVEXKTLITAQPAXIAGPSEAAMENPKGPSRCSTCRKRVGLTGFNCRCGNLYCATHRYSXDKHECKFDYRAAAMDAIAKXANPVVKAEKLDKI

SEQ ID NO: 27115 - protein, 217 aa, Leptospira interrogans serovar Lai str. 56601
MNEDPQKKDEPFFKDVEFKASYGKADQIPSQGTPQIAFAGRSNAGKSSLLNAILERKSLAKVSSTPGKTKLLNFFFVNHSIYLVDLPGFGYSANSHKDHEAMMGLLMDYLNLAKDLKCLFLVCDSQRELPEEELELIGTCFERNIKPVLVRTKIDKLNQSDLSKLRKKMKNIHELYPMLETVLVSNKSGKGLPELRKIVYSLIETVKNRLERIEEIS

SEQ ID NO: 27116 - protein, 258 aa, Glycine max
MACSATSASLFSANPTPLFSPKSSLSLPNNSLHLNPLPTRPSLSLTRPSHTRRSFVVKASSSELPLVGNTAPDFEAEAVFDQEFINVKLSDYIGKKYVVLFFYPLDFTFVCPTEITAFSDRHAEFEALNTEILGVSVDSVFSHLAWIQTDRKSGGLGDLNYPLISDVTKSISKSYGVLIPDQGIALRGLFIIDKEGVIQHSTINNLAIGRSVDETKRTLQALQYVQENPDEVCPAGWKPGEKSMKPDPKLSKDYFAAV

SEQ ID NO: 27117 - protein, 327 aa, Triticum aestivum
MASRAATMVALMLAAVAATCARAQLDEKFYSESCPSVEDVVRREMVRALSLAPSLAGPLLRMHFHDCFVRGCDGSVLLDSANKTAEKDAQPNQTLRGFGFVERVKAAVEKACPDTVSCADVLALIARDAVWLSKGPFWTVPLGRRDGSVSISNETDALPPPTSNFTVLTQLFAAVNLDAKDLVVLSAGHTIGTSHCFSFSDRLYNFTGMENPSDIDPTLEPQYMMRLKSKCASLNDNTTLVEMDPGSFKTFDTDYFKLVSKRRGLFHSDGALLTDPFTRAYVQRHATGAFKEEFFADFAASMIKMGNANPLTGSQGEIRKKCSVVNR

SEQ ID NO: 27118 - protein, 306 aa, Arabidopsis thaliana
MPTLYKKAGCLGIREFMDSSMSTKKKTKLSVRNQTCFKKSSLSSSSTAKKTTNLSMREQTMFKKALELSTLCNIDVCVIYYGRDGKLIKTWPEDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQWTEPLMSGVSNTEQDLSTSSLSQNQSRISVFLYNHDNRSFYQVPDSVSSFDSLTSTGLLGEQGSGLGSNFDLPPMVFPPQMQTQTPLVPFDQFAAWNQAPSFADPMMFPYN

SEQ ID NO: 27119 - protein, 606 aa, Arabidopsis thaliana
MALRLPASKAAEVAIGSIGCGYDLAIDLRLKYCKGGSKDSRLLDIKEGDDNCEIVLPGGISIPNVSKSIKCDKGERMRFRSDILPFQQMAEQFNQELSLAGKIPSGLFNAMFEFSSCWQKDAAYTKNLAFDGVFISLYSVALDKSQVLLREHVKQAVPSTWDPAALARFIDIYGTHIIVSVKMGGKDVIYAKQQHSSKLQPEDLQKRLKEVADKRFVEASVVHNTGSERVQASSKVETKEQRLRFADTSSLGSYANKEDYVFMCKRRGGNDNRNLMHNEWLQTVQMEPDVISMSFIPITSLLNGVPGSGFLSHAINLYLRYKPPIEELHQFLEFQLPRQWAPVFSELPLGPQRKQQSCASLQFSFFGPKLYVNTTPVDVGKRPITGMRLYLEGRRSNRLAIHLQHLSSLPKIYQLEDDLNRSIRQESHDRRYYEKVNWKNYSHVCTEPVESDDDLSVVTGAQLHVESHGFKNVLFLRLCFSRVVGATLVKNSEWDEAVGFAPKSGLISTLISHHFTAAQKPPPRPADVNINSAIYPGGPPVPTQAPKLLKFVDTSEMTRGPQESPGYWVVSGARLLVEKGKISLKVKYSLFTPILGDEVIEEAYEG

SEQ ID NO: 27120 - protein, 148 aa, Oryza sativa Japonica Group
MAPSVMASSATTVAPFQGLKSTAGMPVARRSGNSSFGNVSNGGRIRCMQVWPIEGIKKFETLSYLPPLTVEDLLKQIEYLLRSKWVPCLERPRRRTLMHSSVSSASTTSGRCSSSASSPTSPRAARSLVATKPSSSYIALFNCSSLIR

SEQ ID NO: 27121 - protein, 251 aa, Kineococcus radiotolerans SRS30216
MNHPFDLTGRTALVTGGGRGLGLGISTSLLRAGADVVVLGRGAPAADLAEEAARCGRRLVHHAVDLADAAAVAATAAAVLAEHRVDVLVNNAGTQERHPAVEFPLDAFDRVLDVNLRAVFQLCQLFGAPMLERGEGRVVNIASLLSFQGGLTVPAYAASKGAVAQLTKALCNEWAGRGVGVNAVAPGYMATDMNEALLADPVRREQLSVRIPAGRWGTPQDVGDVVVFLASPAAAYVHGHVLAVDGGWLAR

SEQ ID NO: 27122 - protein, 247 aa, Spiroplasma citri
MITIKTDQEIEYMRKACTTLKQIDQELKAMIKPGMTGIMLNHRAEEIIRANNCKPNFKGLYGFPAAICVSLNEVLVHGIPNHTPFMEGDLVSVDAGCSYEGYNSDGAFTVIVGKPRTAEHVKLLTVTETALAKATAILKPGVRIGDIGETIQTYVEGEGFFLPTEFTGHGIGQELHEDPMIPNVGTAGVGMRLQAGMTICIEPMVQIGTKAIKMLDDNWTPVSALHLCSAHFEDTILITPTGYEVLT

SEQ ID NO: 27123 - protein, 359 aa, Kineococcus radiotolerans SRS30216
MDPVGGAVDPVGLRPAAGCRHDLVSLGEVMLRFDPGEGRIRTARRFDVHEGGGEYNVARGLRRCFGRRTAVVTALADDEVGRLVEDLVLTGGVDTSLVRWVPADGAGRGVRNGLNFVERGFGVRRSVGVSDRGGTAVSRLQPGDVDWDDLFGVQGVRWFHTGGIFAALSESTAEVAAEALAAARRHGTTTSYDLNYRPSLWAGRGGAQAAQELNRRLVEHVDVLVGAGLAGLPGDGGDPRERVLRDAADHPHLRVVATTTRRVVSASRNDFGALAWSAATGLVEGAELRDLAVLDRIGSGDAFTAGLVHGLLGGEGLPRAVALGIAHGALVMTTPGDSSAASAADVEALLASGDASVSR

SEQ ID NO: 27124 - protein, 256 aa, Wigglesworthia glossinidia endosymbiont of Glossina brevipalpis
MKLKPLILSNWKLNGNCLLVKKILLKLNEKLKNKNNLKVVIAPPVIYLSEFKKYVLKKNIFLAAQNVDVNLTGSFTGEISPIMLYEFGVKYVIIGHSERRLYHNESIEDVTKKFLILKKFNLIPVLCIGETKKNKDDKCIENEIVKQIDFILKKIGIEGFINTVIAYEPTWAIGKKDSASPKYIQKIHKFIRNYLSKYDNDISKKIILQYGGSVNSKNVKKIISQKDVNGVLLGRSSTNIEEFLYILDIIEKTKKS

SEQ ID NO: 27125 - protein, 276 aa, Bacillus subtilis subsp. subtilis str. 168
MPTSLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKGQGIQLEAWSPLMQGQLLDNEVLTQIAEKHNKSVAQVILRWDLQHGVVTIPKSIKEHRIIENADIFDFELSQEDMDKIDALNKDERVGPNPDELLF

SEQ ID NO: 27126 - protein, 571 aa, Bacillus subtilis subsp. subtilis str. 168
MVTKILKAPDGSPSDVERIKKESDYLRGTLKEVMLDRISAGIPDDDNRLMKHHGSYLQDDRDLRNERQKQKLEPAYQFMLRVRMPGGVSTPEQWLVMDDLSQKYGNGTLKLTTRETFQMHGILKWNMKKTIQTIHSALLDTIAACGDVNRNVMCASNPYQSEIHSEVYEWSKKLSDDLLPRTRAYHEIWLDEERVAGTPEEEVEPMYGPLYLPRKFKIGIAVPPSNDIDVFSQDLGFIAIVEDGKLIGFNVAIGGGMGMTHGDTATYPQLAKVIGFCRPEQMYDVAEKTITIQRDYGNRSVRKNARFKYTVDRLGLENVKEELENRLGWSLEEAKPYHFDHNGDRYGWVEGIEDKWHFTLFVEGGRITDYDDYKLMTGLREIAKVHTGEFRLTANQNLMIANVSSDKKEEISALIEQYGLTDGKHYSALRRSSMACVALPTCGLAMAEAERYLPTLLDKIEEIIDENGLRDQEITIRMTGCPNGCARHALGEIGFIGKAPGKYNMYLGAAFDGSRLSKMYRENIGEADILSELRILLSRYAKEREEGEHFGDFVIRAGIIKATTDGTNFHD

SEQ ID NO: 27127 - protein, 541 aa, Clostridium difficile 630
MLQVTGVGLRFGDKELFKDVNLKFTKGNCYGIIGANGAGKSTFLKILSGEIEPNTGSISITDKERMSVLKQDHFEYEEETVLNVVIRGHERLWNIMKEKDALYMKEDFNEEDGIKAAELEGEFAELDGWDAETNAEKILMGLGITKDMHYKQMKELVGGEKVKVLLAQSLFGKPEILLMDEPTNHLDFKSINWLNNFIMDLEESIVIIVSHDRHFLNQICTNIVDVDFGKIQMYVGNYDFWYESSQLALQLAKDQNKKTEEKIAQLKEFIARFSSNASKAKQATSRKKQLEKLEVEDIQPSRRRYPYVGFTPAREIGNEVLEVHNLTKTIDGVKVLDNVSFRLDRDDKVVFMGDEIATTALFNIVMGELEPDSGEYKWGVTTSQDYLPKNHNKFFDGVEYSLVDWLRQFSEEKSESFIRGFLGRMLFSGEEALKEAQVISGGEKVRCMLSKLMLSNANVLVLDDPTNHLDLESITSVNKGLEKFPGVLLFTSHDHEFISTIANRIIEITPNGIMDRKMDFDEYLESKEIQDQLAKMYGKDK

SEQ ID NO: 27128 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQGWPGVSCLPDFKTAFPRWQAQDLATIVPNLEPAGLDLLSKMLRYEPSKRITARQALEHEYFKDLEMVQ

SEQ ID NO: 27129 - protein, 319 aa, Xanthomonas campestris pv. campestris str. 8004
MQDQRNLLVFSGNANKPLAQSICKELGVRMGKALVTRFSDGEVQVEIEESVRRQEVFVIQPTCAPSAENLMELLVLIDALKRASAASVTAVIPYFGYSRQDRRMRSSRVPITAKVAAKMICAMEADRVLTVDLHADQIQGFFDVPVDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLSAAARTCPKIRQLSVAELLAETIRRIAFGESVSSLYVD

SEQ ID NO: 27130 - protein, 339 aa, Physcomitrella patens subsp. patens
MLIPPPVSYPDMGHNLNPAPQMSSAALAPVPQARPVPVMQLPIAFQIPKKRINNLSDIEHLHSSEAGKFFLGFIVGLNDSMIGKKLSEYCRESPLIKTICSVLEEMSSWVEQLPPKQQPARYGNPAFREWQTWLEERGPGLMLRILPESLKDGVVELSPYFADSFGNATRIDYGSGHEANFAAWLLCLARLGLVNEDDYQALVARVFVKYLDLMRKLQTTYWLEPAGSHGVWGLDDYHFLPFVFGSAQLKDSKYMKPKSIHNADILENFSHEYLYLGCVQFVKKVKKGVLAEHSPMLDDISGVSSWNKVNSGMLKMYKPEVLEKVPIMQHFLFGSLIKW

SEQ ID NO: 27131 - protein, 441 aa, Oryza sativa Japonica Group
MMKPQHGGMAGHGGGRTRSPFLTSYALTLAFITFVSVLYFKDFSSTLHQPFLTRPPPHRRQIARPRAPSHHHGGGSSSGGGDVVPPFAVGAAAAAGCDVGVGEWVYDEAARPWYEEEECPYIQPQLTCQAHGRPDTAYQHWRWQPRGCSLPSFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 27132 - protein, 73 aa, Physcomitrella patens subsp. patens
MIIPVRCFTCGKVIGNKWDTYLDLLQADYSEGDALDALALVRYCCRRMLMTHVDLIEKLLNYNTLERNENTNN

SEQ ID NO: 27133 - protein, 507 aa, Burkholderia pseudomallei K96243
MASHDYLKKILTARVYDVALETELERARNLSARLGNAVYLKREDNQPVFSFKLRGAYNKMAHIPADALARGVITASAGNHAQGVAFSAARMNVKAVIVVPVTTPQVKVDAVRAHGGPTVEVIQAGESYSDAYAHAVKVQAERGLTFVHPFDDPYVIAGQGTVAMEILRQHQGPIHAIFVPIGGGGLAAGVAAYVKAVRPEIKVIGVQTDDSCAMKQSLAAGRRIELTEVGLFSDGTAVKLVGEETFRLCAAYLDEVVTVDTDALCAAIKDVFQDTRSVLEPAGSLAVAGAKRYAEQAGIEGETLVAVTSGANMNFDRMRFVAERAEVGEAREAVFAVTIPEERGSFKRFCALVGERNVTEFNYRIADARSAHLFVGVQIRRRDESDEIAANFAAHGFTSVDLSGDELSKQHIRYMVGGRSPLAHDERLFRFEFPERPGALMKFLSSMAPDWNISLFHYRNQGADYSSILVGLQVPQADHAAFDRFLAALGYPFWEESGNPAYRLFLS

SEQ ID NO: 27134 - protein, 497 aa, Physcomitrella patens subsp. patens
MTLGHMVQKAKESSGDVTPKKYNIFLASKPVDGDRKWLDVTNKYTNDVAAKVPQATHKDIDDAIDAAVAAAPAMAAMGAYERKAVLEKVVAELKNRFEEIAQTLTMESGKPIKDARGEVTRTIDTFQVAAEESVRIYGEHIPLDISARNKGLQGIVKKFPIGPVSMVSPWNFPLNLVAHKVAPAIAVGCPFVLKPASRTPLSALILGEILHKIEELPLGAFSILPVSREDADMFTVDERFKLLTFTGSGPIGWDMKARAGKKKVVMELGGNAPCIVDDYVPDLDYTIQRLINGGFYQGGQSCIHMQRLYVHERLYDEVKEGFVAAVKKLKMGNPFEEDTYLGPMISESAAKGIEDWVKEAVAKGGKLLTGGNRKGAFIEPTVIEDVPIEANARKEEIFGPVVLLYKYSDFKEAVKECNNTHYGLQSGIFTKDLNKAFYAFEHMEVGGVILNDSPALRVDSQPYGGLKDSGIQREGVKYAMDDMLETKVLVMRNVGTL

SEQ ID NO: 27135 - protein, 711 aa, Acinetobacter sp. ADP1
MYQVLARKYRPRNFIELVGQNHVSRALTSALERGRLHHAYLFTGTRGVGKTTIARILAKCLNCETGITSTPCEVCATCKAVNEGRFIDLIEIDAASRTKVEDTRELLDNVPYAPTQGRFKVYLIDEVHMLSTHSFNALLKTLEEPPEHVKFLFATTDPQKLPITVISRCLQFTLRPLAVDEITSHLTTILAKEQIEADKDAIWQIAESAQGSLRDALSLTDQAIAYGQGAVHHQDVKEMLGLIDRTIIYDLILAIHQNQTARVSQLLMQFRQQALDVSLVLDQLISTLHELALLQYLPELSLKYSEEINQKILKLAKIVSAQDLQLYYQIACKGRSELQLSVTQEQGFEMCVLRLLAFRPLSIDEVTVHASSQPSELQINQLPPAADSETDSSSRSELQHTNNRIEPDLEGSVVISVISQEAESFEAEQVVNHTTDDCQTAKTRQNKDVSSAVVEAEQENILVFNANSDDIVGIEQNKTAVVLAAQDMPFFPVEEERQIANHQHIALPAERVEQADTYQPEPHQVTQPISDSSSEESSLDALADDESTPLIDLSIDTNEHKVQVTSAANDLEVMPQDILKLAEQELEGEWTLEKWEYWFRTSQLSPAVQELAQYGLMSGNIDGICTFNIPQQYEGMLSQLQHALESEVKSRWPNTQFTVKYGKVNEITPYIKQIERKEKAFQRAIDLLQQNPVVKDLLNTFDGQLQNIQLK

SEQ ID NO: 27136 - protein, 690 aa, Nicotiana tabacum
MQDFIGSVRRSLVFKQSGDFDTGAAGVGSGFGGFVEKLGSSIRKSSIGIFSKAHVPALPSISKAELPAKARKDDTPPIRWRKGEMIGCGAFGRVYMGMNVDSGELLAIKEVSIAMNGASRERAQAHVRELEEEVNLLKNLSHPNIVRYLGTAREAGSLNILLEFVPGGSISSLLGKFGSFPESVIRMYTKQLLLGLEYLHKNGIMHRDIKGANILVDNKGCIKLADFGASKKVVELATMTGAKSMKGTPYWMAPEVILQTGHSFSADIWSVGCTIIEMATGKPPWSQQYQEVAALFHIGTTKSHPPIPEHLSAESKDFLLKCLQKEPHLRHSASNLLQHPFVTAEHQEARPFLRSSFMGNPENMAAQRMDVRTSIIPDMRASCNGLKDVCGVSAVRCSTVYPENSLGKESLWKLGNSDDDMCQMDNDDFMFGASVKCSSDLHSPANYKSFNPMCEPDNDWPCKFDESPELTKSQANLHYDQATIKPTNNPIMSYKEDLAFTFPSGQSAAEDDDELTESKIRAFLDEKAMDLKKLQTPLYEGFYNSLNVSSTPSPVGTGNKENVPSNINLPPKSRSPKRMLSRRLSTAIEGACAPSPVTHSKRISNIGGLNGEAIQEAQLPRHNEWKDLLGSQREAVNSSFSERQRRWKEELDEELQRKREIMRQAVNLSPPKDPILNRCRSKSRFASPGR

SEQ ID NO: 27137 - protein, 536 aa, Glomus mosseae
MASTPPTDYGKEAVLDVSETRDVETGEVKNGGLKQDLKNRHMQMIAIGGAIGAGLFVGSGGALQKGGPAALLIGYLIIGIMLLCTCLALAEMAVLYPVNGAFFTYIVRFVDPSWGFAMGWQYALAWLTVLPFELIAASITIRFWREDINMAVWVSVFLVVLMGIQIFGVRGYGEVEFVLSIIKICACVGFIILGIVINCGGVGDQGYIGVKYWRDPGAFTSFKGFCAVFVVAAFSFGGTEMVGLAAAESANPRKSIPMASKQVFWRIAIFYILNLFIVGLILPANDPRLMGASGANTKASPFVLAIQDAGIKVLPSIMNAVITVAVLSVANSCTFGSTRTIQAMAERNMAPNFFKYIDSKGRPLYCVILQIAFGLLAYIGAAPQGMEIFGWLLALTGLGFLFVWGSICLAHIRMRAGMKAQGINLGLIPYKTPFGVAGSYLGLGLNILALIASFYTALFPASGASPTAEAFFSSYLAFFSVTLLYLGYKACTRKRQMYVRPAEMDLASGAVWLEEVEPKEPFVWADTPKKVLRSFY

SEQ ID NO: 27138 - protein, 652 aa, Solanum lycopersicum
MRESSRQQHQTQLFWPRVVMRKWLNISAKDSDYSADPDSDVGSDSGSDSDQEFCDWPRQSGLNDAKDGKVGIDDALPKIRRRKSETFRAQYINAKEIRVCVGTWNVAGRFPPEDLELDSWLDVNEPADIYVIGFQEVIPLNAGNIFGAEDNRPISVWEDIIRESLNKVSPVNKFKSFSDPPSPSRFRPSEDAPDIEEEIAFESDSGSEEEIVPINEECNDFVEIKDGCIMEDHKIVKNDVAVLNNTWGLEPINEEFQKQFPSSKKLDRLNCFRPDEEEEETGESNLQFAKKLTKTLSGTERIGLCWPEKPLDLLGQHVSERPGSFKSMKSFKASKSFNTYSSFKLTVNGQNRTQSDANLLAGLDLEALINRKRKPSYVRIVSKQMVGVFLSVWVRRGLRKHIQNLNVSTVGVGVMGYIGNKGSVSVSMSIYQTFFCFVCTHLTSGEKETDVVKRNTDVHEIHRRTHFNAFSLIGLPKSIHDHERIIWLGDLNYRINLPYNRTRELIAKKDWCKLIEYDQLSKEFKKGRAFDGWSEGTLNFPPTYKYEVNSEKYCGEDPKAGRRNPAWCDRILSFGKGIRLLRYGRSELKFSDHRPVSATYMVEVEVFSPRKLQRALTFTDAEIAKEEIVTNMGLENGMSRFISDQGESCWMR

SEQ ID NO: 27139 - protein, 330 aa, Brassica napus
MATLFPGDGIGPEIAESVKKVFTTAGVPIDWEEHFVGTEIDPRTQSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKLNEQAEQIHRAIINTIAEGKYRTADLGGSSTTTDFTKAICDHL

SEQ ID NO: 27140 - protein, 435 aa, Zea mays
MYVPPPPTGGAGEQPRVYQVWRGSNEFFLQGRFIFGPDVRSVFLTMFLIIAPVVVFCVFVARHLINDFPDSWGISVMVVVVVFTVYDLTLLLCTSGRDPGIIPRNTHPPEPESIDGINDTGVQTPQQFRLPRTKEVVVNGISVRVKYCDTCMLYRPPRCSHCSICNNCVERFDHHCPWVGQCIGLRNYRFFYMFVSSTTLLCLYVFAFCWVYVIKIRAAEHLSIWKALLKTPASIVLIIYCFLCVWFVGGLSVFHLYLMGTNQTTYENFRYRYDRRDNPYNRGTLNNFLEIFCTAIPPSKNNFRARVTVEQGLQQTRSQSRGFMSPSMGKPTIGELEMGRKPVVPWDEPRTAADIRDLEAGFGGMFDEKEGRVAHASPDLSRDLPAEFVEGRTGMHSRQSSWVQRGGDASEASALQMATVHTAEDSNHVPWSGTR

SEQ ID NO: 27141 - protein, 400 aa, Sulfitobacter sp. EE-36
MELLSKTLARVKPSPTIAVTQKAAELKAAGKDVIGLGAGEPDFDTPQNIKDAGIAAITAGKTKYTAVDGILELKQAICAKFKRDNGLDYTPSQVSVGTGGKQILYNALMATMNPGEEVVIPAPYWVSYPDMVLLAGGTPVIAPATLENDFKLTPEALEEAITPNTKWFIFNSPSNPTGAGYSWDELKALTDVLVRHAHVWVMTDDMYEHLAYDDFKFCTPAQVEPALYDRTLTVNGVSKAYAMTGWRIGYAAGPEKLIGAMRKVQSQSTSNPCTVSQWAAVEALNGTQDYIAENNKMFTRRRNLVVDMLSEIDGIVCPKPEGAFYVYPSIAGLIGKTTPSGVTITDDEVFATALLEDTGVAVVFGAAFGLSPNFRISYATSDEALKEACTRLQQFCAALS

SEQ ID NO: 27142 - protein, 148 aa, Populus trichocarpa
MEQTFIMIKPDGVQRGLVGEIISRFEKKGFTLKGLKLLTVEQSFAEKHYEDLATKPFFSGLVEYIISGPVVAMIWEGKGVVATGRKIIGATNPSASEPGTIRGDFAIHVGRNVIHGSDSVESATKEIGLWFPEGPTNWQSSLHQWIYE

SEQ ID NO: 27143 - protein, 269 aa, Wigglesworthia glossinidia endosymbiont of Glossina brevipalpis
MYPMLNIAIQAAREAGKLINKYYGGIYLSENIYQINENSFDINNAVENLICNIIKKYYPNHIILNINKEIKYNFFSRKKKEISNVKWIIDPINGYENFSTNIPHFAVSIAVQINLKTEISVIYDPIKNELFNAIRGRGAQLNGYRIRTKKIKNIKDIIISTIISNEKQNINNNYDFILNNLILYFKNFRCTGSIALDLAYVASNRFSLFFLIKSDLEKFFISNDLIIRESGGLITDFTGGHDYLYSGNILAGNPDIVKKILLIIRKKLK

SEQ ID NO: 27144 - protein, 518 aa, Mycobacterium smegmatis str. MC2 155
MTASQGAASRTALNAERRAAELDTLAAGEHVDVLVIGGGITGAGIALDAATRGLRVALVEKHDLAFGTSRWSSKLVHGGLRYLATGNVGIARRSAVERGILMGRNAPHLVKAMPQLVPLLPSMNRASRALIRTGFLAGDGLRKLAGTSAATLPRSRRIDAARAVAMAPTVRTDGLEGGFLAYDGQLVDDARLVVAVARTAAQHGARILTRVSADHATEESVRLTDHRTGSSFDVRARVVINAAGVWAGQVDPTIRLRPSRGTHLVFDAAAFGNPTAALTIPIPGELNRFVFAMPEQLGRIYLGLTDEDAPGPIPDVPQATPAEISFLLDTVNTALATTLTPADVRGTYAGLRPLIDAGEGRTADLSREHAVVESPDGVLSVVGGKLTEYRYMAEDVLDRAVALRGLDAGECRTRNLPLVGAPANPVTTLRAQVELPGSLVARYGAEAHNVIAQATCARPVEPVADGIDVTRAEFEYAVTHEGAMTVDDILDRRTRIGLVTEDRERALAAATEVLARIG

SEQ ID NO: 27145 - protein, 302 aa, Hortaea werneckii
  misc_feature (34)..(34): Xaa can be any naturally occurring amino acid
MVSAWGGYVFITNLLPLHAFVLTCMGRFSPRLYXSYTTWYALGTLASMQIPFVGFLPIRSSDHMAALGVFGLMQLVGAAEWLRSQLPSKQFQTVIRAAVLLIFAGAFGALVLLTVSGVVAPWSGRFYSLWDTGYAKIHIPIIASVSEHQPTAWPAFFFDLNMLIWLFPAGVYMCFRNLKDEQVFIVIYAVLASYFAGVMVRLMLTLTPVVCVAAAMALSQILDTFLVASSPNEGSSTQANGTPPSANANGNLADKFSALPDTLRSTKSPLVGIYSYLSKSLITGAITSYLLLFVLHCTWLTT

SEQ ID NO: 27146 - protein, 328 aa, Oryza sativa Japonica Group
ISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 27147 - protein, 153 aa, Arabidopsis thaliana
MAGSLVKCSKIRHIVRLRQMLRRWRNKARLSSVSRCVPSDVPSGHVAVCVGSGCRRFVVRASYLNHPIISNLLVQAEEEFGFANQGPLVIPCEESVFEEAIRFISRSDSSRSSRFTCPDDLQKCNGGIKIKSKLDLMIESRPLLHGVAEKAIW

SEQ ID NO: 27148 - protein, 320 aa, Streptococcus suis 89/1591
MGLLQDGKWVDQWYDTKSTGGKFVRTVTQFRNWITPDGQAGPTGRGGFKAESGRYHLYISLACPWASRTLIMRKLKGLEDHISLSIVHPLMLENGWTFADGPGVIKDSLFNSNYLYQVYLKTDPNYTGRVTVPVLWDKETNTIVSNESAEIMRMFNSAFNDITGNYDDYYPANLQAEIDAMNDFIYPNINNGVYKAGFSTSQAVYEKEVKNLFAALDKLEEHLADKNYLVGNQLTEADIRFFTTLVRFDPVYFGHFKCNIKALVDYPNLWDYTKRIYNHSGIAETVDFDHIKQHYYGSHKTINPTGIVPVGPDLDWTLEN

SEQ ID NO: 27149 - protein, 141 aa, Physcomitrella patens subsp. patens
MAEDGYKPWWAIDKAAWREVFSPFYKFASISERRDTPLPPWSESDVQEFINSDPVYGPQLKLVRQGATIANVGALVGGLATAGIALRYSKNLPGAVGAFLGGAAMSWAVAEEGANLGLGLYKFNCMDTNLRFLDWWERKQA

SEQ ID NO: 27150 - protein, 243 aa, Burkholderia pseudomallei K96243
MSKTHFGFETVEENEKAKKVAGVFHSVASNYDLMNDLMSAGLHRAWKAFTIAQANVRPGGKVLDIAAGTGDLTKAFAKAAGPTGEVWHTDINESMLRVGRDRLLDKGVVTPSLLCDAEKLPFPDNYFDVVTVAFGLRNMTHKDSALAEMRRVAKPGGRVMVLEFSKVWEPLKKAYDVYSFKVLPWLGDKFAKDADSYRYLAESIRMHPDQETLKTMMEQAGLDAVKYYNLSGGVVALHVGTKY

SEQ ID NO: 27151 - protein, 302 aa, Oryza sativa Japonica Group
MDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEVQQLLHIFKLLGTPNEQVWPGVSKLPNWHEYPQWNPSKVSDLVHGLDADALDLLEKMLQYEPSKRISAKKAMEHPYFNDVNKELY

SEQ ID NO: 27152 - protein, 444 aa, Oryza sativa
MRYSNIQSGPGPINPTKTHAHSSPLLGVLFSPSLSSPLTSQSHPLPFSCPSHLPPSVQGGGVKMASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 27153 - protein, 500 aa, Vibrio campbellii AND4
MVIPENSSIVIFGASGDLTYRKLIPALYHLYANKQLPENFAILGVSRTEYSDDSYREKLKKSLQEMEKTEPETLNAFINHLHYQAINTSDTQDYSKLVTRLDQLADKYQFEQRNTLFYLATPPSLYSVIPASLAAHGLNKEEDGWKRLIIEKPFGYDLESARTLDKEIHEHFQEHQIYRIDHYLGKETVQNLLVLRFSNAMFEPLWNRNFIDYVEITGAEFLGVEERGGYYDGSGAVRDMFQNHLLQVLAMVGMEPPAQINADAMRDEVVKVLQCLKPLDENALRNDLVLGQYTASDVRGQHLPGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYADLPETQMLTAYERLLLDALNGDATLFARSDAVEACWKYVQPILDFKQDPHALFGYACGTWGPKEADVLLQRANRAWRFPCKNLTDTDYCEL

SEQ ID NO: 27154 - protein, 416 aa, Debaryomyces hansenii CBS767
MNYFQKSLRYFSISSKALAKKKNAGVIKTKYLGRPSNNLTLGVVGLANVGKSTFFQAMTKTSLGTAANYPFATIDPVESLVIVESPKLNHLGQLYESQKNIPTILNILDIAGLTRNAASGEGLGNKFLSDIRQVDGIFQVVRGFRDDDIIHIEDNKVDPIRDMNIVTEELILKDLEFIETGIEKVGKLMKRPHIDKAQVQLEIDTLNRIQDLLYESRKISTGQWTDKEIDIINTYNFLTAKPTVYLLNVNEKDYVAQQNEFKQDVEQWIEDNCPNDILLMFSASYETKINECKTPEELNKFVALNNNKTSAKSDIVDKMRSCLNLISFYTCGPKEARQWSIREGSTMPEAAGLIHTDLQKTFISAQVYKFDDLVNLSPPFNEASLKNSGKQFKCGKNYIVQDGDVVIIKAGNAKAR

SEQ ID NO: 27155 - protein, 482 aa, Vibrio campbellii AND4
MKGDIGVIGLAVMGQNLILNMNDHGFKVVAHNRTAAKVDEFLEGPAKDTNIVGAYSLEELVEKLETPRKVMLMVRAGDVVDAFIDNLIPLLDEGDIIIDGGNTNYPDTNRRVAHCRDKGIHFIGTGVSGGEEGARFGPSIMPGGAPEAWDAVKPIFQGISAKTDAGEPCCDWVGNDGAGHFVKMVHNGIEYGDMQLITEAYQFMKDGLGMSSDEMQAVFADWNKTELDSYLVEITADILGYKDEDGEPLVEKILDTAGQKGTGKWTGINALDLGIPLTLISESVFSRCLSALKDQRVEAESLFGKTITPVEGDKQEWVDALRQALLASKIISYAQGFMLMREASNENGWDLNYGNVALMWRGGCIIRSAFLGNIRDAYEANPDIAFLGSDEYFKNILQGSLAAWRKVAAKSLESGIPMPCTISALSFLDGYTTARLPANLLQAQRDYFGAHTYERIDRPRGEFFHTNWTGTGGDTASTTYDV

SEQ ID NO: 27156 - protein, 677 aa, Mesorhizobium sp. BNC1
MDGPVVWELRGRVLHVLIDNPPVNAGSQPVRAGVLKAIGEAGASNAEAVVIQGANGNFVAGSDLREFEGPLSPPEWPEVFSAIGNCPIPVVAAIEGAALGGGYELALACDGRIAAPDAVVGLPEVALGIIPGAGGTQRLPRLTGRAEAIRLICGAIRVPANEALAKSMVDRIAEDDLISAACDFALSLPGKRRLDDAAVPKESAEVIEAAARAALAKARESRAVVEAIALITRAGIGSTAEALAEERSVFQALRKSEQSAALRYLFFAERTAARALPRFDKEKRVTRLGVIGAGTMGVGLAVSLLAAGKSVVLIDKDDLALTRASAAVKSGLARLERGGKLKEAPDAALARLVASKELSAVENCEVVIEAVVESFEVKSAVLSDLHARLSPGAMVVSNTSYLDIAELARASGRPDRFLGLHFFAPVPVMTLVEVVPLPETSSHTLTVATQLVRDMGKVAVRAGPCNGFLGNRIYAAYRRECELLVEEGAMPWDVDAELRKQGFRMGPFQVGDLSGLDIGWALRRSRDATRDPRERYFALPDTLYEMGRLGRKSGAGWYAYSTDCPDGQPDPEVERLVRTNARAGIAAPDAETIRQRAMGAILNEAARAFEDGTAAAASDIDVVLVNGYGFARERGGPLWQASRLSSDERTLMIDLVAHANGYGFTRGDVESLIAALT

SEQ ID NO: 27157 - protein, 291 aa, Thermosynechococcus elongatus BP-1
MARNVRSTQYVLCSIYRIDFTVFGGRMPLPLYQVDAFTQEPFRGNPAAVCVLRTFFEDRTLAAIAREMNLSETAFVVPLARGFHLRWFTPVAEVALCGHATLATAHVLWQHEGVVEDLEFHTPSGLLRAQRLGDWIALDFPQQPVTPLEDQQVQASIITALGTTPLFMGQAGSDLLVELAAADAVAQLKPDFDQIARLPCRGLIVTARSENYEYDIISRFFAPQLGIPEDPVTGSAHCSLYPYWQAKLGQRELVAYQASARGGVIRMQPQGGDRLLLLGQAVTIFSGELLL

SEQ ID NO: 27158 - protein, 186 aa, Glycine max
MSAYRDEDPRLHGIKTKIRVVPNFPKPGIMFQDITTLLLDPRVFKDTIDLFVERYKGKNISVVAGIEARGFIFGSPIALAIGAKFVPLRKPKKLPGKVISQEYILEYGRDCLEMHVGAVEPGERALVVDDLIATGGTLCAAMDLLERVGAEVVECGCVIELPELKGRERLNGKPLHVLVECFECCE

SEQ ID NO: 27159 - protein, 150 aa, Thermosynechococcus elongatus BP-1
MERTFLAIKPDGVQRGLVGTIIQRFEQKGYTLVGLKLMRVSRELAEQHYGEHKDKPFFPGLVNFITSGPVVAMVWEGRGVIANARKLIGATNPLNAEPGTLRGDFAVDVGRNVIHGSDSPENAEREINLWFQTQELVPWEPALTSWVYEM

SEQ ID NO: 27160 - protein, 267 aa, Nocardioides sp. JS614
MSQTAILGAGVMGETLLSGLVRAGRRVDHLLVGEKRPERAQELEERYGVAVVGNAEAARKADTLALVVKPQDMGDLLEEIAGELRPGQLVVSLAAGITTAFIEARVPEGVAVVRVMPNTPALVDEGMAAVSPGSHCSEEHLAEAESLMASVGRVLRIPERQQDAVTAISGSGPAYIFFVVESMIEAGVHLGLPRATATDLVVQTVVGSAKMLRETGTHPAVLREQVTSPAGTTAAALRELEIHKVRAAFLAAMEAARDRSRALAEGS

SEQ ID NO: 27161 - protein, 501 aa, Xanthomonas campestris pv. campestris str. ATCC 33913
MSESVPRVSLLIDGALVVSATTHWQDVVNPADQSVLAQVPFATPAEVDAAVAAAQQAFVGWRKTPIGTRARIFLKYQQLIREHMPELAAILSAEQGKTLADAEGDVFRGLEVVEHAAAIGNLQLGELANNVANGVDTYTLLQPLGVCAGITPFNFPAMIPLWMFPMAIATGNTFVLKPSEQDPMVTMRLVELALEAGIPKGVLNVVHGGEEVVNALCDHPDIKALSFVGSTKVGTHVYRRASLAGKRVQCMMGAKNHAVVLPDANQEQTLNAMVGAAFGAAGQRCMAASTLVLVGEARQWIPALVAKARGLKLGAGSTPGTDVGPLISCAARERVEGLIASGVAQGATLELDGRTPQVPGLEHGNFVGPTIFSGVTPGMRIYDEEIFGPVLVILEAATLEEAIALVNANPNGNGTALFTQSGAAARRFQEDIDVGQVGINVPIPVPVPLFSFTGSRASKLGDLGPYGKQVVMFYTQTKTITARWFDDETLGHGVNTTISLK

SEQ ID NO: 27162 - protein, 316 aa, Vitis vinifera
MDSAKPELAREVLPLLRIHKDGSVERLRGTEVVPAGTDPQTGVSSKDVTIIPEIDLSARLFLPKLTNPNQKLPLLVYFHGGGFYLSTPFAPNYHNYLNSLVSQANVVAVSVNYRKAPEHPIPAAYEDSWAALQWVASHCNGNGPEAWLNEHANFERIFLSGESAGANIVHNLAMAAGRGDAEMKLVGIGLIHPYFWGEDQIGSEAKDPVRKAMVDKWWQLVCPSGRGNDDPLINPFVDGAPSFKDLGCDKVLVCVAERDILRDRGRLYYETLVKSGWGGTAEMVETEGEDHVFHIFQADSDKARSLVRSVASFINH

SEQ ID NO: 27163 - protein, 139 aa, Mycobacterium smegmatis str. MC2 155
MTERTLVLIKPDGVKRQLVGEILSRIERKGLTLAALELKNVSDDLARQHYAEHADKPFFGSLLEFITSGPLVAAIVEGPRAVAAFRQIAGGTDPVEKAVPGTIRGDFALITQDNLVHGSDSPESAAREIALWFPGEATA

SEQ ID NO: 27164 - protein, 351 aa, Vitis vinifera
MEGNYGEDEEFGFARNYFIAKELGGSGKKSSRKLSDIELVDEQELRAAARSIESKHEKEIGSLLNSYKSLYPKWVFELRCGFGLLMYGFGSKKALIEDFASTALTECAVLVINGYLQSINIKQAVTAIAEALWDQLKTRRTPSGDFPKVQQPFNSRSMDDLLAFMDGSHSEKNDCFVCVVIHNIDGPGLRDSDTQQYLARVAACSHIRMVASIDHVNAPLLWDKKMVHTQFNWCWYHVPTFVPYKAEGIFYPLILAHGGTAQSAKTAAIVLQSLTPNAQSVFKVLAEHQLAHPDEEGKDACQQFVQYLSRALSEFKDHELIKTRRHSDGQDCLYIPLATEALEKLLQDISQ

SEQ ID NO: 27165 - protein, 375 aa, Oryza sativa Japonica Group
MKTLDEYYRFYNSNVHRGIHVLSAKATDAYESARTKVANFVNAANSREIVFTRNATEAINLVAYSWGMSNLKQGDEIVLTIAEHHSAIVPWQFVSQKTGATLKYVGLTKEGVPDIEQLKGLLSNKTKIVVVHHVSNVLGSMLPIEDIVTWSNRIGAKVLVDACQSVPHMPVDVQRLGADFLVASSHKMCGPTGVGFLHGKFDLLSSMEPFLGGGEMIADVFQDKSTYAEPPSRFEAGTPAIGEAIGLGTAIDYLSQIGMQKIHEYENELATYLYESLIAVPNVRIYGPAPCQTVHRAPLCSFNVENVHPTDIAEILDLQHGVAIRSGHHCAQILHRTLGINASARASLHFYNTKEEVDVFVDALKDTIDFLTSEH

SEQ ID NO: 27166 - protein, 181 aa, Populus trichocarpa
MGVLVVNPQDCLKNPLQSQPQRMRFTRNPNLNNPRPNRAQPNRRKWSPNSSPPPRAAVPKNNSSNLVMGQVKILKRGKEDLIEPGKKDETPRGSHNTEAVKSEDLGFFSTNRLGPDAVLVPTQVRLTESKDIVNGFYAGSAFITSPPPSSLPLPGFFTKKTNNPVAVDASSEIMKLLGLSL

SEQ ID NO: 27167 - protein, 262 aa, Ustilago maydis 521
MADLLSTKPEALNDIFDYDMKLNVANPATGAQKSFDIQDERLVRCFYEKRMSQDVEVDSLGEEWKGYVLRIGGGNDKQGFPMKQGVLLPNRVRLLLSKGDSCYRPRRTGERKRKSVRGCIVGPDIQALHLIVVKQGEKEIPGLTDAESTVPKRLGPKRANHIRKFFNLSKEDDVRQFVVRREVVSKKEGAKPYTKAPKIQRLVTAQRLQRKRHLRSLKIRKAEAQKIQKEEYEQVLAKRVAEKKQEVAAHKAARKSAKKVQA

SEQ ID NO: 27168 - protein, 107 aa, Brassica rapa subsp. rapa
LVITNPSNPLGTTLDRDCLKSLVKFTNDKGIHLIADEIYAATTFGESEFISVAEVIEEIPDCNRDLIHIVYSLSKDMGLPGLRIGIIYSYNNRVVQIARKMSSFGLV

SEQ ID NO: 27169 - protein, 459 aa, Magnetospirillum magnetotacticum MS-1
MPTRASNRTITEKDVDSVLHPYTNLKRHPEVGPLVITRGKGVRVYDEAGKDYIEGLAGLWCTSLGWGEERLVEAAARQMRTLPFYHLFSHKTHDVGVELCARLLEMAPVPMSKVFLAGSGSEANDTAIKLIHYRSNALGLPHKKKIIAREKAYHGVTVATASLTGLVNNQRSFDLPIPGVLRAGCPHHYRFARQGESEEDFSSRLAAELEALILAEGPDTVAAFFAEPVMGAGGVIVPPAGYFPKIQAVLDRYDILLVVDEVICGFGRTGKMFGTETFGIRPDMMTLAKGLSSGYAPISALMVNERVYGPVAEESGRIGVFGHGYTYGGHPVSAAVALETLNIYAERDILAHIAKVGPVLQEGLGSFRDHPLVGEARGIGLIGALELVADKTSRAPFPPERTMGAKVVARAQDKGVILRAMGDAIAFAPPLIITEAEIGDMLRRFKAALDEAHGALGLG

SEQ ID NO: 27170 - protein, 519 aa, Vibrio sp. Ex25
MFEFPQFSKHSVKNDVLSGLTVALALVPEAVAFAFVAGVDPMVGLYAAFIVGLITSIFGGRPGMISGATGAMAVVMVSLVATHGVQYLFAAIMLAGILQIAAGMFKLGKFIRIVPHPVMIGFVNGLAIVIFLAQLGQFKAPDINGMLTWLPQDQMLLMLGLVALTMAIIHFLPKITTAVPSSLVAIVTVTALVVGLDLETRTVVDFLRTMSGDEAATLAGSLPTFSIPAVPFTLETLQIILPYAIILAAIGLIESLLTLTVLDEMTNTRGQSNRECIGQGMANMTCSVFGAMGGCAMIGQSMINVNSGGRGRLSGIVAAIALLMFILFASSLIEMIPLAALVGVMFMVVIGTFEWATFKLARRVPKQDFFVIVLVTVVTVLTDLAVAVAVGVIVSALMFAWQHAKHIYADTCLNEEGSKEYKIHGPIFFGSAANFLELFNAPEDPKDVIVDFADSRVTDHSAIEAIETLAERYNSQGKTLHLRHLSPDCRKLLDKAGSLVEINVKEDPSYKVATDILAG

SEQ ID NO: 27171 - protein, 233 aa, Oryza sativa Japonica Group
MAAVSEVEVDGVVFPPVARPPGSGHAHFLAGAGVRGVEIAGNFIKFTAIGVYLEEGAAVPALAKKWAGKSADELAADAAFFRDVVTGDFEKFTRVTMILPLTGEQYSDKVTENCVAAWKAAGVYTDAEGAAADKFKEAFKPHSFPPGASILFTHSPPGVLTVAFSKDSSVPEGAVAAAAIENRALCEAVLDSIIGEHGVSPAAKRSIAARVSQLLKAESTGDVAAAEPAPVSA

SEQ ID NO: 27172 - protein, 400 aa, Bifidobacterium longum NCC2705
MVQCPDRIIASMDTGVDDALALAYLLGSADECELGGVIAGYGNVDANTAYANTCAVLDLFGRADIPVFLGSEHPSWADAFIPDAGCAQFHGDDGLGNTRLAGSGALADGACVPGDDMSGDDMSVDVPDEVVSVGGYLAGDVHAHPALGACSRVNRSRSVGHPQSAMPTALASGGKRRCSVDAADGIEYLIEQVREFGRDVTVLATGPLTDVDAAITRAPDIASKLRLVMMGGTLTQPGNCWDAVAETNIIQDPEAANRVFHSGADITMVGLDVTHQCLLPQSAADRWRATGTKRGRFLADLADFSIKANLEADPALFSGGMPLHDPLAAAVALDSSLVDCFDLALRAETNTGDFNGVRGRTTGDPVGLVNHSMPHVHVALGVDSGRFLDEFVERMAEVCR

SEQ ID NO: 27173 - protein, 213 aa, Vibrio sp. Ex25
MSDNNQCVIVGIAGASASGKSLIASTIYNELRAKVGDHQIGVITEDCYYNDQSHLSMEERVKTNYDHPSALDHDLLCEHLEKLVRGEAVEVPEYSYTEHTRTSNTTTMTPKKVIILEGILLLTDPRLRDLMHATVFMDTPLDICLLRRVKRDVEERGRTMESVLKQYQQTVRPMFMQFIEPSKQYADIIVPRGGKNRIAIDVLKAHIARLLKA

SEQ ID NO: 27174 - protein, 690 aa, Xanthomonas campestris pv. campestris str. ATCC 33913
MLPGFDGLRFSHWQADLREDGVLVLSLDRQGAAVNAFSQDVLLELGDVIERLALDPPKGVVLRSAKANGFIAGADLKEFQEFDRRGTVNDAIRRGQQVFQKLAELPCPTVAAIHGFCMGGGTEIALACRYRVASDDGSTRIGLPETKLGIFPGWGGSARLPRLIGAPAAMDLMLTGRTVSAKAARAMGLVDKVAAPAVLVDVAAALALAGTTRPFKQRATAWATNTLLARKLLAPQMRKQVARKARKEHYPAPYALITTWERAGGGGIQARLAAERKAVVKLASTPAARNLIRIFFLTERLKALGGKDTGLPAIRHVHVVGAGVMGGDIAAWAAYKGFEVTLQDREQRFIDTALARGGELFGKRVKDETKRPAVAARLRGDLAGSGVAQADLIIEAIIENPQAKRDLYQSIEPHLKPDALLTTNTSSIPLTELRGHIQRPAQFAGLHYFNPVAMMPLVEIVQHDGLDPANVARLAAFCKALDKFPVPVAGTPGFLVNRVLFPYLLEASTAYAEGIPGPVLDKTAVKFGMPMGPIELIDTVGLDVAAGVGAELAPFLGLPIPAALATVEAGKRGKKDGQGLYKWENGRAVKPEVASGYEVPTDLEDRLILPLLNEAVACLHEGVVADADLLDAGVIFGTGFAPFRGGPIQHIRSVGADALLARLHALQARYGERFVPRPGWESPVLREPVA

SEQ ID NO: 27175 - protein, 265 aa, Acinetobacter sp. ADP1
MRASTVTIKNEQDIEHLRVSGRLAAQVLEMIIPYVKPGVSTEYLDDICHEFIVDTLKVIPANVGYHGFTKTTCTSVNEVVCHGIPSPNKILQDGDILNIDVAIIKDGYFGDTSRMYLVGEVAPEAKKLVKTTYEAMLAGIQVVKPGATLGDIGHAIQTTAQREGYSIVKEYCGHGIGKVYHEQPNILHYGQPGHGMVLEKGMVFTIEPMVNAGKSQVKELNDGWTVVTTDKSLSAQWEHMVAVTETGFELLTPWPTGTGEYPEII

SEQ ID NO: 27176 - protein, 370 aa, Oryza sativa Japonica Group
MEMFFSSFLNESASSENLFGHPNVERCPFLRNINGATTYSFSSALPVAARGGNGPIFEDGPGFDSAFKLFHGWDGIVPLSGKSYLPDESNSESIDANPEPALLFNPLAARAATISLSAFGPFGFNFFNGKGKRQNKKPNNLNQSNKKPSNPNQNSMKQKGGNSSSHEAMSNEWMENGQCPLARSYRAMSGILPLVAKALQPPAGVKLKCPPAVVAIRAALARTELVKSLRPQPLPAKMVAIALLGMAANIPLGVWREHTKKFSPQWFAAVHAAVPFIGMLRKSVNMPKTAMAFTIAASIIGQTIGSRAERIRLKALAAKGDADSTTVADMYPNKSGNCSDTEGKAWDPLAMKMAGRASGGVAAPTPSMCF

SEQ ID NO: 27177 - protein, 950 aa, Acinetobacter sp. ADP1
MLVLEPQHVHMHQHAGDKAEALQCLINILVEDQLVTPEYLSGLEAREQQSATYLGQGIAIPHGTPQSREYILKTGVRLAHFPEGVVWDGENTIYLAVVIAAKSDEHLQVLQILTRALSKDVNEQVKSAQSSEQIIEILQAQPHSLVLHENLIQTDTFVEDIEDFFWNASKLLKQQKLVDPGFISQLDPQNTIQIQDDLWSISGTGYVKQPAVSIVKAQQPLTFQGSTIKTLICIAANEQLDTDQFNRLMDVLFQPQVQQQLETEQSSNEIAKLVGAETIPDWPSRSIVLANAHGLHARPATQMVNLTKTFNGDIQVSVDGGSFVSAKSLTKLLSLGCQRGQMLTFIAEPNTDATDALEQIILAVRQGLGEEVEAIEDQLTSNSSLNGSQLIEETDSVEISHCGIAASAGLAFGPAHIIKPKKFNYDRFGQSLKTEKEKLEIAIHTVKNTIHQFIAKSTSKDIKQIFLAHLEMLDDPDLIKQVHQGLNHNLSAAAAWHEHIEKAAKAQEGLKDKLLAERAADLRDIGDKVLAVLCNEPEVEEPEQSYILIMHDVGPGDVARLNKDRVAGILTAVGGSSAHSAIVARALGIPAVVGAGDGVLNIDPHAVVLINGDNGEFEVNPSAELIENAIREREYQRLRREEAERHAHEPAITVDQHQIEIAANVGKILDTAKAVSHGAEAIGLLRTELVFMSHNSAPDEKVQEKDYRHVLDALAGRPLVVRTLDVGGDKPLPYLPIATEENPFLGLRGIRLTLRRPNLLRQQLIALLKAADNRPLRIMFPMVGRVEEWRAARAILDEVLQQYPCSNLEVGIMIEVPSAALLAPILAKEVDFFSIGTNDLTQYTMAIDRGHPILSAEADGLHPSILLLIDQTVRAAHANNKWVGICGELAADPKAVPVLMGLGVDELSMSITSIPLVKAQIRTLNYAACQELAQKALLCDSATAVRTLVE

SEQ ID NO: 27178 - protein, 466 aa, Burkholderia vietnamiensis G4
MNQAALIEADRQHLIHPVVNYRAHEARGVTVLESADGVFLRDGDGHTLLDAFSGLWCVNVGYGRESIVKAAAEQMAKLPYATGYFHFGSQPAIELAERLAALAPPSLNRVYFTLGGSDAVDSAVRFITHYFNATGRPSKKQMIALERGYHGSSSIGAGLTALPAFHRHFDLPRADQHHIPSPYPYRHPLGDDPQALIAASVAALEAKVAALGADNVAAFFCEPIQGSGGVIVPPAGWLKAMRDACRRLGILFVADEVITGFGRTGPLFACETESVEPDLMTVAKGLTAGYAPMGAVLMSDEIYEGLAGSRTESAVVGHGHTYSAHPVSAAIGLEVLKLYHEGGLLANGRAQAPRFAAGLDALRAHPLVGDARSAGLLGALELVADKARKTRFDPALNVPDKIAAAAYANGVVFRAFGDGVLGFAPALSFTAGEFDLMFERVRKTLDDVLADPGVQRALDAAHAQPA

SEQ ID NO: 27179 - protein, 430 aa, Nocardioides sp. JS614
MSVLVVGISHKSAPVALLEQLALDGPGLHKLIDDVAASEHVTEATVIATCNRLEIYAEVDRFHGSVEEVSRLVVDRAGERTEAMLPHLYVHYDDGAVSHLFQVVAGLDSMAVGEGQILGQTRAALNAGQEIGTVGPALNVLFQQALRVGKRARAETGIDRAAPSLVSAALDRSRATVGELSGKRVLVVGAGSMAGLATSTVAARGTASVTVVNRTSGNADRLAEEYGARSATLAELAAELAVADVVISCTGATGTLITRDMVAAATVDGRELSILDLALPHDVDPTVADLPGVSLVGLTDLADELRDSDAGQEVEAVRQIVTQEVAAFLSARRQASVTPTVVALRSMATSVVEAEMERLTSRVPGLDDDIRAEVLHTVRRVADKLLHQPTVRVRELANETGAVSYAAALAELFALDQEAVDAVTRPEGLT

SEQ ID NO: 27180 - protein, 174 aa, Arabidopsis thaliana
MFFCFCFCESKKGLCMETYLWDYVVYVGGKLDKEKMTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWFVVSELFQTN

SEQ ID NO: 27181 - protein, 490 aa, Burkholderia vietnamiensis G4
MPLTLSRTELVRTANLVDGSWRAALDGRCFDVTNPATLDTIAYAPDSGAADARAATDAAARALPAWRATPARERAAILRAWHAAIVAHTDDLAKLMSLEQGKPLAEARGEVAYGASYVLWFAEEATRTYGDLIPQQQRGKQLSAVKVPIGVVAAITPWNFPLAMIARKIAPALAAGCTVVAKPAEDTPLTALALGFLAMEAGVPPGVLNLIAASRERGIDAVADWLADARVRKITFTGSTAVGKLLARESAATLKKLSLELGGNAPFIVFDDAQLDAAVDGLMAAKFRNGGQTCVSPNRVYVQAGVYDAFAAKLAARVAALKVAPATDPAAQIGPMINARAVDKIARHVGDALERGARVLTGGRRLSQLGPNYYAPTVLADATADMQLSCEETFGPVAALFRFDTEEQAVDAANDTPFGLAAYFYTQDVRRIARVSARLETGIVGINEGALASEAAPFGGVKESGYGREGSKYGLDDYLSIKYLCQGGLD

SEQ ID NO: 27182 - protein, 200 aa, Arabidopsis thaliana
MTDQGLEGSNPVDLSKHPSGIVPTLQNIVSTVNLDCKLDLKAIALQARNAEYNPKRFAAVIMRIREPKTTALIFASGKMVCTGAKSEDFSKMAARKYARIVQKLGFPAKFKDFKIQNIVGSCDVKFPIRLEGLAYSHAAFSSYEPELFPGLIYRMKVPKIVLLIFVSGKIVITGAKMRDETYKAFENIYPVLSEFRKIQQ

SEQ ID NO: 27183 - protein, 722 aa, Deinococcus radiodurans R1
MAGPIPFFLPLSPPVPKESRMKTLFLAPTRNGVGLSSTALGLARALERQSLKVAFLKPIAQTYEPRTDDSVHFARAVAHLTTPDPIPLTRAEELLSQGGEEDLMEQVIALAREAAGEGSDVLIAEGLALNERNVYAGTLNARLARNLEADTVLVSSLAGVTPAELADELEIAAQGYRRSDGSGLAGFVLNFAPRELDFGSLMAELRSRSRVLASGELPLLGVVSLDPALRQLRTLDVARALDAEIINAGEAESRRVSSTVVTARSVPQMTNLFTSGALIVTPADREDVIMAAALSHLSGTPLAGLMYTSGSAPEATIQQLCEVALTSSLPVLRVPTNSFETASRLVHLDFRVPHDDPRRMDRMLDYIADRLDTVPLGARLRAPGVAGERRLPPSAFRYELIQRARAANKRIVLPEGDEPRTVKAAIRCTEKGIARCVLLAPPEKVRQVAQGQGLELPEGLEIIDPETVRGKYVAPMVELRKSKGLTEPQAEAQLEDSVVLGTMMLALGEVDGLVSGAVHTTASTVRPALQLIKTAPGSSLVSSVFFMLMPEQVLVYGDAAINPDPNAQELADIAIQSADSAHAFGIPVRVAMLSYSTGESGSGEDVEKVKEATKLVRERRPELLVDGPLQYDAASVPSVGRSKAPDSPVAGRATVFIFPDLNTGNTTYKAVQRSAGVVAVGPMLQGLRKPVNDLSRGALVDDIVYTIALTAIQATQSAADCG

SEQ ID NO: 27184 - protein, 512 aa, Spiroplasma citri
MKTANKIIILDFGSQYTQLIARRIRHLEVYCEVWPYNTTLEKIKTTPMKGIILSGGPASVYAEDAFLIDKKLFELEVPILGICYGMQLISHLHGGTVQRATKQEFGFSELIIDNQEDLFAKVPIKSQVWMSHADHIEIMPTDFIQIAHSENSISAIKHLEKKIYGLQFHPEVTHTLIGEQLLSNFVFNICGCEPTWKITEFISTATTEIKGKVGSDNVVLALSGGVDSSVCAVLLHKAIGKQLTCIFVDTGLLRQDSGWNDLQKFQEKFKLNIIKIAAQERFLTALKGVTNPEQKRKIIGNLFIEIFNEEAIKIKNVKWLGQGTIYPDVIESISVKGPSATIKSHHNVGGLPKNLPFQLIEPLRELFKDEVRRTGEALGIDSKFVYKHPFPGPGLAVRIIGEITAEKVALLQAADQIFIDELYQTNLYDQVAQAFVVLLPVQSVGVMGDVRTYGYTAVVRSVDTTDFMTANWSRLPFELLEKVSTRIVSEVHGINRVTYDITSKPPGTIEWE

SEQ ID NO: 27185 - protein, 519 aa, Oryza sativa
  misc_feature (14)..(14): Xaa can be any naturally occurring amino acid
  misc_feature (33)..(33): Xaa can be any naturally occurring amino acid
  misc_feature (45)..(45): Xaa can be any naturally occurring amino acid
  misc_feature (53)..(53): Xaa can be any naturally occurring amino acid
  misc_feature (91)..(91): Xaa can be any naturally occurring amino acid
  misc_feature (107)..(107): Xaa can be any naturally occurring amino acid
PGARRLHKWAGTAXRLVLLLLAAAAGGGWLAAXGRREVVTSPHGXAVAADDGXCSRIGRDALRDGGNAVDAAVAASLCLGVVSPASSGVGXGAFMLVRLADGTALAXLYEAWKRHGKLPWKRLVMPAAKLARAFRVSPYLRKQMEATRDGILQNKGISGVYTSNGDILNVGDVCRNIRLARTLVAVAEKGPDVFYKGAVGDQLAKDIQEVGGIITMEDLKKYQVKIRRPLLENVLNILTQYGLPAGFSGSLGIHRLIESLKHYFAIRMNLGDPEFVNVNEVVSDMMSPKFAADLKKTIYDNMTFDPKHYGGRWNILQDHGTSHLSIVDSERNAVSMTTTVNAYFGSLILSPSTGILLNNEMDDFSMPANTSANSPPPAPANFVRPLKRPLSSMTPTIILKDGNLKAAVGASGGSMIPAGTMEVLLNHFVKNMDPLSSVMAPRVYHQLIPNVVQYENWTTVTGDHFELDAATRADLRRKGHVLEPLAGGTISQLVVDDVERHGGLTAVSDPRKGGFPAGY

SEQ ID NO: 27186 - protein, 394 aa, Wigglesworthia glossinidia endosymbiont of Glossina brevipalpis
MKIIKVTDLNLKDKKVLIRSDLNVPIKNGKIMCNMRIIKSLETINFVIKNEAKCVIVASHLGNPIEEKYDYNFSLTHIVNHMKKIIKYPIRLIQNYLNGFEAKEKEIIVLENVRFNPGERKNDKNLSKKYANLCDILVMDSFGSSHRSESSTTGIIKFAPISCIGLLFLKEIKYLKKALFNSKRPIVTIFGGSKISTKLGVIEKLSNISENVLVGGGIANTILFSKGHNIGKSLHDKNNISKIKKFLYKKNIIIPKDFIVTDNINKFSSYKEKSIKEIKNEDYIVDIGKKSCECFIKIIKKAKTIFWNGPLGLIEIKQFRNGTKEIANSVIHSSAKSIIGGGETVLAMRMFNFIDRFSYISTGGGAFLSFIEKQELPVLSELKKFKKYTNFKQN

SEQ ID NO: 27187 - protein, 251 aa, Oryza sativa Japonica Group
MAKEVDPCDHGEVVDAGCVRAVLAELVLTFVFVFTGVAATMAAGVPEVAGAAMPMAALAGVAIATALAAGVLVTAGFHVSGGHLNPAVTVALLARGHITAFRSALYVAAQLLASSLACILLRYLTGGMATPVHTLGSGIGPMQGLVMEIILTFSLLFVVYATILDPRSSVPGFGPLLTGLIVGANTIAGGNFSGASMNPARSFGPALATGVWTHHWIYWLGPLIGGPLAGLVYESLFLVKRTHEPLLDNSF

SEQ ID NO: 27188 - protein, 490 aa, Arabidopsis thaliana
MAIILCFLILLPLILIFLKKLKHSKWKLPPGPPKLPFIGNLHQLQELPPRNLNHKYGPVILLRFGFVPLVVISSKEAAEEVLKIHDLECCSRPETAGTRKISYNFKDIGFAPYGEEWKAMRKLSVVELFTAKKHQYFRSIREEENDLLVKKLTELALTRSPVNLKKTLFTLVGSIVCRIGFGFNLHECEFIDENSISDLVDKSEILEMTSMFSDFFPGGIGRFIDWISGQNKRFDNVFSDLDTFFQNILDYHLKPGRKVADSSDIIDVVINMIKKQEKDGDSFKLTTDHLKGMISDIFLAGVSTSASTLIWAITELVRNRKVMKKVQEEIRTTLGDKKERITEQDLTNLHYFKLVVKEIFRLHPAVPFLLPRETLSHVKIQGYDIPAKTQIMINVYAIARDPKLWTNPDEFNPDRFLDSSIDYKGLNFELLPFGSGRRICPGMTMGITLVEFALLNLLYFFDWGLPEKEEADKIITGNGVAVGLVQVLLH

SEQ ID NO: 27189 - protein, 229 aa, Mycoplasma genitalium G37
MIGAKTRVAIVGGIGYIGSCFASFIKEQNDKLIVTVIDNNKNNHVIKLLKKIGIEFYFADLLDRHKLTEVIAAIQPDVVFHFAAKTSVSESVHNPLKYFDCNVIGTLNLISAISNLQKPIKLFFASSAAVYGQTTNSYISEEIVITETQATNPYGLSKFLDELILNAVAKNSQLQVVCLRFFNVAGAILPFGNFNGNTTLLIPNLVKAFLKQTPFFYMAMIMQLRMVVA

SEQ ID NO: 27190 - protein, 63 aa, Glycine max
LMDNLPSELAQELAYIKHLYCASPLTLHPTIANMDLRSLFPYSPSDGTPMARHINHLPGFPDE

SEQ ID NO: 27191 - protein, 429 aa, Mycobacterium bovis AF2122/97
MPIIEQVGAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 27192 - protein, 483 aa, Mesorhizobium sp. BNC1
MSGRKYPNPSLFINGRSVTGRGAKEEMVIDPSNEEVLGSYRSAAPEDLQELLDSAAAGFEKWRRTSAYERCEILHKVAAALRENAQEIGSLLTLETGKILSESITEVRGAADHFDWSGEEGRRLYGYTVPARRAESRLRVELEPLGIVFALIPWNFPLGTSARKVAPALAAGCSVILRPPEEAPATVEAFVRCCQEAGLPPGVLNMVLGSPKDVVEPLMASFSVRAVTFTGSTRVGKILIQQAADTVKHLVLELGGHAPAIVLPDADPKKVGVAAARAKFRNAGQVCVSPSRFIVHEKIVEPFTQAMVEETRSIKLGSGFDAGAQMGPLTTARQRERVERLVEDARSKGARILAGGQRPSGFNRGFFFEPTVLGDVPDTALIFEEEPFGPVAPIIPVRSVQEAVEKANAVKWGLAGYLFTSSLADATKVSEAMQVGMVGLNTFAAAAPEAPFGGVKESGYGRECGLEGIREFVSSKLIHTDIG

SEQ ID NO: 27193 - protein, 176 aa, Zea mays
RRLLLDPAIPEEFTRLKNLVEEKEKKIKELQDNVAAVNFTPSSKLGKMLMAKCRTLQEENEEIGAMASEGKIHELGMKIAVLKSQNNELRNQFDVLYKHMDGVTNDVERSNELVAILQEELEAKELEVTRLKEETLSQKEGTPDAPAPAPAPVEEGDGAGNDLKPASDPLQVKLES

SEQ ID NO: 27194 - protein, 163 aa, Acinetobacter sp. ADP1
MVVQIRIGQGMDVHAFEEGDHVTLAGIKIPHTHGLKAHSDGDVVLHALSDALLGALALGDIGQHFPDTDVQFKGADSRVLLKHVYQLILDRGYALNNADITVACERPKLAKYNLEMRQSIADVLDVDVTQISVKATTTEKLGFTGRQEGILATATVLVSYQAK

SEQ ID NO: 27195 - protein, 437 aa, Leptospira interrogans serovar Lai str. 56601
MKFYRRKVEFEKHGKNRMREKSLQYHALHPKGKIEVVPTKPTEDSYDLSLAYSPGVAYPCLEIKDSPELVYEYTNKGNLVGIITNGTAILGLGDIGALAGKPVMEGKAVLFKKFAGIDVFDIEINTKDPDEFIRAVKLLEPTFGGINLEDIKAPESFYIEEQLIEKMNIPVFHDDQHGTAIITVAGLLNSFKLTGKNPDDVKVVICGAGAAGIAIAELIQHIGIKKEQIFLVDTKGVIHHNRNDLNDSKKKYIQKTDSTTLRDVMKGSDIFIGVSVENMVDEDMVRSMSKNPVIFALANPDPEIPYRVAKAVRSDLIMGTGRSDNPNQVNNVLGFPFIFRGALDVRARHITLEMKLAAARSLAELARLEVPEVVSKAYGGEKFTFGPEYLIPKPFDKRVLFHVAPAVAEAAVASGSARIPYLGREKYLGFLEGIIKS

SEQ ID NO: 27196 - protein, 797 aa, Xanthomonas oryzae pv. oryzae KACC10331
MNENILWLHELRLADLARVGGKNSSLGEMIGNLAGLGVSVPGGYATTAEAFKDFIAHNDLSKRIFDKLATLDVEDVNALTLAGKEIRGWVIDAPLQPELDRDIRTAYEQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFSLEAKDAKILVEGRAVGAKIGGGVARVVRSLDDMNRVQAGDVLIADMTDPDWEPVMKRASAIVTNRGGRTCHAAIIARELGVPAVVGSGNATDVLSDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGDGADGKPGLKIIMMCELPSNALLADEFLDIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSES

SEQ ID NO: 27197 - protein, 383 aa, Magnetospirillum magnetotacticum MS-1
  misc_feature (2)..(2): Xaa can be any naturally occurring amino acid
MXCPRGQQGDGTTSSKAFFQKIAFPAGAGNVRYLACSHTPGGPGDAEAIYALMDNGDVYAWGYNGYGQLGLGDTNNRAVPTKIGMFNRNVRAVIAGGGSYGHVAFITTDNKLYLCGYNGSGQIGDGTTSNKTIPVLVDVGGPVVKVAMGGSFSGYGWTLVLRADGKLYGMGYNGYGQLGDNSSTNRATPILVTMLGLTDATKVIDIWAVCGMFGSSFAMTKDGSFWSWGANTNGKLGLGDTANRVAPTLVPNVTHVSQVISPTTGINATYIYDNIVLLRHATAADRIARVNGYVMTVGYGTSFIAGPNIPNPQMSFRMVGFPNRYHGKIRRIAVSGFHQGNDGEPQAMALAMDGTVFSWGPSNTFSLGLPENQSSNAPLRVRF

SEQ ID NO: 27198 - protein, 103 aa, Capsicum annuum
KKVMHNLRLYQVPLQRYMAMMDLQERNERLFYKLLIDNVEELLPVVYTPTVGEACQKYGSIFKRPQGLFISLKEKGRILEVLKNWPEKSIQVIVVTDGERILG

SEQ ID NO: 27199 - protein, 431 aa, Acinetobacter sp. ADP1
MFMSQIVDIRAREILDSRGNPTIEADVILASGVVGRACAPSGASTGSREALELRDGDKARYLGKGVKTAVNNVNTIIRDALVGKSVFEQKDIDNTMIELDGTENKEKLGANATLAVSLAAARAAADEKKIPLFQYIADLRGQTILTMPVPMMNIINGGSHADNNVDIQEFMIEPVGFTSFSEALRAGAEIFHSLKSVLNKKGLNTAVGDEGGFAPNLRSNEEAITVILEAIGQTGYKAGSDIMLALDCASSEFYKNGQYILAGEGNKAFTSNQFSDYLAGLVNQYPIISIEDGLDESDWEGWSYLTSILGDKIQLVGDDLFVTNPKILQRGINEKVGNSILIKYNQIGTLTETLDAIYLAKDNGYSTVISHRSGETEDSTIADLAVGTAAGQIKTGSLCRSDRVAKYNQLLRIEELTKAAYRGKAEFKGLN

SEQ ID NO: 27200 - protein, 131 aa, Zea mays
MTSPWCLSAPPAALGFSASASTLARVPVPGSRRRRWNALVVCAAPDEEKITKRSPLDFPIEWERPKPGRRPDIFPKFSPMKTPLPHPLPADDPLDDDEEEEEEQAPPQEEPQEDDPDKEEPEEDDPDKPTE

SEQ ID NO: 27201 - protein, 297 aa, Sphingomonas elodea
HHHHHHGSMTIKPLRKAVFPVAGLGTRFLPATKAMPKEMLPVVDRPLIQYAVDEAVEAGIEQMIFVTGRGKSALEDHFDIAYELEATMAARGKSLDVLDGTRLKPGNIAYVRQQEPMGLGHAVWCARDIVGDEPFAVLLPDDFMFGQPGCLKQMVDAYNKVGGNLICAEEVPDDQTHRYGIITPGTQDGVLTEVKGLVEKPAPGTAPSNLSVIGRYILQPEVMRILENQGKGAGGEIQLTDAMQRMIGDQPFHGVTFQGTRYDCGDKAGFIQANLAVALSRPDLEPAVRAFAVKALG

SEQ ID NO: 27202 - protein, 353 aa, Deinococcus radiodurans R1
MTTLDRGGVYFFPMTKAARSSKKSAPSVPTPAQARLHTPDTLPRPVLAGRDFLSNLDMTSAELRAVMDTAHSMKAGEWRAVKPLSGLSLALVFEKASLRTRTTFDVGMYQLGGHAITLSNTEIGLGTRERVSDVARNLERWVDGVMGRVYLQQTLVELAQHARIPVINGLSDMLHPAQLLADYQTIEEEFGQDLRGKRVVYIGDGNNLANSHIHMGILTGTDVTVVTPVGYEPNAGVLMDAVKAGVEVHLTNDLDAIQGADVLYTDVWISMGQEAEADIRRRAFRGYQVTPEMLETISPDGIFLHCLPAHYGEETVPEATEHPKSRVFDQAENRLHAQKALLYHVLGDMKPRW

SEQ ID NO: 27203 - protein, 535 aa, Salmonella enterica subsp. arizonae serovar 62:z4,z23:--
MLAGVDGIGGIPFDNYPFAYMVSNLALAIILLDGGMRTQASSFRVALGPALSLATLGVLITSGLTGMMAAWLFHLNLIEGLLIGAIVGSTDAAAVFSLLGGKGLNERVGSTLEIESGSNDPMAVFLTITLIEMIQKHETGLDWMFAVHIIQQFGLGIVFGLGGGYLLQQMINRISLPSGLYPMLALSGGILIFALTTALEGSGILAVYLCGFLLGNRPIRNRYGILQNFDGLAWLAQIAMFLVLGLLVTPSDLWPIAVPALILSLWMIFFARPLSVFTGLLPFRGFNFRERIFISWVGLRGAVPIILAVFPMMAGLENARLFFNVAFFVVLVSLLLQGTSLSWAAKRAKVVVPPVGWPVSRVGLDIHPDNPWEQFIYQLSADKWCVGAALRDLHMPNETRIAALFRNNELFHPTGSTRLREGDVLCVIGRERDLPALGKLFSQSPPVSLDQRFFGDFILEANAKFADVALIYGLEEGMEYRDKQQTLGEIIQQLLGAAPVVGDQVEFGGMIWTVAEKEDNVVRKIGVRVAEDEAE

SEQ ID NO: 27204 - protein, 417 aa, Deinococcus radiodurans R1
MADIKVPVFSESVSEGTLLTWHKKPGEAVKRGELLAEIETDKVVLEVTAQQDGVLQSIAKNEGDTVLSEEVLGTMGEGDAAAPAPAAQDQASGPVASETTAGGTAQQPDSTGTQPAAQSGERREDLSPAVRKIVEEKGLDVSQVPATGPKNNITKADAMGASAPAPAAQPAPQAAKSAVVLPSGPRPEERVPMTRIRARIAERLKEVQNTAALLTTFNEVNMQPTMELRKKYQDQFVKKHGVKLGFMSLFVRAATEALKAFPMVNASVDGKDVIYHGYYDIGIAVASERGLVVPILRDTDNMSLADIEKQIAEFATRARAGKLTMEDMSGGTFSITNGGTFGSMMSTPIINAPQSAILGMHNIIERPIAQNGQVVIAPMMYLAVSYDHRLIDGKEAVQFLVMIKNLLEDPARMLLDL

SEQ ID NO: 27205 - protein, 483 aa, Bradyrhizobium japonicum USDA 110
MNTISMLVGGEQRAATGNATFERLNPLDGQIATRAPAATADDAVAAVEAAAAAFPSWSATGPSERRALLTKAAHALEAKAPAFAASIAAETGGSGIWAGFNVHLAAGMLLEAAAMTTQISGEIIPSDVPGSFAMAVRQPAGVVLGMAPWNAPVILGVRAIALPLACGNAVVLKGSELCPATHGLIVEAFKEAGFPKGVVNYVTNAPSDAGPVVEAMIAHPTVRRVNFTGSTRVGKIIAATCAKYLKPAVLELGGKAPLVVLDDADIDSAVNAAAFGAFANSGQICMSTERIIVDEAIADEFVRRLADKASKLPLGDPRKGPVVLGSVVDMTTVKRCNDLIEDALAKGAKLLCGGKAETTLMPATLIDHVSSAMRIYSEESFGPIKPIVRVKGEDAAIACANDNAYGLSSAVFTRDTSRGMRVASRIQSGICHINGPTVHDEAQMPFGGVKDSGYGRFGGKSGVAEFTDTRWMTIQTSERHYPF

SEQ ID NO: 27206 - protein, 254 aa, Mycobacterium smegmatis str. MC2 155
MVDMKTKSDINAMSAAGAVVAEALREVVANADAGRTTADLDSIAAQVLAVHGATSPFLDYHPRWAPSPFPAVLCVSVNDAVVHGIPGPQVLADGDLVSVDFGAILGGWCGDAARSFVVGTPRPADLALIEATDAALAAGIEAARPGNTLGDIGHAISATVRDAGYALLADHGGHGIGHTMHEAPHVPNVGRRGEGMKLRPGLVIAIEPMLIADGTEDYVHDPDGWTLRTATGARAAHSEHTVAITDDGPRILTL

SEQ ID NO: 27207 - protein, 441 aa, Salmonella enterica subsp. arizonae serovar 62:z4,z23:--
MYHGQLKNILLLSLRFIMDKLSYASDSSTSAWNTYLQQIERVAPYLGELSRWVDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQIEHKQIAGFPGAETIASDAFWSLEMDILIPAALEGQITRQRAEVLTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 27208 - protein, 182 aa, Wigglesworthia glossinidia endosymbiont of Glossina brevipalpis
MRLNIPTCLTLFRLIIVPFFIIVFYLPFSNASFYSAIIFILAALTDWFDGFLARKLNQTTCFGAFLDPVADKIIVVIGLILIIEYFHSFWITIPSLIMIIREIIISSLREWMAEIGKNNLLSVSLISKLKTSIQMLAIFSLLWKETYIIIIIGILSLYVSSILAFLSMLKYFYIAWRDLFRN

SEQ ID NO: 27209 - protein, 672 aa, Legionella pneumophila str. Lens
MNNYKHWDLQRDKDAILWLGLNRRDAAVNSINEEVLDELNSLLHEISHDKKAMGLIIYSLKEKGFIAGADVNAFSQFESSSQAVDFLQKGQTVFARLQALSIPSVAMIDGFCMGGGYELALACTYRIATDDKDTRIGLPEVMLGIHPGWGGTVRLPQLIGGFKALSQVILTGSAIPAAKAKSLGMIDEVVPVRQLRRAAVYFIKNKPPRHRASFIESLTNSSLLRKAIAYLLRYNVAKRVRKEHYPAPYAVIDLWEKEGGVGERAYLKEVDSIEKLVSQNDTAKNLIRAFLLRERLKGFAKDSHFKMAHVHVIGAGVMGGDIAAWCALRGLQVTLQDKSYEQIAPAIGRAHKLYSKKLRKPRLIQAAMDRLIADPHGHGVKRADVIIEAVFENLAVKQEIMKTVEKNAKKDAIIATNTSSIPLDEISSVMSKPERLVGIHFFNPVAKMDLVEIVSSSSTTKKVQQSACAFVNQIGKLPLPVKSSPGFLINRVLMPYLMECVQLLDEGYSAETIDEAALQFGMFMGPVELADTVGMDVCLAVAENLTGHFGGTIPQRLRDLVKEGKLGRKTGEGFYKYKNGKVIKKKAPPHVDKTIADRLILRMVNESAACIREKVVEDSDLLDAGMIFATGFAPFRGGPMNYANDFGKDKLETLFKTFESKYGERFKVDTSL

SEQ ID NO: 27210 - protein, 653 aa, Zea mays
MASAAAVIASPAPGAAAAEPAAWLVDERDGFITWLRGEFAAANAIVDHLIFHLRSISEPGEYDHVFSLVQQRRHHWPHVIHMQQFFPVSDIAFALQQASWRRHAPPAQALGAGASPAALPPPPPRRASFSQSHHSHQHHRHGAHYRPDPARGAATAATGSEKDGREVHNNKEGRGLKEAGNVVDTKSLRLDSPITDEGEEKSKLQAVSEESSKMVATPVEYSTNEIIDGSMVNTVEGLKVYEGLLNVTEANKILSLVNETRASYRRGGLEARQKVIIAKRPMKGHGREIVQLGVPIIDGPPDDENLRETRVEAIPGLLNDLFDRLSQQEIIPFKPDYCVIDIFNEGDYSHPHQSPSWYGRPLCTLCLTDCDMVFGRYISGEKGDHRGPLKLSLATGSLLLMQGRSIDCAKRAIPATRKQRVILNFGKSVARKHIPAESAWSTPLTPPMPWGQSSRPVNGSRHPQSPKHYGYAPISGVLPAPPVGAHHVPPSDGMQPLFVAPAPISAAAIPFTPTVPLQNTSAAWIQEVTPRPAPPRFPGPGTGVFLPPGSGHPLPHQMMPASHGHGEPNSPQGSSAYLHSKVNGKETSNGNLSPKNSPRKTSCTAEEKPECNGSLNGGGGSADEKSTVGMEQQNGVQKNVGSSKVQPHGHATE

SEQ ID NO: 27211 - protein, 362 aa, Cryptococcus neoformans var. neoformans JEC21
MQPHTQPPQPEASSSRAVHIPSDPAPPRPCLTNDAIVSRWQSSPGFQYFWAWIKRRCDRLKGKEIIRGPFDHSAHGIRSLMNMLDQMTSWVEDATPQPQSNQRFGNLAFRTYNKLLQERLPPLIDSWDIPSNLRSQLLPLFINSHAFGHPTRLDYGTGHELAFVLGLWCCVVPGWVGGDNGTEEEEDELILRVFTRYLELTTFLQKTYNLEPAGSHGVWGLDDYCFLPYLFGSAQLLGSNLTPSASLSLALSHHPSATSPPSAPITDLYTLSLHHLTLFKFGASFSEHSPLLYSLSQMPNWVKPHGGLKKMFLGEVVGKRVVVQGIWVGGWCWGEDVPNVEERGDKNEGKGTDAGTKAPWAR

SEQ ID NO: 27212 - protein, 239 aa, Glycine max
LALASAHVIGALSFPRTNRQAKKESAPINGGSCKFGANCKFNHPDPTAVGGGGGNPPSGYGNGGSISLQGVSQTSVPSWSSPRTLNEASPFVPMMLSPTQGVSTQSSDWNGYQASVYLPERSIHPPSTFVMNNPAIDTNVYMHHQKQMPVDEFPERPGEPECSFFLKTGDCKFKSNCKFHHPKNRVTRLPPCNLSDKGLPLRPDQSVCSHYSRYGICKFGPACKFDHPDKLAARDDSWT

SEQ ID NO: 27213 - protein, 434 aa, Candida albicans SC5314
MQASLFRIFRGASLTTTTAAASFTATATAGATTAKTLSGSTVLRKSYKRTYSSSVLSSPELFFFHQFNNNKRYCHTTTTTNTKTIMSEQIPKTQKAVVFDTNGGQLVYKDYPVPTPKPNELLIHVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILSRYVLDTS

SEQ ID NO: 27214 - protein, 131 aa, Oryza sativa
  misc_feature (32)..(32): Xaa can be any naturally occurring amino acid
  misc_feature (44)..(44): Xaa can be any naturally occurring amino acid
PGVPLPLFYFKDFSNSPPFYSPAFGYTVPPLXHSPKWAELENGXTTFAFPPLPQRETDALTGPVQLPDSAGERGPLEIFFDYPDVDAGYRRAVDNGPVPVSPPDQKNWGQKVGFVRDIDGFFVGMGSPVRG

SEQ ID NO: 27215 - protein, 242 aa, Oryza sativa Japonica Group
MSPSRSRSNSRSRSRSRSGSKSKSKSKSRSRSRSRSRSRSPRRERLRSERVSRRSRSRSRSRSPIRRREHRGHRHFAAECTSETVCWNCKQSGHIATECKNDALCHTCSKTGHLARDCPSSGSSKLCNKCFKPGHIAVDCTNERACNNCRQPGHIARECTNEPVCNLCNVSGHLARNCQKTTISSEIQGGPFRDITCRLCGKPGHISRNCMTTMICGTCGGRGHMSYECPSARMFDRGLRRF

SEQ ID NO: 27216 - protein, 1249 aa, Methanopyrus kandleri AV19
MPGLPIKLRVEKAYPEDVGKRAVRMDKASRDRIGVSEGDLVKITGSKTTVARVLPAKKEDVGKGIVRMDKYERQNAGASVGEPVEVDRAEEKVAKRVELMPTERVVVPVQAGLKEEVEEELTREHEQDILEQIKRYLRSRAQQTPIPATHRDVIPLEVQGKTIAGHVLIKFPDSLLVVGIEPEDATVIGPETEIEVKPYSEDLAKAAEIPDVTYDDIGGLDREIELIREYVELPLKRPELLKELGIKPPKGVLLYGPPGTGKTLLAKAVANECGAKFYSINGPEIMSKYYGESEARIREVFEEARKNAPAIIYIDEIDAIAPKRGETGEVERRVVAQLLTLMDGLSEDERVVVLASTNRPDDIDPALRRPGRFDKEIEIGVPDKEGRKEILQIHTRDMPLADDVDLDKLAELTHGFTGADLEALCKSAGLKALRRAIRKIGAKLAEKGEKEEREVAVKVSELSDEELMEVLEKGLDRARIPEEKKRALRRVLREAEEEEKEEVAYTDALDKVLEAEELPEIREELKVTMRDFMEALKEIEPSALREVIVEVPDVSWDDVGGLEDVKQELKEAVEYPLKYPEVYEKLGTRPPKGILLYGPPGTGKTLLAKAVANESDANFIAVRGPEVLSKWVGESIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNSEKKIREIFQKARQTAPCVIFFDEIDAIAPKRGTEVGGSRVTERIVNQLLTEMDGIEATEDVFVIAATNRPDIIDEALLRPGRFDRIVYVPPPDEEAMKEIVKIHTRDMPLAEDLTVDDIVEILRRREREEDAKYTGADIEAVCMEAAMLALREVLDELERIEKESETEEELEARKEALLEELRVERRHFEKAVEKVPPSVPKEKLEEYEKLKEEYQRLAG

SEQ ID NO: 27217 - protein, 714 aa, Vibrio sp. Ex25
MSRTIMLIPTSAGVGLTSVSMGVLRAMERKGVKVSFYKPICQPRSGGDQPDLTSTIVGHNSDMKIGEPMAMSVAESLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNELKVMEIFNTSPIRVLGCVPWSIDLIATRAIDMAKHLKADIINEGDINTRRIKSITFCARSLPNMIEHFKPGSLLVTSADRPDVIVAASLAAMNGVDIGAVLLTGGYDIPREIEGLCKPAFDTGLPIFKAQGNTWQTSLNLQSFSIEVPADDKERIEFINEHVAGHIDGNWIESMTEGTQKSRRLSPPAFRYQLTELARKAGKRIVLPEGDEPRTVKAAAICAERGIADCVLLGNPDEIRRVAAQQGVELGTGVTIIDADAVRENYVARLVELRGAKGMTEVVAREKLQDSVFLGTMMLENDEVDGLVSGAVHTTANTIVPPFQIIKTAPNASIVSSVFFMLLPDQVLVYGDCAINPDPTAEQLAEIAIQSADSAAAFGIDPRVAMISYSTGESGKGADVDKVREATRIAKEKRPDLVIDGPLQYDAAIMENVAASKAPNSPVAGKATVFVFPDLNTGNTTYKAVQRSADLVSIGPMLQGMRKPVNDLSRGALVDDIVYTIALTAIQADQEAK

SEQ ID NO: 27218 - protein, 133 aa, Triticum aestivum
  misc_feature (4)..(4): Xaa can be any naturally occurring amino acid
  misc_feature (6)..(6): Xaa can be any naturally occurring amino acid
  misc_feature (13)..(13): Xaa can be any naturally occurring amino acid
  misc_feature (21)..(21): Xaa can be any naturally occurring amino acid
  misc_feature (32)..(33): Xaa can be any naturally occurring amino acid
  misc_feature (40)..(40): Xaa can be any naturally occurring amino acid
  misc_feature (43)..(43): Xaa can be any naturally occurring amino acid
  misc_feature (63)..(63): Xaa can be any naturally occurring amino acid
  misc_feature (68)..(68): Xaa can be any naturally occurring amino acid
  misc_feature (71)..(71): Xaa can be any naturally occurring amino acid
  misc_feature (78)..(79): Xaa can be any naturally occurring amino acid
  misc_feature (87)..(87): Xaa can be any naturally occurring amino acid
  misc_feature (90)..(90): Xaa can be any naturally occurring amino acid
  misc_feature (92)..(92): Xaa can be any naturally occurring amino acid
  misc_feature (95)..(95): Xaa can be any naturally occurring amino acid
  misc_feature (97)..(98): Xaa can be any naturally occurring amino acid
  misc_feature (100)..(100): Xaa can be any naturally occurring amino acid
  misc_feature (102)..(102): Xaa can be any naturally occurring amino acid
  misc_feature (108)..(109): Xaa can be any naturally occurring amino acid
  misc_feature (114)..(115): Xaa can be any naturally occurring amino acid
  misc_feature (122)..(122): Xaa can be any naturally occurring amino acid
  misc_feature (124)..(124): Xaa can be any naturally occurring amino acid
  misc_feature (126)..(126): Xaa can be any naturally occurring amino acid
  misc_feature (130)..(130): Xaa can be any naturally occurring amino acid
  misc_feature (132)..(132): Xaa can be any naturally occurring amino acid
EAVXDXEFINVKXFDYIGKKXVIFFFYPLDFXXVCPTEIXAFXDRHEEFEKINPEIFGVSVDXVFSHXAWXQTERKFXXLGDFKYPXVFXVXKSXSXXFXVXIPDQGXXLRGLXXIDKEGVXQXSXINNXGXG

SEQ ID NO: 27219 - protein, 569 aa, uncultured bacterium
MQELNEVGLSVAGMTCPSCTRHVEDALLAVPGVTRAAVDYPSNKAQVTGNRLDVSALVAAVGALGYGATPTDEFESKERSVEQPGLLGKAAQWLSGERAVEKPAGQLHVAIIGTGGAAVAAALKAAENGARVTLIERGTIGGTCVNVGCVPSKIMIRAAHIAHLRRESPFDVGLSATPPVVLRDRLLAQQQARVDELRHAKYESILESNPSINLVRGSARFKDGQTLIVEAAEGDTREVAFDRCLIATGASAAIPPLPGLAGTPYWTSTEALVSEAIPKRLAVIGASVVALELAQAFARLGSEVTVLARRTLFASDDPAIGEAVTAAFRAEGITVLTQTQASAVTYCDRQFILTTAQGELKVDQLLVATGRTPNTASLNLERAGVTFDSQHRILIDQGMRTSASNIYAAGDCTDQPQYVYVAAAAGTRAGINMTGGDVKLDLDAMPAVVFTDPQVATVGYSEAEAQRIGLQTESRTLTLDNVPRALANFDTRGFIKLVAEAGSGRILGVQAVTPEAGEIIQTAAIAIRARMTVQDLANQLFPYLTMVEGLKLVAQTFSKDVTQLSCCAG

SEQ ID NO: 27220 - protein, 315 aa, Vibrio sp. Ex25
MGKLVEGVWHDVWYDTKSNGGKFVREDAGFRNWVKNEPDAEFKPESGRYHLYVSLACPWAHRTLIFRKLKGLEPHIDVTVVCPDMLSQGWQMGLPEPLFGHTRMHQIYTQAKPDYTGRVTVPVLWDKKTNTIVSNESSEIIRMFNSEFNELTGNHDDYYPEQLKHVIDEWNDFVYPNVNNGVYRCGFATTQEAYEEAFDSLFAALDKIDSHLATHRYLAGNTITEADWRLFTTLIRFDAVYVGHFKCNKLRIADYENIQGYLKELYQVEGVEETTDFYHIKRHYYFSHTGINPTQVVPKGPDLDLISPHGREIIS

SEQ ID NO: 27221 - protein, 243 aa, Debaryomyces hansenii CBS767
MDSLKLPTTAAQAKAFTAPNSLLFPLGIDGQRTDINQEATPKKEEDTSDTIVEPNQDEDDGATSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDVKFPIRLEGLAFSHGTFSSYEPELFPGLIYRMVKPKIVLLIFVSGKIVLTGAKQREEIYAAFEAIYPVLSEFRKS

SEQ ID NO: 27222 - protein, 361 aa, Methanopyrus kandleri AV19
MRAALALEDGTIVHGELFGSPREAEGEVVFNTSHTGFQEALTDPSYRGQILIMTFPMQGNYGILPEVGESDRVQVEGFVVRYLHDGPIHPRAEITLDEFLQDHGVPGIAGVDTRMLTRKIRTEGAMRGVLVPYEPDDQPSDEELLERVREVPHISEMDLVPQVSVREEYRFSDGKPEIVVIDCGVKRSILRELAKRGAGVTVVPYDTSAQEIMDIDPDGVVVSNGPGDPKRVRETVETVRELIGQVPLMGICLGNQILGLAEGGDTFKLKFGHRGANQPVKDLDKDRVYITSQNHGFALDPDSLRDTPLRVRWVNVNDGTVEGVVHTDAPAFSVQFHPEAGPGPWDTKWVFDEFLAMCREH

SEQ ID NO: 27223 - protein, 120 aa, Debaryomyces hansenii CBS767
MDSLKLPTTAAQAKAFTAPNSLLFPLGIDGQRTDINQEATPKKEEDTSDTIVEPNQDEDDGATSGIVPTLQNIVATVNLDCRLDLKTIALHARDAEYNPKRLEDVIMRIRENKNKELIFE

SEQ ID NO: 27224 - protein, 846 aa, Magnaporthe grisea 70-15
MTVVAGPTYPLELLQGTKVTKFAKKRGSTTSRKQLMLVLDAESAKITWDKSKPSKSIYIDDIKDIRTAEDIRQYRLDFGIPESEEPLCFSIIYATHDVKPKTKMMHLVAGDPAIVDMWVSTLHTISMHRQDIMSSLMAFNDKAIRTYWKNELHKQLKNTSNNGEENIDFLGVERVCQNLHIHVSSETLKEKFLEALGTSSVDADASVKNGRLNFSQFQEFVRLMKRRADIRPIFRERASDIERGMTLLDFVSFLTDVQNEDVDADRAYWEAIFARFAKRNKSKDLEGDDVPRISEAALVSFLTSTYNVPIVSAPKNYTLDRPINEYYISSSHNTYLLGRQVMGFSSVEGYISALMRGCRSVEVDCWDGGDGWPLVSHGWTMTTNIAFREVMNVINKYAFVKSEFPLWISLEVHCNPDQQRKMVAIMKEIFGARLVTEPLEGLPADKLPSPSQLKNRILIKAKKPGHEEPNPERTGRRRGNSLTSPYTKPVMLDNSTIPSQSLPHSPLLTPTHSQIRRMGAKTRVNTITEGRVHDSTSGSPSDCDSGSERDIQQPISPNSGTSKIVKELGDLAVYCAGIKFSGFEHPDSKTVNHIFSFHEGTFQRHGRPGDAKRALYRHNMRYMMRVYPHRGRVYSSNFDPLLMWRRGVQMAALNWQTFDLGMQLNHAMYDGGMDQSGYVLKPKEFREIQHFPYLPEHMVGGKRPRKNVKFSIDVISAQQLMRPHNLRDRHTLDPYIEVEAFLADDKRNTNKEYSDAGPSKTKHKTPIAKDNGFNPIFDQRYNFNFNTKYPDLIFIRWTVRLSEGGSQSDRSTILGTESVNKLRSLGRTVFNRSNNSPKSSVDGGSQ

SEQ ID NO: 27225 - protein, 517 aa, Zea mays
MTDLAKLISLYKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRHADPLALRLLERLLAFDPKDRPSAEEALADPYFASLANVEREPSRHPISKLEFEFERKKLAKDDVRELIYREILEYHPQMLEEYMKGGEQISFLYPSGVDRFKRQFAHLEEHYSKGERGSPLQRKHASLPRERVVVSKDGNTERQINDQERSADSVARTTVSPPRSEDADMDDVKPTSLSSRSYLKSASISASKCVVVRNKHPEPEDDGIPEEMEGTVDGLSEKVSRMHS

SEQ ID NO: 27226 - protein, 624 aa, Nocardioides sp. JS614
MADVDTALFLVALAVAVLAGVVVAGRIGVPAPLLLVVAGVAASFLPFLPEVHLEPDVVLFGLLPPLLYSAAITSSLVDFNANRRPILLLSVGLVVFTTLGVGVLVHELVPGLSWPVAFALGAVVAPPDAVAATSIGRHIGLPRRVVTILEGESLFNDATALVSLQTALGATLVGVELWRVGLDFVVAAGGGVLIGVVVFLVVGAMRRRLSDPMLDVAMSFVIPFTAFLAAEEVHASGVVAVVTAGLLLGHRAPVLQTAQSRIAERINWRTIAFLLENTVFALIGLQARWLFDDLGESTLSPARIIAVSAATLVAVIVLRLVWVFLSRSLLVRPRVDPATGQVPPWSFTLLLGWSGMRGVVTLAAAFLIPPDTRHREVLLVVAFAVVAGTLLVQGLSLPWLTRRLHVPAPDPLDDALARATLLQQASKAAVEELERQEYDDQAGVGDLIRQRLDQRNFAAWERLGTTADQESPAAVYYRIRMAMIAAERRRILEIRRSGTVASEVIAEVLSMLDVEESMLDNAHQERDEAEDYARRRWTLGETCDDLGRYPVVDAEPATYCQACLDEGTRWVALRRCLECGNLACCDSSPRQHATAHFRETQHPVMQSAEPGEDWRWCYLHHLTA

SEQ ID NO: 27227 - protein, 461 aa, Blastopirellula marina DSM 3645
MAETFLLMVAPVSSLFEKAEAKNFDRIRPLAARMRPHTLAEFAGQTHFLGEGKLLRRLIQADRLNSVLFYGPPGTGKTTLAQLLARECRSRFEQLNAVTSGVKELREVLQKAKDEIAVGGRRTLLFIDEIHRFNKSQQDALLPDVENGVVILVGATTSNPFFAVNSALVSRSQVFQFQPLSPDDIKQLIHRALADKSVGLGDIPVNIHEDALHFLAEVSDGDARRALNALEIGVLSSKERPVEFTQELAAESVQRKAVQYDRDGDSHYDAASALIKSIRGSDPDAALYWLARMLEGGEDVRFLTRRLVILASEDVGNADPNALTLAVSAMQACEFIGLPECQLTLSQTVAYLACAPKSNAATIAIGEAVQDVREGRLIPVPVHLRDAHYQGAKTLGHGADYQYAHNADDGVAAQDYLGVDREYYRPVPRGFEAELAERLKSIRAKLRSAKATTSSPEEPEA

SEQ ID NO: 27228 - protein, 568 aa, Oryza sativa Japonica Group
MGNTCVGPSSAADRHGFFHSVSLAVLWRPGGRAEPSQPPGYPPRESSHSSVTSSTAPERVTIADSDLSSSTPNKGGNKPKVRRVQSAGLLADSVLKRDSERLKDLYTLGKKLGQGQFGTTYQCVEKATGKVLACKSIAKRKLVSEEDVEDVRREIQIMHHLAGHPSVVSIVGAYEDAVAVHLVMELCAGGELFDRIVQRGHYSEKAAAQLARVIIGVVEACHSLGVMHRDLKPENFLFVNHKEDSPLKTIDFGLSIFFKPGENYSDVVGSPYYVAPEVLMKHYGREVDVWSAGVIIYILLSGVPPFWDESEQGIFEKVLKGDLDFSSDPWPAISDSAKDLVRKMLNRDPRKRLTAHEALCHPWVCVDGVAPDKPLDSAVLTRLKQFSAMNKLKKMALRVIAENLSEDEIAGLREMFKMLDTDNSGQITLEELKTGLRRVGANLKDSEITTLMEAADIDNSGSIDYGEFIAATMHLNKVEREDNLFAAFSYFDKDSSGYITQDELQKACEEFGIGDAHLEDIIKDIDQDNDGRIDYNEFVTMMQKGNNPLGKKGQGQLSFGLREALKLG

SEQ ID NO: 27229 - protein, 358 aa, Thermosynechococcus elongatus BP-1
MSHAVTLIRGDGIGPEVAAAARTAIDATGVKIDWVVVDAGVAMMERYGTPLPEEVIDAIKSTKTAIKGPITTPVGTGFRSVNVEIRKRLNLYANLRPAKSIVGVKSYFQNIDLVIVRENTEDLYAGIEFAYTSPEAAKARAFLSDLSGKPIREDAAIGVKPISVLGSDRILEFAFKYAKANGRKKVTAVHKANIMKFTDGLFLERAREIASRYPDIVFEDRIVDNMCMQLMQKPELYDVMVMPNLYGDILSDLCAGMIGGLGVAPGANIGDECAVFEAIHGSAPKYAGQNKANPTALILSGVLMLQHLGEMEAAQRLQAAVEKVIAEGRFVTYDLAAPGKEPVGTQEMAAAIAEYAAP

SEQ ID NO: 27230 - protein, 402 aa, Oryza sativa Japonica Group
MGAADKWLLPLVSVSFVSLLLFLSALSGFSASSSLFARLPPPSYVRRGAAAPPSFAYVLSGGRGEGRKLLRLLLAVYHPRNRYLLHLSADAPESERVELAAAVSRAAPAVRAFGNVDVVGRPTAGTPMGSSGLAATLRAAAALLRLDSEWDWFVTLNAADYPLVTQDDLIHVFSSVPRHLNFIDHTSDIGWKETQRVQPIIVDAGIYLAGRNQFFQATEKRDTPDGFKFFTGSPWVILNRRFIEYCIFGWENLPRTLLMYFTNVMLPQEGYFHSVVCNSDFRNSTVNSDMRYMEWDDPPQMEPHFLNTTHYDEIVESGVPFARKFRENEPLLDKIDERVLHRWRHRPVPGAWCTGRKRWFNDPCSQWSNVNIVRPGPQAEKFRKHMNQIIEESASGNNSCKQ

SEQ ID NO: 27231 - protein, 476 aa, Wigglesworthia glossinidia endosymbiont of Glossina brevipalpis
MKENKINTEVLVIGSGPGGYSAAFRCADLGLKTVLVERFSSLGGVCLNVGCIPSKSLLHIANNLNSINKLKKIGIKFNEREIDMNQIRKWKCDVVLKLTNGLNMMSKARNVKIIHGYGEFIDPYTVNVKSLKENTKIKFEHAIIAVGSSPIKNHFMLQPDEKIWDSTDALKIKFIPKKLLIVGGGVIGLEMATVYNSFGSEVYIAEMSNQLIPAVDTDIINIFYKSIKNNFNIMLNTELKSVYLEDNNIYAELVNNDKKIEKICCNAVLFSTGRKSNGDLIKAKEIGIKLNNLNFIEVNNQMRTNIPHIYAIGDVTGHPMLAHKASYQSHIAAEVISGENHFFDPRVIPSVAYTNPEISWVGITEKEAINLNIPYETALFPWNALGRAIASDHHEGGMTKLIFNKENKKIIGGSIVGYNSSELLGEISLAIEMGCDVDDISLTIHAHPTLYESIGRASEIFSGTITDFLNKKSKNK

SEQ ID NO: 27232 - protein, 496 aa, Wigglesworthia glossinidia endosymbiont of Glossina brevipalpis
MSEIIKVPDIGPDEVEVTEILVKIGDSVDIEQSLITIEGDKASMQVPSPKPGIIKEIMIKIGDKIKTNQSIILIKNFEKEICISSKKNKDSKYDKNYKEIYSADLGIINTKIIKIFFSINDYLEVNNPILIVKDFEKTKTILSPLNGTVSFINVKNKDFIKSNKLVFSLKNISSKIKSNKVILEKKLNIENKIINENIYSSPFVRRIASKFNIDLSKIDGSGRKGRILPEDIKNSINIDCMENKFIDNNSKLKNVNSFEDSKEILYGESELIEIGKIKKISGSNLYKNWISIPHVTQFEQVDISELESFRKNQNNTLKYKVKITILSFIIKSVFFALKEYPLFNSSLSKDKNKLILKKYFNIGIAVSTDYGLVVPVIFDVDKKGIIEISHELFNISNKARNKKLISRDMTGGCFTISNLGGIGGREFTPIINYPEVAILGVSQASIQPMWNGSSFSPKLMLPLSLSYDHRVIDGSEGAKFIIFLKKIISDIRLLTL

SEQ ID NO: 27233 - protein, 249 aa, Brassica napus
MKFNVANPTTGCQKKLEIDDDQKLRAFYDKRLSQEVSGDALGEEFKGYIFKIMGGCDKQGFPMKQGVLTPGRVRLLLHRGTPCFRGHGRRTGERRRKSVRGCIVSQDLSVLNLVIVKKGEKDLPGLTDTEKPRMRGPKRASKIRKLFNLTKEDDVRKYVNTYRRKFTNKKGKEVSKAPKIQRLVTPLTLQRKRARIADKKKRIAKANAHAAEYQKLLASRLKEQRDRRSESLAKKRSRLSSAAAKPVAA

SEQ ID NO: 27234 - protein, 267 aa, Zea mays
MVSTTNFPAEVVPQAPEDPLFGLARAYKADNSPNKIDLGIGAYRDEKAKPWVLPVVKKADEILRNDPELNHEYAPIAGIASFTSKAAELVFGADSAAISEKRSTTLQTISGTGAVHLGALFLARFYKGNHTVYLSNPTWANHHQIFKNVGHSIDTYPYFHKETKGLDFEGFKQTLKSAPEGSVFVLHACAHNPTGVDPTQEQWTEIAALMKERNHFPFFDTAYQGFASGDLVRDAWAIRYFVEQGFELCVAQSFAKNFGLYGERAGC

SEQ ID NO: 27235 - protein, 507 aa, Pseudomonas syringae pv. tomato str. DC3000
MTDLLNHYARKILTSRVYDVAVETPLHGARQLSERLGNQVLLKREDLQPVFSFKIRGAYNKLAQLTAEEAARGVVTASAGNHAQGLALAAKELGILATIVMPRTTPEIKVEGVRSRGATVVLHGDSFPEALAYSLKLVEQQGFVYIHPYDDPDTIAGQGTVAMEILRQQPGKLDAIFVPVGGGGLIAGIAAYVKYLRPEIKVIGVEPDDSNCLQAAMAAGERVVLSQVGLFADGVAVAQIGYHTFEVCRHYVDEVITVSTDEICAAIKDIYDDTRSITEPAGALGVAGIKKYVEQRGVTGQTLVAIDSGANVNFDRLRHVAERAELGEGREAIIAVTIPEQPGSFKAFCEAIGKRQITEFNYRYHTDREAHIFVGVQTHPENDPRSALVASLTGQGFPVLDLTDNELAKLHIRHMVGGHAERVNDEVVLRFEFPERPGALFNFLNRLGGRWTISMFHYRNHGAADGRVVAGLVVPEEERHLVGAALDEIGYRYWDESENPAYRLFLG

SEQ ID NO: 27236 - protein, 371 aa, Pisum sativum
MAGVNQNGVAEFPAVQTHGGQFVQYNVFGNLFEVTAKYRPPIMPIGRGAYGIVCSLLNTETNELVAVKKIANAFDNHMDAKRTLREIKLLRHLDHENVIGLRDVIPPPLRREFNDVYITTELMDTDLHQIIRSNQNLSDEHCQYFLYQILRGLRYIHSANIIHRDLKPSNLLLNANCDLKIIDFGLARPTMENDFMTEYVVTRWYRAPELLLNSSDYTSAIDVWSVGCIFMELMNKKPLFPGKDHVHQMRLLTELLGTPTDADVGLVKNEDARRYIRQLPQYPRQPLNRVFPHVHPLAIDLIDKMLTIDPTRRITVEEALAHPYLEKLHDVADEPICMEPFSFEFEQQHLDEEQIKEMIYREALALNPEYA

SEQ ID NO: 27237 - protein, 459 aa, Rhodococcus sp. DK17
MSLAPSRVTLPDFIDSRPVSRYQYIVIALCGVVMFIDGFDTQSISYMAPHIAEEWGLSKQVLGPIFSAALAGLMVGYLALSPLSERFGHRRMILTSTVIFALGTLAAAWSQNVTELMALRFITGMGLGAAAPSAIALTGEFSPKRLRATFVLVIYCGFSLGFVAAGLVSGWLIPILGWRSVLVVGAVAPLLLLPALLRYLPDSLTSMINRGAEPNRIQAIFRKMDPALAVGPDITYEAEKRTDGQRTALRSLFTRDRVLGTLLLWLVFVINLGEFYALQSWLPSIMTSLDYNMGTVVTATTLTTVGGIAAAFVTGPCMDRLGAYVTLGTVYVVGFAFVALTGVAFTAPLWVLLTANFFAGVCISGGQKSLIALSAVFYPTPMRSTGVGWALGVGRLGGIVGPIAVGAALGMGWSASAVFYAMSVPMLVAGAAVFLLGRWVRSDNHPDRKSAESHSLARK

SEQ ID NO: 27238 - protein, 270 aa, Chlamydia muridarum Nigg
MLTDKKSSPTWSSLLPSETSQYFVFGNWKMNKTFSEAQTFLKDFVSCEILSNPKIITGIIPPFTLLSSCQQIIKNTPIRLGAQTLHEVDSGAFTGEISAPMLKDIGVDFVLIGHSERRHIFHEQNHSLAEKLLAAIRNGIVPVLCIGETLEEQEAGATQDILLEQLTVGLSRLPEHAPFILAYEPVWAIGTGKVANPDLVQEIHAFCRNVVKDLISKDAAERTPILYGGSVKADNTRALTLCPDVNGLLVGGASLSVESFLAIIQQIAVS

SEQ ID NO: 27239 - protein, 632 aa, Chlamydia muridarum Nigg
MISPLLQHISSPQKLRSLSLDQLPLLCDEIRNRIIATLSLTGGHLASNLGIVELTVALHYVFASPEDQFIFDVGHQAYVHKLLTGRNTEAFSNIRHDNGLSGFTSPQESNHDIFFSGHAGNALSLALGLAKGASHGSSHILPILGDAAFSCGLTLEALNNVPSDLSKFIIVLNDNQMSISENVGNIPQGISQWIQPPKFDKIFQKIHSWMRKIPGFSRQKSELLHKVDIALKSLSHPLFEQFGIHYVGPFDGHNIKKLIPALEAVKGLPYPVLFHVCTAKGNGLAEAEKDPALYHGVKAYFKNHSPKKKPLSSEVKTPSSFPQHVGHILCQLGEKHPRLQVVTPAMSLGSCLEDFRKQFPDRFTDVGIAEGHAVTFSAGIARSGTPVVCSIYSTFLNRAMDNVFHDVCMQELPVIFAIDRAGLAFHDGRSHHGIYDLGFLCSMPNMVVCQPRNASVLERLLFSSLLWKSPCAIRYPNLSTRKEVSNPSFSPIFPGEAEVLCQGDDLLLIALGHMCDTALAVKEQLLDHGISTTVVDPIFIKPLDTELLQTLLSHHSKVVVLEEHSIHGGLSAEFLLFLNNHNLKTDVLSLGIPDIFIPHGNPETILNMIGLTSDQITLKILAHFNFSAPIPI

SEQ ID NO: 27240 - protein, 481 aa, Chlamydia muridarum Nigg
MIARTKIICTIGPATNTPEMLEKLLDAGMNVARLNFSHGTHESHGRTIAILKELREKRQVPLAIMLDTKGPEIRLGQVESPIKVKPGDRLTLTSKEILGSKEAGVTLYPSCVFPFVRERAPVLIDDGYIQAVVVNAQEHLIEIEFQNSGEIKSNKSLSIKDIDVALPFMTEKDITDLKFGVEQELDLIAASFVRCNEDIDSMRKVLENFGRPNMPIIAKIENHLGVQNFQEIAKASDGIMIARGDLGIELSIVEVPALQKFMARVSRETGRFCITATQMLESMIRNPLPTRAEVSDVANAIHDGTSAVMLSGETASGTYPIEAVKTMRSIIQETEKSFDYQAFFQLNDKNSALKVSPYLEAIGASGIQIAEKASAKAIIVYTQTGGSPMFLSKYRPYLPIIAVTPNRNVYYRLAVEWGVYPMLTSESNRTVWRHQACVYGVEKGILSNYDKILVFSRGAGMQDTNNLTLTTVNDVLSPSLE

SEQ ID NO: 27241 - protein, 465 aa, Chlamydia muridarum Nigg
MTSYQVSSRRHRPNTFSEILGQDMVVSILKNSLRLNRSAHAYIFSGIRGTGKTTLARVFAKALNCQSPTENQEPCNQCAICKEISLGTSMDVMEIDGASHRGIEDIRQINETVLFVPSKSRYKIYIIDEVHMLTKEAFNSLLKTLEEPPAHVKFFLATTEIAKIPNTISSRCQKMLLKRIPEETIIDKLTTIAKLGKIEASREALLPIAKAAQGSLRDAESLYDYVVGLFPESFTPEDTAKALGILSDDTLYQIAEAITTQNYEQALSPVSDAMHMGVAPAHFLQDLTLLFRSLLLKQHSQKFDSIAVKYSSESLLEILDFLGESARHVNLALFEKTFLETVIIRLLRIYSRPTLSQLVSQIKQPAQSPLRPIPSSPVLDPGPSPTKSIVKEEVKALPQPVEAKFSQGSLLTPPPSQPKKETLNQEVSAPSSSTPSCSEAAAIDTLLQFAVVEFSGVLTKEPKHG

SEQ ID NO: 27242 - protein, 503 aa, Acinetobacter sp. ADP1
MRYIDPNQPGSKVQFKAQYENFIGGQWVPPVKGEYFGNSSPVDGKVFTQIPRSSVEDIELALDAAHKAKADWNKASPTVRSNVLLKIADRLEENLELLAVAETWENGKPIRETLAADIPLAIDHFRYFAGCIRAQEGGISEIDEDTIAYHFHEPLGVVGQIIPWNFPILMAAWKLAPALAAGNCIVLKPAEQTPSSILVLAELIQDLLPPGVLNIVNGYGAEVGRPLATNPRISKIAFTGSTKVGQMIMQYATENIIPVTLELGGKSPNIFFEDILDKEDDYLEKTLEGFAMFALNQGEVCTCPSRALVQESIADKFLEMAVERVKRIKTGHPLDTETMIGAQASKQQFDKILGCIDTGRNEGAQLLTGGDARHDVDGGFYIEPTIFKGNNSMKIFQEEIFGPVLSVTTFKDFDDAMRIANDTIYGLGAGVWSRSAHTSYRAGRAIEAGRVWTNCYHLYPAHAAFGGYKQSGIGRENHRMMLDHYQQTKNLLVSYSTKPMGFF

SEQ ID NO: 27243 - protein, 277 aa, Oryza sativa Japonica Group
MWWWPAFLYPPPAPAFVAAASVAQFALLANAGLGELRGEHMAYSKFWQVVAGKKKNGGGGGGGALLPSRQGMLVAYVPAFVAAAASFAVPGAVVGVRAQVLSAALTVHFLKRILEVLFIHQYSGSMPLNTAATISSSYLVITATMIYAQHLAAGLPDPPVDLLYPGVAAFAVGIAGNFYHHYLLSQLRNAAGGSGGGERQYRIPTGGLFGLAACPHYLFEIVGFFGFAMIAQTAHALAVASGTVAYLAGRSCATRRWYESKFEDFPDSIKALVPYIL

SEQ ID NO: 27244 - protein, 177 aa, Filobasidiella neoformans
MGAAESSMFNSLEKNSNFSGPELMRLKKRFMKLDKDGSGSIDKDEFLQIPQIANNPLAHRMIAIFDEDGSGTVDFQEFVGGLSAFSSKGGRDEKLRFAFKVYDMDRDGYISNGELYLVLKQMVGNNLKVQDQQLQQIVDKTIMEADKDGDGKLSFEEFTQMVASTDIVKQMTLEDLF

SEQ ID NO: 27245 - protein, 229 aa, Nocardioides sp. JS614
MVRAELDKQPSDVRRMFDAVARRYDVTNDVLSMGQDRRWRRAVIAAVDPQPGERVLDLAAGTGTSSQPFADRGASVVPCDFSLGMLRVGKSALPHLPFTAGDGTRLPFADATFDAVTISFGLRNIVDPLSGLRELHRVTRPGGRLVVCEFSHPTFAPFRTVYLEYLMRALPSIARAVSSAPDAYVYLAESIRAWPDQEGLAAMVAEAGWRAPAWRNLSGGIVALHRATR

SEQ ID NO: 27246 - protein, 511 aa, Oryza sativa Indica Group
MELTTLLLLALISFFFLVKLIARYASPSGRESALRLPPGPSQLPLIGSLHHLLLSRYGDLPHRAMRELSLTYGPLMLLRLGAVPTLVVSSAEAAAEVMRAHDAAFAGRHLSATIDILSCGGKDIIFGPYTERWRELRKVCALELFNHRRVLSFRPVREDEVGRLLRSVSAASAEGGAACFNLSERICRMTNDSVVRAAFGARCDHRDEFLHELDKAVRLTGGINLADLYPSSRLVRRLSAATRDMARCQRNIYRIAESIIRDRDGAPPPERDEEDLLSVLLRLQRSGGLKFALTTEIISTVIFDIFSAGSETSSTTLDWTMSELMKNPRILRKAQSEVRETFKGQDKLTEDDVAKLSYLQLVIKETLRLHPPAPLLIPRECRETCQVMGYDVPKGTKVFVNVWKIGREGEYWGDGEIFRPERFENSTLDFRGADFEFIPFGAGRRMCPGIALGLANMELALASLLYHFDWELPDGIKSEELDMTEVFGITVRRKSKLWLHAIPRVPYISTY

SEQ ID NO: 27247 - protein, 366 aa, Xanthomonas campestris pv. campestris str. ATCC 33913
MLFETLDTTGHEQVIFCHNRDAGLKAIIALHSTRLGPALGGVRMRPYANSEAALNDALRLSRTMTYKNALAGLNVGGGKAVIIGDPKTDKSEALFRAFGRFVDTLGGRYITSEDVGTDVNDMEQIYLESEYVTGVHQVHRGSGDPAPFTAYGALQALMASLNRKLGHEEVGKASIAIQGLGHIGMELVKLLKERGAKLYVADLNPALVDRAVSEYGAEAVRPEEIHEVPADVFAPCALEGAINEDTLPRLKAKIICGTANNQLSSAAIGEELHKRGILYAPDYVVNAGGVMNVSLEIDGYNRERAMRLIRSIYHNLEKVFDLSTQLGIPPQQAADQIAETRIEAISKLKLPLGRTAPRFLHKLRGE

SEQ ID NO: 27248 - protein, 182 aa, Physcomitrella patens subsp. patens
MASIIAASSVVAPAALSAASSAVSTSESTSVKAFSGLKSTTLFSSKAQTLSSVQNGSRVQCMQVWNPIGMTKFETFSYLPPLSDDAIAKQVEYMIQQKLIPCLEFDVNANGVSRANNSSPGYYDGRYWTMWKLPMFGCQDSAQVLREIEECKKTFPGCFVRVLGFDNVKQVQICGFLVARPN

SEQ ID NO: 27249 - protein, 369 aa, Burkholderia vietnamiensis G4
MKSRAAVAFEAGKPLQIVELDVEPPRKGEVLVKITHTGVCHTDAFTLSGDDPEGLFPAVLGHEGAGIVVEVGEGVTSVKTGDHVIPLYTAECGECLFCKSGKTNLCVSVRATQGKGVMPDGTTRFSYNGQPVYHYMGCSTFSEYTVVAEVSLAKISPDANPEQVCLLGCGVTTGLGAVKNTAKVQEGDTVAVFGLGGIGLAVIQGAKLAKAGRIIAVDTNPGKFDLARVFGATDCVNPTDYDKPIQQVIVEMTGWGVDHSFECIGNVNVMRAALECAHRGWGQSVIIGVAGAGQEISTRPFQLVTGRRWLGTAFGGVKGRSELPGMVEDAMAGKIQLAPFVTHTKPLTGINEAFDLMHEGKSIRTVVHF

SEQ ID NO: 27250 - protein, 280 aa, Pleurotus djamor
MERYNTRTASNFPGLVFDCAEEAQSGYKHIDTAYNYHTEKYVGNAVRESGIPREELFITTKLPWHHYARVAESFQESLDALGLGYIDLYLIHWPQPILYDPNDPLPKNPDGTPKTTNYPFTKIWADMERLLDTGKVRAIGVSNFSIKNLEILLESAKVVPAVNQVELHPYLAQPELVDYCKQKGIAITAYTPTGYQTVRDDPVIVELASKYRVSPAQVILAWHMSRGVIVTPKSANAERQRENINVSFLHFPINSFDVLFLASTAATCPGACRSSAYISS

SEQ ID NO: 27251 - protein, 402 aa, Bacteroides fragilis NCTC 9343
MMKACFMGLGYIGLPTAIIAAKHGVQVTGVDINPKVVEMTNQGKLHIIEPGMQDLLEEVVSKGQLIASTTPKESNAYFIVVPTPFKGNHEPDISYVEAATRAVVPFLKEGDLYVIESTSPVGTTDKMKDLIFSLRPELKEKIYIAYCPERVLPGNVIHELVHNDRVIGGMNKESTDKAIEFYSQFVKGTLHRTNCKTAEMCKLTENSSRDVQIAFANELSVICDKAGINVWELISLANKHPRVNILQPGCGVGGHCIAVDPYFITADFPIESQIIAKAREINNYKAFWCAEKVENAMLKFELEHHHKPTIAMMGLAFKPDIDDLREAPAKYITTKVMQSCNNADILIVEPNVSEHKVFKLTDYKEAYAKADIVVFLVAHSVFKALPYVSDKVILDFCGIYKK

SEQ ID NO: 27252 - protein, 306 aa, Pleurotus djamor
MSAYPPIVLNTGARMPALALGGWAGLTEEERTQAKEWFLTALKSGYRHIDTAQIYYTEKSVGNAIRESGIPREELFITTKLPWNHHSRVAESFQKSLENLGTEYIDLYLVHFPQRVFYDETTDFPRNPDGSIKVVNSPTLNDVWADVETLLDTGKVKAIGVSNYSIKTLEELLKTAKVVPAVNQVELHPFLAQSKLLAYCKEKGIAVTAYTPTGYQTVLTDPTIVELAGKYGVSPAQIVLAWHLSRGVAAAPKSANESRQKENLNLPFLQPEDVAKISALDRGQRIANKADERGQVWGLTLEELGW

SEQ ID NO: 27253 - protein, 473 aa, Mycobacterium smegmatis str. MC2 155
MLESRSDLSSSDEPRSGLARSLKTRHMTMIAIGGAIGAGLFVGSGAVIKTAGPAAIVSYVVAGALVLCTLRMLGEMVVAKPRTGAFADYARIGIGPWAGFTLGWLYWYYYVIIIAVEAVAGAQILAVWVGLPLWLMAMLLMAALTLTNLISVRWFGEFEFWFSGIKVAAIVSFIVVGLLWVFGVWPGDTNGLTNLVAHGGFAPNGFGSIFGAVVVVIFAFGGAEIVTIAAAESAEPAKSVARATTGVIWRIILFYVGSIFLVVCILPWNDASVLSSPYVAALEKLQIPGAGLIMNIVILTAVLSVLNSSIYTSSRMLRVLASHGDAPQWLVRTNTRGVPTRAILASTVVGWVSVVLAYIAPDSLFLFLVNSCGVVAIFMYVMIGVSELRVRRAIEREDPAKLTLKMWFFPYLPIAVIACFVLVLVAMLFDADQRVQLLASVVSLAVVLLAYALRKRHGQVPATDTKQAARTDE

SEQ ID NO: 27254 - protein, 658 aa, Pleurotus djamor
MAFNLTSTSLTPSRPAPQAPRRGTEDSFGSSSTLNSSGYSSSFSFTPASPSSSSYAASYSGIGGSPNRHPENNMYGGNQIVRNGVVSVKEDGTFASWMWKAKWLVLTDSELSIHKSEHAPKQTVVNLGDISSIERTDLKPYCLLLETKDKRFYFSLKNDEELYGWQDDVYARSPLMGVSNPTNFVHKVHVGFDPVSGAFTGMPEQWSKLLTKSAITREDYAKDPQAVLDVLEFYTDHQKREMEEMGAKESLPIQAPPPLQPSQSKDRERERERERAEREREREKDLARPGMGAPSKSSPATTQPATQPASGPAGATAGPPPVKPLQPTKKVQIQAEEKPKTTGVAAAAAALEKPKEKEKRISTMTEVQIMEKLRQVVSDEDPKTIYSKIKKVGQGASGHVYVAKTLATGKKVAIKEMDLSHQPRKELIVNEILVMKESQHPNIVNFLESYLVKSNELWVVMEYMEGGALTDIIENNTLEEDQIASICFETCKGLGHLHSQSIIHRDIKSDNVLLDAQGRVKITDFGFCAKLTDQKSKRATMVGTPYWMAPEVVKQKEYGAKVDIWSLGIMAIEMIENEPPYLDEEPLKALYLIATNGTPTLKKPEALSRELKGFLAVCLCVDVSSRATASELLDHEFLKKSCALSGLAPLLRFKTKQQ

SEQ ID NO: 27255 - protein, 324 aa, Ralstonia solanacearum GMI1000
MTKAIRIFETGGPEVMQLVDAEAPAPGPGEARIRQHAIGLNYIDVYFRSGLYPQPLPGGIGMEASGVVEAVGEGVTHVRPGDRVAYAGRPTGAYAEVRTMPADILVRLPEAIGFETGAAMMLQGLTAQYLLRDSYRVQPGDTVLFHAAAGGVGLIACQWLKALGATVIGTVGSDAKAALARAHGCDHTIVYTRENFTERVREITGGKGVPVVYDGIGKDTFSGSLDCLAPRGMMVSYGNASGPVPPFDLGVLSAKGSLKLTRPTLMTYTAQRALLEPMAAELFDVVGSGKVKIEIHQRYALADAAQAHRDLEARKTTGSTILLP

SEQ ID NO: 27256 - protein, 283 aa, Oryza sativa
  misc_feature (111)..(111): Xaa can be any naturally occurring amino acid
  misc_feature (200)..(200): Xaa can be any naturally occurring amino acid
  misc_feature (260)..(260): Xaa can be any naturally occurring amino acid
ACVGTGESAIMAGGGKNCNLPGIVVDLPTLTEKDKEDILGWGVPNDIDMIALSFVRKGSDLVTVRQLLGQHAKRIKLMSKVENQEGVVNFDEILRETDAFMVARGDLGMEXIPVEKIFLAQKMMIYKCNLAGKPVVTATQMLESMIKSPRPTRAEATDVANAVLDGTDCVMLSGESAAGAYPEVAVKIMARICVEAESSXLTTDSFDWTISSEGPARHSLIYRGLVPLLAEGSAKATDSESTEVILDAALKSAVQKQLCXPGDAVVALHRIGVASVIKICIVK

SEQ ID NO: 27257 - protein, 369 aa, Salmonella enterica subsp. enterica serovar Paratyphi A str.
MATLSRLFIHPVKSMRGIGLTHALADISGLAFDRIFMVTESDGTFITARQFPQMVRFTPSPLHDGLHLTAPDGSSALVRFTDFTPQDAPTEVWGNHFTARVAPTAINQWLSGFFSRDVQLRWVGPQLTRRVKRHNAVPLGFADGYPYLLTNEASLRDLQQCCPAGVQMEQFRPNLVVSGVAAWEEDSWKVLRIGDVIFDVVKPCSRCIFTTVSPEKGQKHPSGEPLATLQAFRTAQDNGDVDFGQNLIARNSGVIRVGDEVEILATAPAKAYGATTVDDSVTPDKHPDASVTIDWQGQTFCGNNQQVLLEQLENQGIRIPYSCRAGICGCCRIRLLEGEVSPLKKSAMGDDGTILSCSCVPKTALRLEN

SEQ ID NO: 27258 - protein, 361 aa, Solibacter usitatus Ellin6076
MNLNVLVLPGDGIGTEVTCQAVRVLEHVAKKWNHTLHLTEGLLGGIAIHKTGTPFPQETAKLAASADATLMGAVGLPEFDNAPPEKRPEKGLLGIRQALGVYANLRPVRAYASQLDSSPLKNHLVEGTDMIIVRELTGGIYYGTPRGISGSGLEERAVNTMTYTRAEIERVARMAFHLARARRKKVTSVDKSNVLENSQLWRRVVVEVAKNFPDIELDHILVDNCAMQLVLNPKRFDIVLTENMFGDILSDEGAVLAGSIGMLPSASIGDQRPSGAWVGLYEPVHGSAPDIAGQNKANPLGAIGSVAAMLAYSFGLKEEAAAVETAIEAVLTSGQVTADLRPAGAPATTAQVGQAVCAAIG

SEQ ID NO: 27259 - protein, 338 aa, Glycine max
MERYEILKDIGSGNFAVAKLVRDNYTNELFAVKFIERGQKIDEHVQREIMNHRSLKHPNIIRFKEVLLTPTHLAIVMEYASGGELFERICNAGRFSEDEARFFFQQLISGVSYCHSMQICHRDLKLENTLLDGSTAPRVKICDFGYSKSSVLHSQPKSTVGTPAYIAPEVLTRKEYDGKIADVWSCGVTLYVMLVGAYPFEDPADPRNFKKTIGKILSVQYSVPDYVRVSMECRHLLSQIFVASPEKRITIPEIKNHPWFLRNLPMELTEGGSWQMNDVNNPSQNVEEVLSIIQEARKSLNVPKVGGLLTGGSMDLDDFDADEDLEDLETSGEFVCPI

SEQ ID NO: 27260 - protein, 899 aa, Arabidopsis thaliana
MEYHPQAIRLCALIFISFYALLHLVEAQDQKGFISLDCGSLPNEPPYNDPSTGLTYSTDDGFVQSGKTGRIQKAFESIFSKPSLKLRYFPDGFRNCYTLNVTQDTNYLIKAVFVYGNYDGLNNPPSFDLYLGPNLWVTVDMNGRTNGTIQEIIHKTISKSLQVCLVKTGTSSPMINTLELRPLKNNTYNTQSGSLKYFFRYYFSGSGQNIRYPDDVNDRKWYPFFDAKEWTELTTNLNINSSNGYAPPEVVMASASTPISTFGTWNFSWLLPSSTTQFYVYMHFAEIQTLRSLDTREFKVTLNGKLAYERYSPKTLATETIFYSTPQQCEDGTCLLELTKTPKSTLPPLMNALEVFTVIDFPQMETNPDDVAAIKSIQSTYGLSKISWQGDPCVPKQFLWEGLNCNNLDNSTPPIVTSLNLSSSHLTGIIAQGIQNLTHLQELDLSNNNLTGGIPEFLADIKSLLVINLSGNNFNGSIPQILLQKKGLKLILEGNANLICPDGLCVNKAGNGGAKKMNVVIPIVASVAFVVVLGSALAFFFIFKKKKTSNSQDLGPSSYTQVSEVRTIRSSESAIMTKNRRFTYSEVVTMTNNFERVLGKGGFGMVYHGTVNNTEQVAVKMLSHSSSQGYKEFKAEVELLLRVHHKNLVGLVGYCDEGENLALIYEYMANGDLREHMSGKRGGSILNWETRLKIVVESAQGLEYLHNGCKPPMVHRDVKTTNILLNEHLHAKLADFGLSRSFPIEGETHVSTVVAGTPGYLDPEYYRTNWLNEKSDVYSFGIVLLEIITNQLVINQSREKPHIAEWVGLMLTKGDIQNIMDPKLYGDYDSGSVWRAVELAMSCLNPSSARRPTMSQVVIELNECLSYENARGGTSQNMNSESSIEVSMNFDIGATPDAR

SEQ ID NO: 27261 - protein, 110 aa, Glycine max
  misc_feature (27)..(27): Xaa can be any naturally occurring amino acid
  misc_feature (46)..(46): Xaa can be any naturally occurring amino acid
AAKHTFTASRLSNPPSAPRAPSRRPKXTTDKIEKSDGAKDAGAGGXAPPPPQGPDPGNVAKEDPTKIITDNRQTRGANTAREESLKKEEEAGKLKYVCQSNEGVEEHKVR

SEQ ID NO: 27262 - protein, 365 aa, Clostridium acetobutylicum ATCC 824
MRLGIVGLPNVGKSTLFNAITKAGAESANYPFCTIEPNVGVVSVPDKRLDVLEKMYNSKKKVHTSIEFYDIAGLVKGASKGEGLGNKFLSHIRESAAIVHVVRCFKDDNIVHVDGSIDPIRDIETINFELIFSDLEVLEKRIEKTTKTARSGDKKAKDELVILEKLKKHLEDGKSVRTLEFTDDEAEFVKGLFLLTSKPILYAANVSEDDILSGNVENDMVKSVQDYAKRENSEVIPICAGLEEQLSSLEEEEQKEMLSEYGLEDSGLNRLIERSYKLLGLMSFLTAGPEEVRAWTINQGTKAPAAAGKIHTDIERGFIRAEIVSYDDLINCGSEAAAKEKGLYRLEGKDYIMQEGDVVFFRFNV

SEQ ID NO: 27263 - protein, 392 aa, Chlamydia muridarum Nigg
MDYYTILGVAKTATPEEIKKAYRKLAVKYHPDKNPGDAEAERRFKEVSEAYEVLGDAQKRESYDRYGKDGPFAGAGGFGGAGMGNMEDALRTFMGAFGGDFGGNGGGFFEGLFGGLGEAFGMRGGSEGARQGASKKVHITLSFEEAAKGVEKELLVSGYKSCDACSGSGAKTSKGVKVCDRCKGSGQVVQSRGFFSMASTCPDCSGEGRVITDPCSECRGQGRIKDKRSVHVNIPSGVDSGMRLKMEGYGDAGQNGAPAGDLYIFIDVEPHPVFERHGDDLVLELPIGFVDAALGIKKEIPTLLKEGTCRLNIPEGIQSGTVLKVRGQGFPNVHGKARGDLLVRISVETPQHLSNEQKELLRKFSETEKAENFPKKRSFLDKIKGFFSDFAV

SEQ ID NO: 27264 - protein, 331 aa, Vibrio sp. Ex25
MTIKVGINGFGRIGRFVFRAAQERADIEVVGINDLIDVDYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDAVVSQDFIGEVQTSVFDAKAGIALTDNFVKVVSWYDNEIGYSNKVLDLIAHISK

SEQ ID NO: 27265 - protein, 254 aa, Triticum aestivum
  misc_feature (172)..(172): Xaa can be any naturally occurring amino acid
NKFVQKSLPVPVRNSRDIVDPRVRLIFSKGSSQVIAQYYQLIRLGCEGYRNIMDNCQENAMVLKEGLERTGRFNIVSKDQGVPLVAFSLKDSSRYYEFEISEFLRRFGWIVPAYTMPPDAQHVTVLRVVIREDFSRTFAERLVIDIEKALHELDALPSCSSGPAPAAPPTGXPVSKKDLPRQRELVSVWKEGRPPPGRKTQGVLLDGGALHLLTWLAGDLMNPITCLLNTFWGGISLILKLAYYLPLWAMKDFF

SEQ ID NO: 27266 - protein, 484 aa, Corynebacterium diphtheriae NCTC 13129
MTDQTQLAQIGIVGLAVMGSNLARNFAHKGHTVAVFNRSFEKTQALMDQHGDEGNFIPSATIEEFVASLEKPRRAIIMVQAGPATDAVINQLADAMDEGDIIIDGGNALYTDTIRRESEIAQRGLNFVGAGISGGEEGALNGPSIMPGGPDKSWEALGPLLESIAAQVGGTPCVTHIGPDGAGHFVKMVHNGIEYADMQVIGEAYQLLRYATEMQPSEIADVFKTWNQGDLDSYLIEITSEVLAQVDSETGTPLIDLIVDEAGQKGTGRWTVKAALDLGIATTGIGEAVFARALSGATTQRKAAQGNLPAGTLESLASLNIDKDQFVEDVRRALYASKLVAYAQGFDEIIAGSAEHNWDVDPRDLATIWRGGCIIRAKFLNRIVEAYDANPELPSLLLDPYFKTELESLIDSWRRVVVAATQLGLPVPVFASSLSYYDSLRAERLPAALIQGQRDFFGAHTYRRTDKDGSFHTLWSGDRSEVEA

SEQ ID NO: 27267 - protein, 491 aa, Bifidobacterium longum NCC2705
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 27268 - protein, 193 aa, Oryza sativa Indica Group
MERARQGLVQPVQGELRRESTGSASRTSSAPPATTSHRRAARSSSWIHVWILAARVVFGKKKVEPMVKDAAAPGKGGRLKMESSNAQPQDSAYSVPKNPSMTCCRKRTDGATFLEDLKDHIEEFIHASMDEHKTCFKHHPKGQMCKHSDTALLCSFCILDILMMKHFLCFMFRISDVWDVKGCRGAFGGCQGS

SEQ ID NO: 27269 - protein, 407 aa, Oryza sativa Indica Group
MTSSGGAGCSRSHSFSGISSAAATGGAGAGADVFVRAADNEMYVRADKIDLKNLDVQFEKTRSKVWLEQHRSSSAASPLPLLEWEIDLAKLDIQNQVAHGTFGVVYRGTYDGHDVAVKVLDWGQEGQESTAKHREAFEKEVAVWQKLDHPNVTKFVGASMGTSHLKIPSAKAESRSSSVGGGSAGGGGGQRCVVVVEYQHGGTLKTLLYKHRDKKLPYKKVVQLALDMARGLRYLHGEKIVHRDVKAENMLLDRKKTLKIADFGVARVEAGADGDDMTGQTGTIGYMAPEVLQGRAYDHKCDVYSFGVLLWETYCCAMAYPNYSLADISYHVVKLGIRPDIPRCCPKAMADIMARCWDANPDNRPEMSEVVALLEKIDTSRGKGGMTPVPEHASQGCSCFGFSRGSA

SEQ ID NO: 27270 - protein, 322 aa, Corynebacterium diphtheriae NCTC 13129
MVDSHEKQRGDTGEVTTEDRSSAIAVLVFPVLMIVGAIIAYQTPETFVGFKPYLNPMLMFIMFAMGLTITLPDLKELARRPWSIALGVVCQFIVMPLSAVAISSILGFDQSLTIGLILLGSVPGGTASNVLAYLAKGDVALSVAMTSVSTLVSPFATPLIMLLLAGESAEVNASGMMVILLKTVLIPVGFGLILRFFAQRFVDTVLPVLPWLSIVVIGIVMMTVVAGAHAKLALVGIVVVLGVAIQNLIGFIAGYWSARAVRQPEASCRTASIEVATQNSGLAASMATQFFTPEAALPGAVATIYANISGAIYAAIVRRKAL

SEQ ID NO: 27271 - protein, 87 aa, Zea mays
NDELVWDNGTPFPEPCIDRLAPHIGKYEALAWLCGGLGFFAALGMAAVVNDKASNIPYGLTGGVPGERPTASGGRRRLLSLGATSSG

SEQ ID NO: 27272 - protein, 99 aa, Prochlorococcus marinus str. MIT 9211
MASYKVTLVNANEGLNSTIEVPDDQYILDAAEEQGIDLPYSCRAGACSTCAGKITAGSVDQSDQSFLDDDQLEAGFVLTCVAYPTSDVTITTHAEEELY

SEQ ID NO: 27273 - protein, 321 aa, Actinobacillus pleuropneumoniae serovar 1 str. 4074
MTKKLLILHTGGTISMSEGEDGKVSPSEKNPLLAALERLNHPAQLSQESVLNVPSPHITLQHWLLLKTRIEKAVNEEQYDGIVITHGTDTLEETAYFLDLALNVNVPVAITGAMRSSNELGSDGLINLQSAILVALCPESRNKGVLVVMNDEIHNAKFVTKTHTTNVATFQTPTFGPCGLIAKNRVLYFQQLTEYERFPIQTVTRTNVQLVKAYAGMDSFLLEQLAHHGCNGVVIEALGAGNLPPSCLAGLDALLRADIPVVLVSRAFNGVTQDVYDYLGGGKQLKQQNVIFTTGLSGQKARIKLLVLLNQNLSKPLAEYF

SEQ ID NO: 27274 - protein, 398 aa, Actinobacillus pleuropneumoniae serovar 1 str. 4074
MSMFNHIQAAPADPILGLGEAFKAEQRAGKINLGIGVYMNAEGKTPIVKAVKKAEALLLEQETNKNYLTIDGVQAFNAYTQELLFGKGAEIIASGRAKTAQSLGGTGALRIAAEFIKRQTSAKNIWISNPTWPNHNAIAEAVGLNVKGYRYYNPETHGLDWDNLLADLSQAEAGDVVLLHGCCHNPTGIDPTPEQWDALAKLSAEKGWLPLFDFAYQGFGNGLGQDAYGLRAFVKNHKELLIASSYSKNFGLYNERVGAFTLVAENADVANKAFTQIKSIIRVLYSNPAAHGANAVARVLGDETLRAEWVAELDEMRDRIKGMRNRMVQLLKEKGAKQDFDFIAKQNGMFSFSGLTPEQVDRLREEFAIYAVRSGRINVAGITDQNIDALCEAIVKVL

SEQ ID NO: 27275 - protein, 340 aa, Deinococcus radiodurans R1
MDGVYKGKPFLCWKRLFCLGRHSVYLRRLFGIGRCSTLSGRFHSRPFHVPTPRRFSMTQSSPNRPADPATTFRPDLLAGKHALITGGGSGINLGIAQSFAAHGCAVTILGRNLEKAQNAAQGIVDAGGRAMGVSADVRDFAALEAAVAAATAEFGDFDIVLAGAAGNFPAPVDGISPNGFKTVVDIDLLGTYNTIKAAAPRLKVPGGNILSISAYGVPVPMQAHVVAAKAGVDALTQTLAVEWGLRGVRVNAIIPGPIDGTEGMARLAPDEKSRSAFTRTVPLGRFGVPQDIANAALFLVSDAASYVTGVILPVDGGQNMLGGAPQYQMYLQMQAAQQKD

SEQ ID NO: 27276 - protein, 165 aa, Hibiscus rosa-sinensis
IQMGLAENQLCFEFIKKWLMEHPEASLCTPEGVGRFKETALFQDYHGMPEFRQAVAKFMGKVRGDRVKFDADRIVMSGGATGAHETVAFCLADPGEALLVPTPYYPGFDRDLRWRTGVELVPVICESCNNFQVTRNALEAAYEKAAEAGLRVKGLLITNPPNPLG

SEQ ID NO: 27277 - protein, 487 aa, Byrsonima crassifolia
GPGISALEKKNLGRIAQIIGPVLDVTFPPGKMPNIYNALVVKGRDTLGQQINVTCEVQQLLGNNRVRAVAMSATDGLMRGIEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQSFYLVGNIDEATAKAANLEMENN

SEQ ID NO: 27278 - protein, 338 aa, Glycine max
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 27279 - protein, 250 aa, Prochlorococcus marinus str. NATL1A
MTLSKLLEGQTAIVTGASRGIGKAIAIFLAKEGAEVIINYSSSLENANKVVSEINSFGGKAYPLQADISNENSVNDLIKTVLEKNNKIDVLVNNAGITKDGLLMRMKTDDWQKVLDLNLSGVFYCTRAVSRQMLKQKKGRIINITSVVGLMGNPGQANYSAAKAGVVGLTQSAAKEFASRGITVNAVAPGFISTDMTKDLDSESILSAIPLGRFGNPEDVAGAVRFLAADPSASYITGQVIQVDGGMVMS

SEQ ID NO: 27280 - protein, 396 aa, Salmonella enterica subsp. enterica serovar Paratyphi A str.
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSNPSWPNHKSVFNAAGLEVREYAYYDAENHTLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDVLRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 27281 - protein, 609 aa, Arabidopsis thaliana
MYYLPSSCLVLFLFFSLFYHLPCASSKQTLGWCESQFQCGNITAGFPFWGGNRPEVCGHPLLELHCLDNITSLTISDHLYHVLSINHTYNTLRVARTDFLQSICLSPFPFANATLPPEIFDILPTYKSVTLYRCYPVIPDLARYGCPAIGSVSVSDNLENPVSCEARFTVNIPTSFVPNEKRLNITSLVRDVRNGFEVRLRIDENSCQECSSSHKYCGFTGTLPLETKCRPLNLPTPTIAGVSLLPFLVLTLVVHIIRKQKTSNDKGQQDLKEHIPKPRIKALIQLKQYSYEQVKRITNSFAEVVGRGGFGIVYRGTLSDGRMVAVKVLKDLKGNNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGSVSHKSDVYSYGMLVLDIIGARNKTSTEDTTSSTSSMYFPEWIYKDLEKGDNGRLIVNRSEEDEIAKKMTLVGLWCIQPWPLDRPAMNRVVEMMEGNLDALEVPPRPVLQCSVVPHLDSSWISEENSISSEI

SEQ ID NO: 27282 - protein, 180 aa, Triticum aestivum
  misc_feature (63)..(63): Xaa can be any naturally occurring amino acid
MSQETVNPKAYPLADSQLTITILDLVQQAANYKQLKKGANEATKTLNRGISEFVVMAADTEPXLEILLHLPLLAEDKNVPYVFVPSKQALGRACGVTRPVIACSVTSNEGSQLKQPIQSLKDAIEKLLHDLFKDPFQLWMGPSCHQFFFKRLDLVEWVVLCTKLFVFFSSLINFCKTCLC

SEQ ID NO: 27283 - protein, 420 aa, Wigglesworthia glossinidia endosymbiont of Glossina brevipalpis
MKLLVFGISYKTAPISLRERVIFSPENINIALNNLLKKSDILGGVILSTCNRTEVYLSIKNFYKAKKIIILWLYKFFNDLKIKEIKNNFYSYIDNYAVSHLMRVTSGLDSMILGEHQILSQVKSAFFRSLKNKNISIDLQKLFESAFSVAKKIRSETKIGSYSISIPYIICVLLKKIFISFTEIKVMLIGSGTINELIAKQLFKYKIKDLFISNRTIDHAKNLAIKVNGCVVEFNEIFKNLNKMQVIITSTYSRKLIITYKIIKSIIEKNKNKKIIFIDISIPRNIDKKIKKITGVHLYTLEDLKDLITNNLEKRKNAATLAENIIKKESIKFMSHIKGYYSSEIIKKYRFQINKLKKIYEKKALLELKLGNNPENIIKKLTYKLTNRLVHKPTKLLYNTSCSKNNKDLYDLYNKLKIDL

SEQ ID NO: 27284 - protein, 305 aa, Wigglesworthia glossinidia endosymbiont of Glossina brevipalpis
MKIFSGSSNIKLSNKIANLLGISISNSEINKFQDGEINIKINENVRGEEVFIIQSMCFPVNDNFMELVITADALKRASAKKIIAVIPYLGYSRQDRRVYNEQVPITAKMIANLLAASGICHVIIVDLHCEQIQGFFDIILDSITTENIFFNDIISQKLNQPVLVSPDFGGMKRVRRISKMLNHKDIVIIEKYRPKLNESEVIKVIGDVNNRDCILLDDIIDTASTLCKSALCLKKLGASKIICYATHPVFSKKSYKNIKNSEIDEFIVCDSIPLNVNIKCFNKIRVLTISKILADHIFSISKLNK

SEQ ID NO: 27285 - protein, 78 aa, Pseudomonas syringae pv. tomato str. DC3000
MSTIEERVKKIVAEQLGVKSEEVVNTASFVEDLGADSLDTVELVMALEEEFETEIPDEEAEKITTVQAAIDYVNSHQA

SEQ ID NO: 27286 - protein, 210 aa, Azospirillum brasilense
  misc_feature (176)..(176): Xaa can be any naturally occurring amino acid
MYDFEPKMNALVPMVIEQTNRGERGYDIYSRLLKERIIFLIGGVNDAVASLICSQLLFLESENPSKDIALYINSPGGYVSAGLAIYDTMQYIRPQVSTVCMGQAASMGSLLLAAGAPGKRFSLPNSRIMIHQPSGGAQGQASDIEIQAQEILKLRSRLNDIYVKHTGQSLDTIEAXMERDKFMSPEEAKAFGLIDEVVEKRPGSIGDGAA

SEQ ID NO: 27287 - protein, 250 aa, Zea mays
MLSIAGAIGAGLFIGSGHAIAAAGPAAILAYIMSGTLVVLVMRMLGEMAVASPDTGSFSTYAERAMGRTAGFTIGWLYWWFWVLVIPIEAIAAAAILHAWFPAIETWEFALAVTGLLTVTNLFSVARYGEFEFWFAMLKVIAVLGFIALGALALTGALPDVSVSGVVNLSHEFGGFMPNGMTAVIGAMLTTVFSFMGTEIVTIAAAESKNPSKQITRATNSVVWRMGIFYIVSVFLIISIVPWNDPMLVQ

SEQ ID NO: 27288 - protein, 714 aa, Legionella pneumophila str. Lens
MIKKIHRWLPLLVLIGLLVLFFSLHLDKYLSFNALRENHALLIAWTQTHYFIAPLIFIVFYTTAVAISIPGAVLLTLTGGFLFGVFWGVLFVVISATLGATILFFAVRSALGDWFAQKASGWIERMRRGFQHNAFSYLVTLRLIPLFPFWAVNIVPALLNIRAKTFVTATFLGIIPGTTVYVMVGNGLSQIFAANQTPNLGIIFELQILGPLLALAVLSLMPVLYQFSTRKHQNHHSFSDISRVINCDLAIIGGGAGGLSLASGCSQLGLKVVLVESGKMGGDCLNYGCIPSKSLLAAAKTFYYAKHATHFGVHTEAIKVNFEQVMQHVHQIIDNISEHDSVQRFESLGVQVIKQVGKFLTPDTLQAGDSIIKAKRFVIATGSSPFIPPIPGLDAVSYFTNETIFDLKEQPEHLIVIGGGPIGCELAQAFAMLGSKVTLLEGLNLLPKDDPDCVAVLRTQMKSMNILIYEQIEITQINSHPDKGISVCFEFQNTQFIITASHLLIATGRRANVKPLDLEKAGVKLTSKGVEVNKYLQTSNKKIYALGDVTGLYQFTHMASYQAGIVLRNIVFKLPSKVDYRAIPWVTYTDPELAHVGIGVSDALRHPDTQIIEWPFVDNDRAQTEHTLNGKIKIITDKKARILGVTIVGPHAGELILPWVMAIREKKTLRSFTDVIVPYPTLSEISKRVAGSFYAPKLFSNKTRMLVRWLQKIG

SEQ ID NO: 27289 - protein, 457 aa, Solibacter usitatus Ellin6076
MVIVPGVVLYFNPLPGMNAGQEHLFAFFVATIIALVAQPVPMGVSVLLAMTLVVVTGTLTAAKVLSGFGNVTVWLVFTAFLFSRAVTQTGFGMRVGYLFIERFGKTPLRLGYALAGADLVLAPFIPSDTARGGGVVFPVTRSVAKAFGSEPGATARKMGSFLMLVSFHTTYTASAMFLTGMAANPLIAEFAYKIGHVELTWGRWLSGSILPGMLTLAFVPWLLFRLARPEIQDTTAAREMARKELARRGPMGREEKWLVAIMGAVMAGWVTSPWHGLPNTFVALSGLCALLLARVIAWEDLLAEHRAWDALIWFAPLVMMADAMNENGAIKILSGGLFGLVHGWPWLMVLLLLVTAYCYVHYGFASMTAQVTALYPGFLAAALAGGVPPMMAALPLAYFSSLNAAMTHYGTGSAPVFFGAGYVRQGEWWRLGFLISVVNLVIWLGIGSLWWKLVGIW

SEQ ID NO: 27290 - protein, 260 aa, Aspergillus niger
ASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPADEGYAHGGVEYWSVDPYSAQNTFVCTGDEVQCCEAQGGQGVNDAHTTYFGMTSGACTW

SEQ ID NO: 27291 - protein, 528 aa, Chlamydia muridarum Nigg
MSIVLDKIGKTLGTRVLFDDVSVVFNPGNRYGLTGPNGAGKSTLLKIITGVIEPSRGTISLPKKIGILRQNIDSFSDVVVLDCVIMGNSRLWEAMQRRDALYAEEFTDAVGMELGEIEEIIGEEDGYRAESEAEELLLGIGIPEEFFSQKMATIPLDLQFRVLLCQALFGHPEALLLDEPTNHLDLHSINWLGNFLKDYNGTVIVVSHDRHFLNTITTHIADIDYDTIIIYPGNYDAMVEMKTASREQEKADIKSKEKKIAQLREFVAKFGAGSRASQVQSRLREIKKLQPQELKKSNIQRPYIRFPVSDKASGKVVFSIEGISKTYDADPLFNPFSLEIYQGDKIGVIGNNGLGKTTLMKLLAGVEQPSAGQIKLGHNVAFSYFPQNHADVLRDCGEETLFEWLRRRKTGITDQEIRSVLGKMLFGGDDAFKQVKALSGGETARLLMAGMMLENHNMLVLDEANNHLDLESVSALAWAINDYPGTAIFVSHDRTLIEECATKLLIFDKGVISFFDGPMSEYLASKKK

SEQ ID NO: 27292 - protein, 370 aa, Legionella pneumophila str. Lens
MNIFNLPDLGEGLPDAEIHEWFVKEGDTVKADQPLVSMETAKAVVDVPCPQSGTIAKLYGKPGDVIKTGEPLVEFVSTTEKPADKGTVVGNLEESTDVSEDNFIIGSQRSSHRVKTTPAVRLLAKKLGVDLSSLKGSGDNGVITREDVQNQANINSQPPVGFEPLRGVRRAMLNSMVQSHAEIVPVSIFDEADIHSWKPNTDITVRLIRAIIHASKKEPALNAWFDTKHAARRCFKEVHLGIAMDNEEGLFVPVIHDAEKYSDSELRKIIDEFKESVRNRAVSADKLKGATITLSNFGKFSGRFASPIIVPPMVAILAVGRLYKAAVINDEDKIEAHKMLPLSLSFDHRAITGGEATRFLGAVIESLQQA

SEQ ID NO: 27293 - protein, 508 aa, Bifidobacterium longum NCC2705
MADTNVNGGTQQATGKLKSVESLDQANEMERGLSNRHVQFIAIGGTIGTGLFLGSGKSISLTGPSIIFVYILVGIIMFFLMRAIGEMMYRDPSQHTFINFITRYLGNGWGHFAGWTYWAALVLLGMTEITAVSTYFITFFDTFGIDLTHWKWLIELCFLVVLVSINLIAVKVFGEVEFWFSMIKITLICAMIATAVVMIVIGYHYPAVQIHGVDHVSPAGHAGFDNLFANFSFAPNGWMAFLMSFQMVFFAYEMIEFVGVTVSETKNPRKVLPKAINEIIVRVLIFYVGALMAIMCIVPWTSFKPNKDGSFASPFIMVFQYAGLNWASALVFFVVITAASSALNSLLYSAGRHLYQLAGESPNPTLNKIGQVSDRKVPARAILVSAVLILLSPIVNAIPGVSGAFVLFSSASSAVFLFIYILTLMAHRKYRRSADFIPDGFVMPAWKVLNTVAIAFFVFIYLTLFLADDTRNSAIAGLVWLVGFGGFSMLRERYRSRDLKVALEHKEI

SEQ ID NO: 27294 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARVKSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 27295 - protein, 328 aa, Physcomitrella patens subsp. patens
MEVKRKMALELNDVVIKSMGMGAVFKDYGAKINSLDFHRTEDLLVTASDDESIRLYDFANATLLKTIHSKKYGVDQICFTHHTNSVIYSSKKDSDESLRYLSLYDNRYLRYFKGHRDRVVSLCMSPKNDCFMSGALDHTVRLWDLRTNVCQGLLRVRGRPAVAYDQQGLVFAVAMEGGAIKLFDVRSYDKGPFDTFLVGGDTAEVSGMKFSNDGKLMLLSTSNGHVYVVDAYSGKKLHGFSLEPNPDGGVLEASFSPDAQFVIAGSGDGTLRTWSTLSGVEVSCWANNAGVPACVKWAPRRFMFATASMALAFWIPDLTKLQRTDIGL

SEQ ID NO: 27296 - protein, 420 aa, Bradyrhizobium japonicum USDA 110
MSAVGNEPLARQALAFVLAGGRGSRLLELTDRRAKPAVYFGGKSRIIDFALSNAVNSGIRRIAVATQYKAHSLIRHLQMGWNFFRPERNESFDILPASQRVSENMWYVGTADAIYQNIDIIESHNARFIVVLAGDHIYKMDYEVMLRQHVDSGADVTVGCLEMPRAESSGFGIMHIDENGWIQEFLEKPADPPPMPGKPDVSLASMGIYVFDAKFLFDQLKRDAEDPSSNHDFGKDIIPYIVKNGRAIAHQFSTSCVRSGDDPRAYWRDVGTVDAYWAANIDLTDVVPELDLFDRAWPIWSYSEITPPAKFVHDEESRRGQAVSSLVSGGCIISGASLRRSLLFTGVRINSYANVENAVIMPYVNVGRGARLKNVVIDRGVEIPEGLVIGEDPELDAKRFRTTEQGISLITQPMIDRLNT

SEQ ID NO: 27297 - protein, 2197 aa, Arabidopsis thaliana
MERSRSKRNYHYDQDYDGDSMPRSKPRYNNNYHFGGGGGGNNRYRGGGGGGGGNGRPSKSHPETMATTTYRILCHDAKAGGVIGKSGTIIKSIRQHTGAWINVHELVPGDAERIIEISDNRRRDPDGRMPSFSPAQEALFSVHDRILESEAQFGYGGPPPEEEEDYGGVRPGGGRVVTRLVVSRMHVGCLLGKGGKIIEQMRIETKTHIRILPRESNLPRCVSLSEEIVQIVGELNAVKNALAIVSSRLRESQHRDRSNFQGRSHSPERSFAAAGDDYMPQLRRQSSDRFPRGNFRNNNFSSRQSNYAEEAPAVPVGENVYSEELVFQILCPADKIVRVVGESQGIIDLLQNEIGVDVRVSDPVAGSDEQIITISSEEAPDDPFFPAQEALLHIQTQIIDLIPDKDNLITTRLLVPSRDSICLEGKAGSVSEISRLTGTSVQILAREEIPRCASINDVVIQITGEIRAAREALVELTLLLRSHMFKELSQKETPPASTSTTGPLEGVAGVMEVASSNNTIQSREGPTSSNLNLQQVSTILPQFKEGFGSVAKAGESEHREEVPVTTSRMAVPLVTRSTLEVVLPEAVVPKLVTKSRNKLAQISEWSGASVTIVEDRPEETQNIIRISGTPEQAERAQSLLQGFILSTTAKTSPAASPFFEFVKKRRRIAPPSPFPPSNVIRHVVSRGTAYHKYENAIHHPLLFACQGVRYRKLEVILTTGIEKLGKAGETVKVAPGYFRNHLMPKLLAVPNIDKYAYLIREQRKMYNHEEVKEEVKVVHKTSEVQTKEYEKAAKRLANANLVLRKLVDKEKFKNRSSKDDKPDVQTPITKEEIVSEASVARQLCVKIDPDNVVLAAPLETFGEYEVPLKFPKTIPLPQGTVQWILKVKIPSRHYFSTRRVGEIAATRTKSFTLPPMVFSNSLLSSTTSLTTWANQSSSQSSLSPRYSTWQCVCLRNQKRKPKLYLIPARHFLSTPIDSVSSSSITASRYATSGVSEVQRSTSSNNVTEMEEFEMELQELFNEVKSMVKIGKESDAMDLLRANYVAVKEELDSGLKGIEQAAVLDIIALGYMAVGDLKPVPALLDMINKIVDNLKDSEPLLDSVLMHVGSMYSVIGKFENAILVHQRAIRILENRYGKCNTLLVTPLLGMAKSFASDGKATKAIGVYERTLTILERNRGSESEDLVVPLFSLGKLLLKEGKAAEAEIPFTSIVNIYKKIYGERDGRVGMAMCSLANAKCSKGDANEAVDIYRNALRIIKDSNYMTIDNSILENMRIDLAELLHFVGRGDEGRELLEECLLINERFKGKNHPSMATHLINLAASYSRSKNYVEAERLLRTCLNIMEVSVGSEGQSITFPMLNLAVTLSQLNRDEEAEQIALKVLRIREKAFGEDSLPVGEALDCLVSIQARLGRDDGEILGLLKRVMMIQEKEFGPSAQELIVTLQKIIHFLEKLEMKDDKFKFRRRLALLRERYKQNLSSIISRRKKKMSSETSSLTKKMKKKKEGLGWIESIKGWSCVFHEFLFQRFMASHLQNPLPLPSLNHLTCIVTGSTSGIGRETARQLAEAGARVVMAVRNTKAAHELIQQWQKEWSGKGIPLNLEAMELDLLSLDSVVGFCNLWNARLSPLHVLINNAGIFSMGEEQKFSKDGYEQHMQVNHLAPALLSLLLLPSLIRGSPSRIINVNSVMHYVGFVDPDDMNVVSGKRKFTSLVGYSGSKLAQARDLPRYVQVQYALIPYFIFSPQEGSRSTLFSATDAQIPEHCEKLKTEDKPVCTFISQNCKHTKPSEEAHNVETAERVWEKTIKLIGLPLDAVERLIEGEEVQCREKKKMSSEMKKNDGLGWIQWMRGWFNVVQEILLQRIMASHLQIPFHLPPLNHLTCIVTGSTSGIGSETARQLAEAGAHVVMAVRNIKAAHELIQQWQTKWSASGEGLPLNIQAMELDLLSLDSVVRFSNAWNARLAPLHVLINNAGMFAMGGAQKFSEDGYEQHMQVNHLAPALLSLLLLPSLIRASRSRIINVNSVMHYVGFVDPNDMNFVSGKRKFSSLSAYSSSKLAQVMFNNVLLKKLPLETGISVVCLSPGVVQTNITRDLPRLVQDLYSALPYFIFSPQEGCRSSLFSATDPQIPNHYQKLKTNEKSVCTLFISLNCKLTNCSEEAQNVETANRVWEKTLELIGLPSDTVERLVEGEVVKCRYRTR

SEQ ID NO: 27298 - protein, 199 aa, Triticum aestivum
MSVISDSIHWKRLEEHAKTMKNVHLRTLLQDNDRCKAFNAEHDGIFLDYCRQNITSETLDMLYELAGTAGLDEKKGNMATGKHINTTEDRAVFHIALRAPREKAFYVDGENVVPAVQAVIDRIADFSDRVRKSQWLGVTGKPLTSVVSIGIGGSYLGPEFVYEALRTDPEALQGAEGRTLRFLANVDPVDIARALSGLD

SEQ ID NO: 27299 - protein, 345 aa, Burkholderia xenovorans LB400
MKAINRIIEQARRSPMRIVLSEAEDPRVLQAAQRASHEGIARILLAGDAARIREAAARFDVDLSGMELVDPAASALAASYADELFALRGNKGMTPEQAQREILNPLCFANLMVRLGHADGSVSGAVNTTAEVVRTALQIIGIAPSFKLVSSFFLMMLCEPFHTLKGGLIFSDCALVVEPDAGQLAEIAIAAADSAKSLLMDEPRVAMLSFSTSGSAHHAAVDKVVNATHMVQERRPHLAIDGDVQLDAAIVSEIALRKVKHSQVEGHANVLVFPSLEAGNIGYKLAERIGGAKAIGPLLQGLRKPANDLSRGCSADDIYYVIAVTAVQAQAALTHPDALLTPSHS

SEQ ID NO: 27300 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 27301 - protein, 267 aa, Campylobacter jejuni RM1221
MMRVKFNGKELDTDFKTSLEFFENISKNENDVWIINGFATKENIALNEDDELFCIERNTLPPKDALDAMMRARHTPKLHDKLKNGRVAVCGLGGLGSHIAINLARSGVGYLKLIDFDVIEPSNLNRQAYRVSDLGKFKTEALKEQISEINPYISIEICTLKINEDNLKSLFKDIDIVCEAFDSAIAKAMMAQNFHRFYKDSILICASGLAGYGDSNSIQTRKIAKNFYVCGDLVNGAKLGNGLMAPRVNICAGHQSNLVLELLANKE

SEQ ID NO: 27302 - protein, 196 aa, Methanopyrus kandleri AV19
MRSVSVGEVARRDVITGSPTETAVEIAYKMREHGIGSVVIVNEKDEPIGIITERDLVIKVVSQGKNPDEVIARDIMSQPVITVEEDMEVNEAVKLMVDKGIRRLPIVDDNGKLIGIVTMQDILQVEPYLVATIEEEMKKFQEELEELEEVSEIIEGVCDLCETYSEELRFVDGVWVCPECYEDILGREIEDRELEE

SEQ ID NO: 27303 - protein, 438 aa, Clostridium acetobutylicum ATCC 824
MIDINFDKVISQIRECKTEYVEGIVNKVVGLTIEVDGIKAFVGEVCIIYNERNRPIKCEVVGFNEGRVILMPLGELEGISPGCRVVQTGIPLSVKCSDELLGKVLDGLGAPLRGEEVKSGVLYQLDREPPDPLKRRRIKNSIETGVRAIDGFLTCGEGQRIGIFAGSGVGKSTTLGMIAREAKADVNVIALIGERGREVLDFIEKDLGEEGMKRSVIVCATSDKPALVRLKGAFTATAIAEYFRDKGKKVILMMDSVTRFAMAQREVGLATGEPPATKGYTPSVFAMLPRLMERSGMAETGSITAFYTVLVDGDDFNEPIADAVRSILDGHIVLSRNLAAQNHYPAIDVLSSVSRLMSEIADSDHKKAAGLARDLLAEYKKNEDLINIGAYVKGTNNKVDAAINYNDRIISYLKQGIEEKSSFEESINSLKSMFNITQ

SEQ ID NO: 27304 - protein, 437 aa, Chlamydia muridarum Nigg
MFKEKKAPLVCKFGGTSVGTSSSIQRVCEIIRKEKPSFVVVSAVAGVTDLLEEFCRAPVGQKSQFTAMIREKHESIAKELGIDVAIEPFLGPLKQFEGAGHLQQEDQAKILAIGEDLSASLICSYCRANSLQLEQLEARQVILTDSQFLRAEPDLALMQTMWGELVLKENTIYLMQGFLGATASGATTVLGRGGSDFSASLVGELCEARELRIYTDVRGVHTADPKILKDTQLIDFLTFEEMQELASSGSKVLHQDMLKPCIRAKVPIFVTSTFDLTKEGTWICASLNEGVEGPEIKALSLKANQALWFVEYHSPLMRLENVLRCVRGLGSIPGVVMAQNSGVYFTVDWEENNQSMTEALREFGAVSCEGPVSLVALVGAKLTSWSMTGVFDALQGTPVLYWSQTDTVINLIINEESGVVVTKLLHDYVLGLNRSGL

SEQ ID NO: 27305 - protein, 483 aa, Burkholderia xenovorans LB400
MMERGGDMQRSTETTELKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLRGRRSDAMPGEPETVEYRHHHR

SEQ ID NO: 27306 - protein, 956 aa, Pseudomonas aeruginosa UCBPP-PA14
MLELDTRQIRMGQRAADKAEALRLLGAALVADGLAAPGYAEGLKAREAQGSTYLGQGIAIPHGTPDTRELVFSTGVRLLQFPEGVDWGDGQQVYLAIGIAAKSDEHLQLLQLLTRALGEADLGPALSAAASAEEVLGLLQGAPQELALDAQLVGLGQNAEDLDELAWLGARLLKKAGCVENGFAAVLQQTEPLPLGDGLCWLHSEQLVKRPGLAFVTPAQPLQHQGQPVTGLFCLASLGEAHQALLERLCDLLLEGRGAELVRATSSRSVLAALGGELPPDWPSARAVLANPHGLHARPAQALAQLAKGFAGEIRVRLADSEAAPVSAKSLSKLLALGARRGQTLEFSAEPAIAEDALPALLAAVREGLGEEVEALAEEALPDAVGEAEEDARPAPLRAGERLQAIAASPGIASGPAHVQVAQRFEFQPRGESPAHERERLLRAKRAVDEEIVGLVERSTVKAIREIFVTHREMLDDPELAEQVQLRLNRGESAEAAWSRVVEDSAAQQEALHDTLLAERAADLRDLGRRVLARLCGVEAPREPEQPYILVMDEVGPSDVARLDAQRVAGILTARGGATSHSAIIARALGIPALVGAGAAVLGLEPGTALLLDGEHGWLQVAPSTEQLQQAAAERDARQQRQARADAQRLEPARTRDGHAVEVCANLGDTAGAARAVELGAEGVGLLRTEFVFMNNARAPDLATQEAEYRRVLDALDGRPLVARTLDVGGDKPLPYWPISHEENPYLGLRGIRLTLQRPQILETQLRALFRAAGERPLRVMFPMVGSLDEWRQARDLALRLREEIPLADLQLGIMVEVPSAALLAPVLAREVDFFSVGTNDLTQYTLAIDRGHPSLSAQADGLHPAVLQLIDMTVRAAHAEGKWVGVCGELAADPLALPLLVGLGVDELSVSARSIALVKAGVRELQLVAARGLARKALGLASAAEVRALVEAEVQ

SEQ ID NO: 27307 - protein, 371 aa, Aspergillus oryzae
MTIAKTYNILVLPGDGIGPEIMAEATKVLSAFNTSTVQFNTRSELIGGCSIDLHGKPITDAVKEAALASDAVLFAAVGGPKWDNMRRGLDGPEGGLLQLRKAMDIYANLRPCSADSPSRSVAREFSPFRQEIIEGVDFVVVRENCGGAYFGRKVEEDEYAMDEWAYSTSEIQRITRLSAELALRHDPPWPVISLDKANVLASSRLWRRVVEKTMAEEYPQVKLVHQLADSASLILATNPRVLNGVILADNTFGDMISDQAGSIVGTLGVLPSASLDGLPSETRRRTNGLYEPTHGSAPTIAGKNIANPVAMILCVALMFRYSLDMEREAQQIEEAVRTVLDSGIRTPDLGGKAGTTEVGDAIVAVLRGQKL

SEQ ID NO: 27308 - protein, 448 aa, Oceanobacter sp. RED65
MLVNNDNSVAPMTQSKPLLSESLTGEQISELDAKHVWHPYSSFNSPLLPFPVESTEGVRIRLKDGRELIDGMASWWSAVHGYGHPVLKQAAHDQIETMSHVMFGGLTHEPAVTLCEKLVKLSPDGLNKVFICDSGSVSVEVAMKMAFQYALSQGNRERNKLLTVRSGYHGDTFATMATCDPVNGMHHMFENILPKHIFAEAPPCKFEEAFSESHIQDLKDKLVQHQQEVAAIILEPIVQGAGGMRFYSPDYLKRVRELCDEYDVLLIADEIATGFGRTGKMFACEHAGITPDILCVGKALTGGFMSLAATLCTDKVAKGICEGEAGVFMHGPTFMANPLACSVANASLDLLMSGEWQQQVANIESGLKIGLGPAKALSQVEDVRVLGAIGVIELHEPVDMPTVQPQFVQEGVWVRPFGRLVYVLPPFVIENEDLAHLTKAMVSVVSRL

SEQ ID NO: 27309 - protein, 289 aa, Kluyveromyces lactis NRRL Y-1140
MEKLLHWSIANAQGDDEAKARAGQPDPKLLEQLFGGGPDEPTLMKHAMAVISNPEATLENKLVAFDNFEMLIENLDNANNIENMKLWEPLITVLDDPEPELRAFALSVTGTAVQNNDQSQNNFAKYDGALAKVIKLASGRAEDAQVRTKAFYTLSNLIRHNKLIYDQFNQLNGLQIIAPVLKDANASEKLKLRAMALLSTVLTVADMNADFFALLRAYNIIETTLEFLHPECNLYLIDRVLNFFSQLINVGFEFSATELEKLKVGVKNIEPVEAQLNEDDYKTVQYVSK

SEQ ID NO: 27310 - protein, 809 aa, Oryza sativa
MAGSTTSATLMPEPNIVPGVGPVIGLEEGWAKIYRDGVQRVFHMVAGRDAAAGRAFNNREYMALYTTIYTMCIQKAPHCWTAQLYDRHELALVEYLDGTVLPAIEQKKGEFLLKELVQRWANHKLIKQWMCDFFRYLNRFYVKRHNKKPLEEVSILRFKTNVYKKVKGKACTAVLELIRRDRDGEQGVDRDLLRDAIAIFVDMGMGNGKTYQYDFEAAFIDHSANYYSRQSALWLSGDSCPEYLRKAEARILQEKRRVAEYLHSGTDEPLMETLYQTLLIRHQSELLDKENTGLRVMLKTHAEQDLARLFILYSPVPSSLPPIARTLNAFILDVAAALLDKCTASRTTATEYIPELIRVHERYYDLVSGACFCGHATFHRALKDAFELIVNKKVLAAPAAPAAPAAPAPAAAPAAAGAGAAAAGAGADAKAAGSSSSSAPAAPIHTAELLANYTDVLLNKTGTRLDEKKLESTLNNVVRIFSYLTDKDLFSEFYRTLLSKRLLLGRSASTDAEKSLIGKLKLKCGAQFTSKLEGMLNDMRNASDHNQSFKDFLRDKKRDSELNGIDFSVQVLTTGFWPNGVSKTEDVKLPAAMQSCMDVFRAFYDTHTNNRVLTWLHNLGVVTLTGFFTKRKSDLVVSGVQAAILLQFNEHNDLSIEELAKVTGLTPENLKAQLRVLVSGKYKVLLKRPAEGYKPDHRVSVNLAFSDAQLRVRIPPAMVVGGAVSEKEREKDVESVEEDRRHAVEACIVRIMKARKTLEHQQLMLEVSQQLMQFFKPDPKAIKKRIEDLIAREYLERDAEKNTQYHYIA

SEQ ID NO: 27311 - protein, 336 aa, Mycoplasma hyopneumoniae 232
MKKIAINGFGRIGRLALRRLFEVNDENLQVVAINDLTDASVLAHLFKYDSAHGKFNGEVEVLKDNGKNYLKIKGQKILVLSERDPKSLPWGQLGIDLVVECTGFFASKSGASQHLEAGAKKVIISAPAGNDVKTIVYNVNCDTITEDDRILSSASCTTNALAPLVNALDKEFGINHGFMTTIHAYTADQRLQDAPHGDLRRARAAGVNLVPSSTGAAKAIGLVVPSLTGKLDGIAIRVPVITGSFVDLSVELKSNPSIEEINQKMREYANESFAYCDEPIVSSDIIGDRHGSIFDATLTKYIEANGKKLYKLYTWYDNEYSFVSQFVRVIRYFVQK

SEQ ID NO: 27312 - protein, 410 aa, Cymbidium hybrid cultivar
MGLGDSEQQLLSRMATNGGHGENSSYFDGWKAYDRDPYHPTQNPEGVIPDQMGLAENLLCHDLIEEWIRKNPAASICTEEGVSQFRAVANFQDYHGLPFFRQAVAKFMEKVRGERVRFDPDRIVMSGGATGAQETLAFCLADPGDAFLIPVPYYPAFDRDFCWRTRARLLPIQCDSSNSFNITPSALEAAYINAQKSNIRVKGILVSNPSNPLGTTMDKQTLQSLLRFANEKRIHLICDEIFSGTVYKPPHFISLSEVVEADQAAFDRDLVHVVYSLSKDLGLPGFRVGIIYSYNDAVVQCARKMSSFGLVSSQTQHLLGCMLADEEFTSKYLAENARRLKERHGVFTDGLARVGIRCLDGNGGLFCWMDLRSLLKEATVEGELELWRVIINEVKLNVSPGSSFHCGEPG

SEQ ID NO: 27313 - protein, 379 aa, Yarrowia lipolytica CLIB122
MTDITMIPGPIEFDPEVLSAMSHQSVAHNSPQFVEVFGSVLTDLRALFKSTDPKAQPFVIAGGGTLGWEIVGANLLKRDDKALVISTGFFSDAFADCLKVFCDHVDVISAPAGEAPSLGEIETALKKEKYNLITLTHVDTSSGVVIDIKAISELVHKVSPDTLVVVDGVCSVGVEPISFDDWGLDFVLTAPQKAIGAPAGLSISMASPRAVAKVESLEKIPVYFGNLKKWLPIMQAYEARKPAYFSTPAVQNVYALQVALKQILHNGISLDQRFENHKQVSDKIKKQINDWGLEIIAKPGLGAHGLTCIYLPEGVTLPDFLPKVAAKGVTLAGGLFKGINTKYFRFGHMGVSAVDPKRDDVDRTLKAIHDSLVEAGYKC

SEQ ID NO: 27314 - protein, 644 aa, Thermosynechococcus elongatus BP-1
MEDKNTMVASPPSADAALKRSKIEALKERSQHLREPVATELLEPTNRFSEEGAQILKFHGSYQQDNRDNRVKGQEKDYQFMLRTRSPAGYIPPQLYLTLDRLAEEYGNRTLRATTRQGFQLHGILKKNLKAAIAAIVRSMGSTLGACGDLNRNVMAPPAPFRDRPEYTLAYEYAHRIADLLTPQTGAYYEIWLDGEKVISAEEHPDVKAARQRNGNGTIFPNNEEPIYGDHYMPRKFKCCVTVPGDNSVDLFSQDLTLVVITNPQGQLEGFNIYAGGGLGRTHNKEETFARLADEIGFVRAADVYDAVKAIVATQRDYGDRYNRRHARLKYLIHDWGVEKFKAKVEEYFGKPLEPFRPLPPWRYQDFLGWHPQGDGKFFYGLSIANGRILDQGNFKLKSALKKIVEDFHLPLRVTPHQNLLLCDISPEQQDAIQHLLEEHGVRDVSAIDPLERYSMACPALPTCGLAITESERAIPGVLERIRRLMDRLGLKDEHFVIRMTGCPNGCARPYLAELGFVGIVPGAYQTWLGGSPDQTRLAEVYIERLPIAELETVLEPLLVFYRDRRQQGESFGDFCHRVGFAALRQFAANYVPTAPPKRYRVDVRADQYQQLKELAAAEGRSLAAVTREAIQHYLEQSRQNKQG

SEQ ID NO: 27315 - protein, 324 aa, Cymbidium hybrid cultivar
MESGSFPVINMELLEGSSRPEAMAVLRDACQNWGFFELLNHGISHELMNRVEAVNKEHYRRFREQRFKEFAAKTLASGEEVDSDNLDWESTFFLRHLPTSNISEVPDLDDDCRSTMKEFAREVEKLAESLLDLLCEDLGLEKGYLKRVFCGGSDGLPTFGTKVSNYPPCPKPELIKGLRAHTDAGGIILLFQDDKVSGLQLLKDGEWVNVPPMRHSIVINIGDQLEVITNGKYKSVLHRVVAQTDGNRMSIASFYNPGSDAVIFPAPALVEREAEEKKIETYPKFVFQDYMNLYVRQKFEAKEPRFEAMKSMESVSSSQLIPTA

SEQ ID NO: 27316 - protein, 561 aa, Saccharomyces bayanus
MSQVQTSLTGGNSGLAVNNISTTMNSQMPNRSNIRLVNGNLPPSLHVSSNLNPGNSSAPHSGSQSRDDSSIVGLHYKIGKKIGEGSFGVLFEGTNMINGLPVAIKFEPRKTEAPQLKDEYRTYKILAGTPGIPQAYYFGQEGLHNILVIDLLGPSLEDLFDWCGRRFSVKTVVQVAVQMITLIEDLHAHDLIYRDIKPDNFLIGRPGQQDANKVHLIDFGMAKQYRDPKTKQHIPYREKKSLSGTARYMSINTHLGREQSRRDDMEAMGHVFFYFLRGQLPWQGLKAPNNKQKYEKIGEKKRLTNVYDLAQGLPIQFGRYLEIVRNLSFEETPDYEGYRMLLLSILDDLGESADGQYDWMKLNGGRGWDLSINKKPNLHGYGHPNPPNEKSRRHRSKNHQYSSPDHHHQYTQQQQQQQQLQAQAQAQAQAQAQAQAQAQAQAQAQKQQQQLQQAQAQQQADRYQIQHSDSHYDEEREASKLDPTSYEAYQQQTQQKYAQQQQKQMQQKSKQFTDTNANGQTNKYPYGAQPTTNNEPNANNGAQDMGSNKSSKGFFSKMGCC

SEQ ID NO: 27317 - protein, 523 aa, Saccharomyces bayanus
MSQRSSQHIVGIHYAVGPKIGEGSFGVIFEGENILHSGQSQTGSKRDSSIIMANEPVAIKFEPRHSDAPQLRDEFRAYRILNGCVGIPHAYYFGQEGMHNILIIDLLGPSLEDLFEWCGRKFSVKTTCMVAKQMIDRVRAIHEHDLIYRDIKPDNFLISQYQRVSPEGKVTKSCASSSNNDPNLIYMVDFGMAKQYRDPRTKQHIPYRERKSLSGTARYMSINTHFGREQSRRDDLESLGHVFFYFLRGSLPWQGLKAPNNKLKYEKIGMTKQKLNPDDLLANNAIPYQFATYLKYARSLKFEEDPDYDYLISLMDDALRLNNLEDDGHYDWMELNNGKGWNIKVNRRANLHGYGNPNPRANGNTTRNNTNMNSKTRNTTPVPTARQQVQNSNNNMDNSKSRISSNPQSFIKQQLLKKNEPNKYIPETHSNLQRPMKSQSQTYDSISHPQNSPFVTYSSLKPNPKRSTNEHNLSSHYSNFANKNINYQSQQNYEQENDAYSNNENEAFCSRFYNYCCCCFCCC

SEQ ID NO: 27318 - protein, 175 aa, Oryza sativa Japonica Group
MAAEAETKAMITLRSCEGQVFEVAEAVAMESQTIRHMIEDKCADTGIPLPNVSAKILSKVIEYCSKHVEARGGAAAAADGDAPAPAAVEANKAVEDELKTFDAEFVKVDQSTLFDLILAANYLNIKGLLDLTCQTVADMIKGKTPEEIRKTFNIKNDFTPEEEEEVRRENQWAFE

SEQ ID NO: 27319 - protein, 715 aa, Pseudomonas putida
MIYEGKAITVKALESGIVELKFDLKGESVNKFNRLTLNELRQAVDAIKADASVKGVIISSGKDVFIVGADITEFVDNFKLPEAELVAGNLEANRIFNAFEDLEVPTVAAINGIALGGGLEMCLAADYRVMSTSAKIGLPEVKLGIYPGFGGTVRLPRLIGSDNAIEWIAAGKENRAEDALKVGAVDAVVAPELLLAGALDLIKRAISGELDYKAKRQPKLEKLKLNAIEQMMAFETAKGFVAGQAGPNYPAPVEAIKTIQKAANFGRDKALEVEAAGFAKLAKTSVAESLIGLFLNDQELKRKAKAHDEIAHDVKQAAVLGAGIMGGGIAYQSAVKGTPILMKDIREEAIQLGLNEASKLLGNRAEKGRLTPAKMAEALNAIRPTLSYGDFANVDIVVEAVVENPKVKQAVLAEVKGQVKDDAILASNTSNISINLLAKALKRPENFVGMHFFNPVHMMPLVEVIRGEKSSEVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVFDATVLDVLKPVVFEQRDVTDEDIINWMMVPLCLETVRCLEDGIVETAAEADMGLVYGIGFPPFRGGALRYIDSIGVAEFVALADQYADLGPLYHPTAKLREMAKNGQRFFN

SEQ ID NO: 27320 - protein, 562 aa, Idiomarina loihiensis L2TR
MPQTQRPLYIPYSGPNLLETPLLNKGSAFSKEERAAFNLTGLLPPRYESIEEQAERAYMQYRSFETPINKHIYLRAIQDNNETLFYRLLTDHLEEMMPIIYTPTVGDACEKFSDIYRSSRGLFISYSERDQIDDILRNATKQKVKVIVVTDGERILGLGDQGIGGMGIPIGKLSLYTACGGISPAYTLPVMLDVGTNNEKLLEDPMYMGARHKRIEQDEYDEFLDKFIKAVTRRWPGVMLQFEDFAQPNAMPLLRRYRDEVCCFNDDIQGTASVTVGTLLAACRQKGKKLSEQKVVFVGAGSAGCGIAEQIMIQMTAEGLTEEQAKRQIFMVDRFGLVMDTMDGLRDFQQALAQKTSDLNAWEYSGEYPSLLDVMHCAEPDILIGVSGQAGLFTEQVISTMAKNVERPIIFPLSNPSKHVEAHPADVLKWSEGKAIVATGSPFGEVEYDGRIYPIAQCNNSYIFPGIGLGVLSVKSERVSDEMLRVASKTLANASPSANGKGEALLPAFNDLTQLSKDIAFAVGKVAQQEGLALEIDDDTLRERIDNNFWKPEYRFYKRVSI

SEQ ID NO: 27321 - protein, 495 aa, Ralstonia solanacearum GMI1000
MNTETTSAAPSSDPVTFDTFGLHPDILRALAESGYTRATPIQAAAIPVVIAGRDVMGAAQTGTGKTAGFSLPIIQNLLPDANTSASPARHPVRALILTPTRELADQVYDNVAKYAKHTALRSAVVFGGVDMNPQTEQLRRGVEVLVATPGRLLDHVQQRSVNLSQVRMLVLDEADRMLDMGFLPDLQRIINLLPAHRQTLLFSATFSPEIKKLAASYLRHPQTIEVARSNATADNVRQVIYTVPDGHKQAALVHLLRQRAEQGLPSQCIVFSNSKIGCSRLARALEREKINANAIHGDKTQTERMQTLEAFKQGTVDVLVATDVAARGLDISQMPCVINFDLPFNAEDYVHRIGRTGRAGASGDALSLFAPGDERLLADIEKLIKRNLPRETLTDFDPTGEQARERERRERDERRNRTEIRRARERDERNGARVLDHTVVRPPFRPSEDPFFSRPYESNVPAEAAEAAKPAPAGGHPRSAKRPIAALLGGVPRKR

SEQ ID NO: 27322 - protein, 414 aa, Prochlorococcus marinus str. NATL1A
MTPERLGLLWGITVFSGAGARLLSVLTGLPGVVLLLLSGLLIGRSGLGLVEPLDLGKGLETIVGLLVSLVLFDGGLNLRFPGGAIKSIVLRISSIRLIISLAAGFFAAHWFAGLGWSVAGVYSAIVLATGPTVVTPLVRQIRLASPLSDVLEAEGLILEPIGAVLALLLLELVVGDLHGWRELFLGLLSRLGGGVLIGSLAGLFLSEGLKRLRSEPYIGIRLQLTLGVVFLLYGVCEWLLPESGLPASVAAGFVVGQRPSTQANELDKLIRELAQLAITMLFPLLAADVSWGELSPLGWGGITCVLFLMIIVRPIAVSIATYGLPLDNKQRLFLGWLAPRGIVTAAVASLFSIRLEQAGVLGAGKLQGLVFLTILMTVGIQGLTAQPLAKMLGLLDEDKDLDKPTNSGSIFTES

SEQ ID NO: 27323 - protein, 566 aa, Chlamydophila caviae GPIC
MKVALSFKHLVPKLYTCIKDGYTFNTFKKDFLAGLTVGVLAFPFAIAIAIGVGVSPIQGLLASIIGGFIASALGGSRVLISGPTSAFISILYCISAKYGVEGLFTITLMGGVFLVAFGLTGLGTFIKYMPYPVVTGLTTGLAVIIFSSQIKDFFGLQMGDSVPTDFIAKWIAYWDYLWTWDSKAFAVGLFTLLIMIYFRNYKPRYPGVMIAIIVASTLVWLLNIDIPTIGSRYGALPKSIPMPSFPHLSLTKILQLMPEALTIAVLSGIETLLAAVVADGMTGWRHQSNCQLVAQGIANIGTSFFAGMPITGSLSRTAASIKSGATTPIAGLVHSAFICVILLALAPLTVKIPLTCLAAVLILIAWNMSEIHHFIHLFTAPKKDVVVLLTVFILTVMTNITSAVQVGMMLAAFLFMKQMSDLSDVISTAKYFDENKQAKDDNFFSKSEVPAHTEIYEINGPFFFGIADRLKNLLNEIEMPPKIFILCMSRVPTIDASAMHALEEFFLECDRQGTLLLLAGVKKTPLSDLKRYHLDELIGVDHIFSNTKSALLFAQALINLESKASH

SEQ ID NO: 27324 - protein, 340 aa, Shewanella sp. MR-7
MKHKKQDIKPCIAQESIDRTFSIAPMLDWTDRHYRYFARLMSANALLYTEMVTTGAILHGRGDYLAYNQEEHPLALQLGGSNPAELARCAKLAAERGYDEVNLNVGCPSDRVQNGRFGACLMAEPELVAECVDAMKQVVDIPVTVKTRIGIDEQDSYEFLTHFIDTVMAKGCGEFIIHARKAWLQGLSPKENREIPPLDYDRVYQLKRDYSTLNISINGGITSLEQAKTHLQHLDGVMVGREAYQNPYILAQVDQLLCGSQKAVISREAVIEAMLPYIEAHLQAGGRLNHITRHMIGLFQGLPGARAWRRYLSENAHKNGAGIEVVKQAYQSIQSEIIAQ

SEQ ID NO: 27325 - protein, 175 aa, Triticum aestivum
MAPTVMASSVTSVAPFQGLKSTAGLPVSRRSNGASLGSVSNGGRIRCLQVWPIDGIKKVEILSYLPPLSTEALLKQVDYLIRSKWVPCLEYSKVGFIFREHNASPGYYDGRYWTMWKLPMFGCTDATQVINEVEEVNKEYPDAYVRIIGFDNMRQVQCVSFIAFKPPGCEESGKA

SEQ ID NO: 27326 - protein, 291 aa, Chlamydophila caviae GPIC
MKRNDPCWCGSKRKWKHCHYPQAPQVSWEQQKQYYASQYDIILKTPEQIEKIRYACQITARILDALCEASKEGVTTEELDQLSRKLHKEYHAIPAPLNYGTPPFPKTICTSLNEVICHGIPNNNPLKNGDIMNIDVSCIVDGYYGDCSRMVMIGEVSDIKKRVCQASLDCLNAAIAVLKPNLPLYEIGEAIEACADTYGFSIVDQFVGHGVGIKFHENPYVPHYRNRSNILLAPGMTFTIEPMINVGKKEGIIDPRNHWEARTCDNQPSAQWEHTLLITETGYEILTLLEK
